United States Patent 8,781,750 (CELL-TYPE-SPECIFIC PATTERNS OF GENE EXPRESSION) - sequence listing, part 58

SEQ ID NO: 38586 - DNA, 43622 bp, Homo sapiens
cgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggtgagaaccaaggggaccgtcctgggcctggggtcacgggaggaggcccaagctgggcatggagtggttccctgcggccaccgccgccccgcgtctggagaggtgacttcaggaacctggagtccgggtgggggaaatgtagatgttctgccctctcctcagctcgagacagtcgcgtttccacagtaatttgtagagccacaccacgagggcaaggatcgtgtcagtcttgtgcctgctgcatcctcaggacctggcacccaaatcctgtaattgacttgagggccctcgctccccaagctcttaagcacgtattgccctttgcactgccccttctctgcggcgcgcaccttatcccgggctggtgaggtcaagtgcattgctcaggccattagtcctgcagaagccaccctagggtgcgccttctcaagggtgaggtgtctgcggctcaagccgcccaggaactcgagattctggttattcaaagcagaacgccttgaatgtgtgaatagctcttcgggacgtccacacacgctgactgcgtgggcctgaaaggccacttcactggttccgctctctgctcatttctggcttccggtgaagtgagttttcttgagctagtgttctagactagaggccacatgctttcctcacagtttctctctggctgtatttagtgcctttcgtcctaaataatcaacacattttactttttatccttccctatttatcttgttcttagtctcttctttggacagtacgtttttatctatttcccaagtgttattgactctacgatgttaaaacttttacgcgggattaacaattaaacgttgatgtagatattgcctgttgtacacagcttaatatttggaatgtcatttatcaagcatatgttgttcatcttctatatctcaggcacagtggtaaggattgggaaattttcttttttttgtttgagacagagtctcgctctgtcgcccaggctggagtgcagtggcgcgatcttggcccactgcaacctccatctctcggggtcaagcgaatctcctacttcagcctcccgagtagctgggattacaggcacgcgccaccatgcccggctaatttttttttttttagtagagacagggtttcaccatgctggccaggctggtctcagctcctgacctcgtgatccacccgcctcggcctcccaaagtgttgggattacaggcgtgagccacgcgcccacccaaggattgggaaattttcatgtgaataaaccataactgctgtttcgaataattgacagtcaaactataatatggtgtgttaattgctatgttagagtatatacaaaatgttaaaagtacacaggtcatggaggagcacagccagaaggaaaagcataaacagtagtgatgttaaagtatatgggttagccaacagctagcaaagtgactagaacataatatagcagactggaggaatatttatttggatctgaaactgaaaagataaactgaggacagattgtatgccatgttgtatagtttgaattgccctgtagtgactggggatttacctatcaaatatattttaatgctgaaatgacattattttcataattaaggtttattgtgcttttaagtgtgcagggcaggttggaataaagtgagagaagctagacatctcttaaaatggttggagtccgagatgattggctaaactagtgggttaggaaggaggagttagattcaataagtttgctatatttaaatcaacagttgcatgtggtaatgtctgctcttcattcctttgggagcagaaatacatccataacacgctaaattaaaaaaggagttctcagggctgccaaccttacagtagaggttgagtggtagtatattactcctacataagagaaaaaaaatcaaaaggactgcttactaaaagttggggaaaaaaagaggcaaaaataactccctggtttctagcctgggtggctggtgaaacactcttacaagtgaagagcaggcttgatggacaagaaaatggattcagatttggacagacactgagtttgacatgtctgcagatttagtcatatattttacgttcaaaaccttaacaatatgttaaagttaactttcagaaatgttgtactaggtaagtttgtttttactccttcaatttcatatgtgcagaaaacttggagatcatgcatgaaagaatgatatataaattcatcttctgtacatgcacatatgaaaaatcagcagctattaataaattggcttcattagcagaagaacctgcaaacaattaaatggtggtagtttatgtcaccatcagatgcttcaaagagaaaatcagtttattccaattatttccatcattttcattttttcacccaatttatagatttaaaaaagcttttggctgttgattctttcaaaaatgaaatacctgtattgtgaatgctgtcataaattcatttcaaaagttccatcattgaaagggaaatgaattgtagatgcagtaagtatgtaaatacagattttggtagaatgtagtatcattaaattaagaaactggtggagcagaactgtacttttaattggtatggtccacacataatacatatgtgtgccaaaacaaaccgtgatggtctgttaataaaaacagaagctgtaaatatttggttacagccaagatagagtaatggggactagattcatttttcttacaacaaaccagtgaccccagctttcattttaataagaaagtagaaaacctagagtaagcagatgacaggaaataataaagatcagagttgaaattagtggaacagaaaagagaaaaaaatggagaaaatacatgaaactaagagctgttttttggggaagatcaatagaatcactctagccagactgatcagaaaaaaagagatgttcctgtatttcagtataggaatgagagaggtgacatcactaaaattttacagatattaaaaataatattatgaacaactatgccaataaatttgacaatttagatgaaatgtacaaattcctttaaagacacaaattaccaaagttcacttaagaaatagataaccagtatatgccctgtgtttattaaagaaatggaaattgtagtttaaaattttcccacaaagaaattctagccaaggtggcttcactggtaaattctatcaaatatttaatattataaataataccaattctacataaactcttccaaaataattggagaggaaggaatgcttcccaactcattttctgaggaccagcattatcctgacaccaaaccagacaaagatattactagaaaagaaaattgcagacctatatccatcattaacttaaatgtacaaattttaaaccattttaccaaattgaatttagtaattcattaagtgaacaatacatcatgactaagtgggatttaccccagtaatttaggattggtttaacatttaaaaaatcaatgtaatgcaccatattaataagccaaaaaatcaaaaacatgatcatgtcaatagatgcaaaaggcatttgacaaaatctaacatctgttaagaattattaagtgttagattttatcctgcttgccagcaaataagttggcttgccagtttcatagatgctagcagacaacttttggtttagagataagggttgtattacttatagcatagtaggcagcaggagattcattttcacattggttgccttttcctccaagtccatgaggctggaggtgggctctggtggatgctgcacaagtagtgaggctgtattacacatgaggaactctcagctagagaactaatcttaacaaggggggctgctagccaacctgctcaacttttgcctttagggacacattatctttattatcctggacagcaaatcagccttccctctgcctcaaaaaaaaggtgctgtctctgtcttccaagtctgtttactatatgaacatccttgaaaagatggtccagagcaaagctggtaattccttgcagaagacgtgcagaaacaggagaaacccattgagaattgtcttgcaacaatatccagccttctttctacactaaatagccattccctcagccattctgctcaatatgacctgaccgacagggttggtgccaaatctgtttaatttgtgtctttataatgtttacagtaaaaaaactagatggctttcttggatttttgtattgacatttcctcttggctcagagcattaatccagggacagcaagatgtgtaagtgattttgcagactccaccttgtcatgcaaggaggaagagtaattccatcatctataacaactctgacccgtaagttagggcagatttgaaagacgtttgggtccaacgtggtgtttccttaacatgaaggtctattatgactgcttctaaggtacatttcatcttgttttgaggaaagagataatgcctggctttcacacaagaagtcttggggtgcatatggtgcccctggaagcaagtgttgcttcctattgttacagcccctaaaatgggaccagctcagtttaggggtacaaggtaacagtgcctgcaatttagggctcccattttagttaaaataattgagtctagtccttgtttaaggagagactacctgagtgctgtcaatccagtttttcctatttggtcacatcatcagccaaatggaatttatctgtaccatggaatgactgagactggggttgtggaagacatatgggagtgttttttggcagaggtgcaaaagctggggccattcttgctgcttctgatagatttatcggtagggttaggggaatgacaagttgtcaaaaccgtctgttggaacatagcatacctagcagttaaatttaacacactgacaacagtttgggagaactccacgagtgtttttcttggggctccaggttgatttttaagacagttatttttgaaatttgtttctatccctagacccatcggtataatacagatgtgttagttaataaatatttcaaagcattttaacgttagcacccgctttcgctttggaacagggttctggtttagatgacaaatcgtatgatcattttttaaaagacctagttcatttatccatgacagtttttttttttttttggtaaccagtgcaggtagtaatgatctctcttacctccgaacttccagaacatgttctatatatgcttcatatgtaatttatacattctatacagtttttgcattgtatgtgcttgtctcctaccagattgtgacatttttaagtattgtgacaatagtttattaatttctgtctttgccagggcctagtaccatgcttggcacgcaaaagatatttggtaaataccattttaaaaccttcccccctcctcaactttttatttaatatatattattggggagtctgtattaagtgattctttgtgtttattgtttgataatcttatatacctcacaagaattttgtggcttggatgaagcacgtaaatatccttgttttatatatgcatggtgcaagtgaggctcaaagaaattgtgttctttctcaaggttaagacctttacgacagtgctgggatcaggatgtaggtctctggaatcagcgcttatttctctttccattataccatgctgtattagatatttaacatatgtaaggagatagatgctaaattgaatactgtgttttccttacatgaacagatgtgtttgtgtttaatgtgagattgtttaagcagtgtcgctacttgaaattctaccagtgcaggaggctttgaggcacttttattcagcgtactttttctttattgttgtggtatgatgtagaatgttttaatgtttggcctgttttttgatttccaatagaagtaaccagtgttaacagttgcattaacatccttccatgcccttcttgacactgatagaaacataggtttacatttatgaggttttttccctaatttgatatatgtgaatgtctattattcttaatctgttgctagatattcagattttttctggttctcctccaccgcaaaccatgtagtaactctctttgtacatgtatctttaataccagaatgggcctttaatagatatttgctgaatagagcaaactgaggcacagaatggcatgaatgcccagtcacattgttagtttacccaacttttttttcttttttaaccactgtttttttgcagtagtctaaaggcttctctagcttttacttgaaaatcatatgaaaaattagaaagcgcccagactttgaaacctgatgtgggttttaattaggtttctggcacatactagctgcactttatgtagaggacataaaaaactttggtaaatacggttgatttttgtattgtgatgataatactggctaatagttggtggacccttaaagtgtgctgagcactgaattaaattatcttctacattatctcattaattcctccaaacagctctgtgagtgtgaggaatgtagagtttaaatggctgtattgctagtaaatgtaggagccagcattcaaactctggcagtttggagcccgagctcttaaccactacacgattactactgtacgctagagcagagtttctcaaccttggcactgttgatattttgggccaggtattactttgttgtcaggggttgtcctgtgcaacgtaggatatctatcagcatccctggcctctaccaaatagttgctagtagcctctcccctaccgtccacaccagtgacaataatgacaataaaaaaaagtctatcattgccaaatgttccctggggaacaaaatcaccctagttgagaactgctgtcttagaaggatatttgggaggggaggaggagacgtgactctgaagtagttgaaaatatacagttggaattcaggataaggatcagaactaaagatgtgatttgaaagttactgttaagtattagttatttactttcccagaaaaaaaagtatagagtaagaaaaaataataataatataaggctaaagacagagctggagaaatggaacagttgagtgaaaagagtggatagaggtgccagagattgagagagagagaaggaacagtcatagagtggtaattcaatgaaaataaactcttgaaactctttaaattataaatatactcccactgtaaataattgggatatattaaagagagtaatgagatttggctgtgagctttattagttttaccattttgttttgtcatgtgttgcatttcctttagttaatattttatttcatgttgaaggaaaaaatgaattatcctgtttactgaagaaaataatttattatttcaggttgccgaggagcccaagtagaagaaatatggagtttagagcctgagaattttgaaaaattaaagtaagtataattttagttgtgttaatatgtatatatatatactttaacaaacttaaaggatattcagatttgtttgtttattttacttggattactctaggttgaatacgttatgtcctttaagtctcttcaatcctgtgagatagatattattattatttttttataactaagaacctgaggctgataggtaacttgcaagggagtcaaacctaaggctctgtaattccatatccacaaagtactggttagttgatttttttttttttttttttttacaaaattcacttatatatcaatagtgttagaacatggaacacattttaacataaaaagcaagaacaatagctcagtgtactaaagcatatttgatagataatatatatttatagtaatccagaacttgcctacacactatcacattacctctgggaaagttatatttaaagttccaaatgttgatgccagaaacaacttttctccttcccccatctttctgaccagaatcacctcttttaacttctccttacccctgactaccatgccctcaaacattgaccctgtatcttcaaatggagggctagaggaattttcactggtgggagtcttggagtctggaatggggtcagggaatcttttaaaagggaaaatagggacttaggaatatgctaactgttgttaatagtaagaaggtgataggtagtttgcttcttcctacctttctcttccctgtaaaaagagcaatcactttagatgaaatgagatcatttgtggctaagatcagggaaggttaattaaaaatggatcatttgaactgtctttaaaaaatgggagccaggcatggtggcatatgcctgtagttgtagctactcaggaggctgaggcgagaagatcgcttgagcccaggagttcaagtctagcccaggcaacatagtgagaccccatgtctaaaataaaattgaatcaaataaaaagataggaaacctttttttttttttctttttctttttgaaacagtctcactctgtcatctaggttgcagtgcagtggtgcgatttcggctcactgcagtctctgcctcccgggtacaagtgatttttctgcctcagcctcccaggtagccgggattacaggcacgcttcaccatgcctggctaatttttttgttttgtttttgtttttttagtagagatgtggtttcactatgttgtccaggctggtctcgaactcctggcctcaagtaatctacctaccttagcctcccaaagtgctggaattacaggcttgagacaccatgcccagccctgaggataggaaaagttttttgtggggtgggaggcagttgtgatagatagactagaaggaatttcaaagtagtgatttaatgttttgtgctcaaaaacagttcctttaggaaagtggatgatttcattatgtatgagatggtagcatcaattcatactgcaatatgaggatttttcatgaatccaataatatatgaaggttacttcctatatttaatatagataatatatgctatcaaccgtttatctataaacatgttacatgaactttatatattttggagttcagccagcttctggttttactatattcttattttttaagtgaggtaatatcaggtagaaatgaatagtctacagatttgagaataaacctttcactacaattttattttaactgatataattttaagttgtattagcatcttctaaggcaacagtctagtaactatgaatggcaatagtgatcttttaaaaatttcccatatttacttcatttgtattatatttgttagataactgactaaaattttatagattaacaatgtattatgaaagaagcagggtttgatgtcattaatttgtattttattttgtaggccagttcatgggttaatttttcttttcaagtggcagccaggagaagaaccagcaggctctgtggttcaggactcccgacttgacacgatattttttgctaagcaggtatggtccttggatactctgaaaagtctcaagagcaaccctttttataaacaagactctagtttactactgtttgctactagtgtagtagtcctcaaactcttacactcttaaaaattattgacatctccaattacagtcttaaaaattattgacatctcaaaagagcttttgtttctgggattatctatcaatgtttgccatattagacattaaaactgaaacattttaataatatttacgccaggcatggtggcttataactgtaatcccagcactttgggaggccgaggcaggaggatcccttgagcccaggaatttgttttttctttttctgagatagagtcttgctctgtcgcccaggccagagtgcaatggtgcgaggctcattgcaacctccacctcccaggttcaagccgttctcctgcctcagcctcccaagaagctaggattacaggcacataccaccacaccaggctatttttgtatttttagtagagatggggtttcaccatgttggccaggctggtctcaaactcctgacctctcaggtgatacacccgccttggcctcccaaagtgctgggattacaggcgtgagtcactgtgcctggctgagcccaggaatttgacaccagcctgggaaacctgaagagacccgtctctataaaacaaaaacaaaaaaataaattagctgggcgtggtggtggcgtgcctgtggtcccagctacttgggaggctgaggtgggaacactgcatgagcccaggatatggaggctgagtgagatatgttcataccactacactccagcctgggcaacagagcttgaccctgtctcaaaaaaataagaaaaaaagaattatgaatagatttgaaagtaacaacaataaacttgttacatgttaacatcgataacattttttaatgaaaaataactatagttaccaaaaaattagctagaagattgcattgttttacatttttgcaaatcttttaaatgtctgccttaatagcacagctggatcctatctgcttcttcattcagtctgttgcaatgttttcgttttgttttgcttttggttgaaatcaataaaaaaagttctgtctcacacagatgtgtagttggaaaaagagaaatattatctttttcaggtaaatatattctttgacagtatgtcaacgctttaaaagtattgctttctcaaaggttagttgtaatgtaaaatttgtactttgttatggtaaaatcctttggattatgttgcccttcaaatggatcttttattcctgtatgattttgtaacattgtacatttaccgttttatgaatgtcttctaagtgttgacacattagatatgatattgttgagaagttaaattacccatagcaaaccttttaagctcacagtgggagatctaagttttacaaacttctaatttttaaattttcacttgaaaattcaaattttatcaacaacaacaaatattattaggtgtttgttcacaaagccacagactgatttaactcatttttaagaaaatatgtgccagatatccttgtctggaaaaccacatttgtctctcgtttgttctttcaagcaaaaatgatgttccaagggaaaaagctaacaatttagcttacaaatcaattgctgaagtactttcttcaagataactagcatatcttggtatacagcagtagttctttatttgtacttcctatttcattccacagaatattaaagacttgagacttgtactccaaggtcaaaatttgataaaaataagttttactgctttatcaaagacttttttttagtaaaacttgcttttgttttctttttttaaaactcttatgtatgtcagtgaaatagtttaatgtcattgcctagattcatgctaaaataccaccagttttacacactgttgcttttgtgccaacagtgcagatggaaaagaagaggaaaaggcaaaaactgtcttagaattacaatggaaaccattttgagctcacaaactccttgaaaagggtcttagggattcttagagagccatagataatactttgattgcatttgtttgaaaattgcacttatttctgagacccaaaaacttgcttagaatagtctgattaacctttagaaaggtggaaaataaaactgcttattctcattactgcccttgagataaagcttttgctactaagtaacttgttttcttttttcttttattttattgctgctttccattttcctctgacttttttgaattgagtattcttagagaaattagaacttcttgcttttactttaaggaaaatagggttttttatagtgtagttaaaaatgtatcatttgttttttttctgatagcagaacttaacattacagcaatataaatatagtgatgaacatgaatatccttgtaatcccacacccatctctactaaccttttaacagtttgactcatccatttaatcaacaagtaatcattgagcacctactttgctaggcattgttttagatactacatatataatggttaacaagagaggcatcctcaacaactataataataataatagtaataatacaaacagtaggcaacatttacctctcttgttgtgtgccagatattgtaatttgggtatattatttaatatttgcaacaagcccatgaggttgttgtcttcatttcacaaatgaagaaattgaggcctagaaaaattatttgcctgagatcacagagataatatgtagtacatccagaactccaagtataaaacccaggtttgtgactccatatgtcatacttcctcccacattttctgttcatatgctaacatgttttccttataattttgtttgctaaaattggattattatgcaaaatattttgtttttttttacttagtaatgaaagtttgactttgtttcatttcacaacacataataaatattagttaacatttattgaaagcttactaagtacttttatatatttaaaatgattatattttaaatttaaatatacaaaaattataaatttatatataaatttaattatttatatattctataaatatataaattattatatttaaatatatttaatatttaaaattattaatctgatcccttacaacaattatctggttttgcaggcttctcatcattttacagatgtggaaaccgagtcctagagaagataagaaacttgatcatgttatgtagctagtcagtggcagagctagggtgcaaacccaggcactgtggctctgaagtctgtactattaacctgatcacaacactgcctcctttagtgttcttggtataaatatcctgtaatttaattaattaatcttttagtagtcaacattttgagtttctaattatttccctagtctaaataatctggtcgggcatggtggctcatgtttgtaatcctatcattttggaaggctgaggtgggaggatcacttgagcccaggagtttgagaccagcctgggcgatatagggcgaccctgtctctaaaaaaaataaaaagttagccagacttggtagcacacgcctgtagtcttagctattctggaggctgaggtgggaggattgcctgagcccaggaggttgaggctgcagtaagctatggtcatgccactgtactccagcctggtcagcagagcaagacctgtctcaaaaacaaaacaaaaaatccaaatagtccatttgtataatatttttgtgcttatatatcattatacatatagtaactataattttaaatccacagttgtttgtaaattttaagatctacgtagtagagaaaagctaggggacagatgagtttaaaagtctgtgaggtgatttttctcctttttaaaaatgtttttattttttcaatgtatataagcatatatgccattataaaaatttaaacattataaagtggatgctgtagaaaataaaagtgtcttgtaatctctgctttagacataaccactgaaaacaatttatatttttacagatttttttcccatgtatgtttgtgtatatttgtgttaggttattcttgcattgctataaagaaatacctgagactgggtaatttataaagaaaaggtttaattgacctacagttctgcaggctttataggaagcctggtgctggcatctgctcggcttcttgggaggcctcaggaagcttttactcatggtggtaggcaaagtaggaacagacatctcacatggctgagctggagcaagagagaaagagagagtggggcacacatttttaaatgatcagattttgagcaacagctcacttaacaccaaggggatggcctaagccattcataagggatccacccccatgatccaaacacctcccaccaggccccaccttcagcattggggattacatttcaacatgaggtttgggcagggacaaatttagagactgtatcagtaaattaattaattgtgtttcttccacactaaactgtaaacctgggagttagggattttgtttttatattcagtccttggtacgtggtaggtatccaataaatgcagaccgaaccgttcatctctaagaatattactattaaacagtgctagaatttactaacactaagatactaatgatgtctgatttatagagacctagctacttttaaggtataagaaagtactctataaagaaagaaaaaaatgatagtagagtatgaatttataatttctggagtcccttgatattttttagttctgtgttacatttgtattattccagttgtgtttatgaaagtctcagattagtgattccccatatcattgttttggtactttattttgctaacgttcatattaaactgacaggtcaataattccccattaatatctgtcagtctttttagtatatgcctcctataagcctatgctaggagagttataatatatattacatcaatatgtaatagttgattttaggtttcaagggcttacagtaataatttccaatccaggatgtctggagtattttcagaaatttgaaaaaatttaatgaaatcatatttatttgataaggttatacagattaactaaatggcatttataatgggattacctcaatatagagaggtaacactggctattttgtgctgatcatatactctaattcaagggggttgcgtgtgtgtgtgtgtctgtgtatcattggttaataaaatattgaggaaagaaatatatcctagtaattgcaatttgtatataaggatccagaaatgaaattttgataactgttctccctctgcaaaatattgtagtcttgttatttcactgatgagagagctgaggtgtgatttacttgcttaaaatcatgctgcagtggtactggatttgtgtgactccatgtgttcagtctttcaggaaagaatgactgaatacctacaatgtgccagatactgtggtgcttggagaatgaaaaagtgccatgattcctgccctcaaatatgcttagagtttcgtggaagcaattgatattaatcaattaaatgttaaattacaatgatgataagtgctgaatggagtgaaatgaggactatattacgaagtttaggaactgtccacaaaactaccctcactttgaacaccaactgtagagttcgaccaagaccaccttcacctctgacagcattgcaggtttgtggtggggggatccccagatcatcctcaggttctataattggttagaagactcatagacgttactgaaagctgctatactcatgattatggcttattacaacagaggaatatagattaaaattagccaagggaagagccacatggggtagagttcaggaaagttccatgtgcagagcttccagttgtcttctcccagtagtgtcacagacagtgctcactattctggcaatgctatgtgacaatatgcagagtattgccatccaaggaaccccctccgattcttggtgtccaaagtttttagtgggccttggtcacatagacctggttggccacccatgtggctggaccttagtctccagccccacaggaggttgagctgataatcttgacccaatacccccaccctaagtcacattattagactatcagtgtggcccaaagctctcaggtaaacaaagactcttaggcattcaaggacttagaactcatctcccaggaaccaagggcaaagcccagacctctctttgggcaaggttaatttctttactatagtcataaaagtgggacttcaccttgtcagagagaaagcctctctgagtaagtgacagttcagctgaaatctaaaggttaagtaggtattaactaggggagagaggttcaggatcattccagattaattacagctttatagcaaaagtgagtaagactagtaaaaggtacaggaagaagaccaatgtagctgaactgtgcagagcaaaggggagatgtcctgagatatgaagcagaacaggaaatatgttagccaggatattaggtacagttaggcataggcataaaaaaaacaatagtttataagaaataggtggtttttttttttttttttttttttttaatattcaagagctgtcaaggctccaggctcttttgttttgctcctttgtgtatgttttctattccaaaggttatttcatggtccaagatgatttctggggcttcagccattctttctcaattccgtattcagacaggaggaaggggaaagcacactcctttcccttttatagaatttgcctgtgtcacatgtatgcttgtctctggccaaaactcagtcatttgagttagcagtagaggacactaagaaagttgtcttcattccaggtggtcatgagcctagataaaatttatgtactctagcctacagatgcagacagaggtcagatcttacagggtattttaggctgtgattgagacttttgtctttatctttagagtaatagaaagttactgaagtgttctaagaagagtgtcatgaacagattttcatttagaagaggccattttggctccagtgttgggaatgcatttgagaagtagtgtaggacaagagtagatgtaagttaggaggcttttgcagaagtccatgtgatagtaaacaaaaaactggaagtaaagacagatgtgaatagaatttagagataaagtattaccacctttaatgtgtaatagattagatgtgaggacggaggaggatgacattatgatgatggctgtttttcttttttcctaaaaagttgctcttaaggtacccagaatgggattataagaatccttggttaataacacatatatatgattggtttattcatggtctccttttatttatttgattattttaagaaacaaagtaagtgcctaagaacttaccgctgaaataaactttatctatgttacttccttctgtcccacccatcgttcaatgtacttctcgtcttccctctctccatccagtgtaacccttatgttgaattctgtttatcattttctttttatgtattttttgtaatcctgaaaaaggtgtttgtaaataaaattttaacttgataaaaagtatcgtgctctatatacattttgggagtgtttttttttttctttttttggagacaggatctcgctctgtcacccaggctggagtgcagtggcatgatcacagctcattgtagcctcaacctcctgcctcagcctcctgagtagctgggactacagatgcacaccaccataccctgctaattttttatatttttggtagagacagaatctcattatgttactcaggctggtctctaactcctagactcaaatgattctcccatctttgccctcacaaagtgctgggattacagatgtgaaccattaagcctggcctacttttttcacttaatattatattgttaagattcatccataagtttattatgatagttcatttattttgcatgctatatgataccagctgcactaacatgctacagtttacttaatcttctgtagtttgttctttgggttttcaatttgagttactgtgaattgtgttgctgtaaacattttttgtacatgtgcaagtttctcctggtgtatacctagaagtagaatgagtatttcatctaatatgtaaatgtgcaacttttgaaggaaatatccaaacgttttctgaagtagctgttcaaatttgcatttccactagcaatgtgtaggagttgttacaaagccacatattataacacgtggcattgctaggcttttaaatttttgtcagctaattggttccaaaatgctacttcatttttgtcttggcttatgtctccctgatcactaatcatgttgaaatgcccttcatgtgcttagtggccatatgtatttcctctgtgaaattcttgtttatgttatttttcaatggggttaattatgctttttttaaaaaaaatttattgatacatagtagatgtacatattttggggatacatgtgataatttaataccttcacataatttataaagatcaaattagtataattgggatatcagtcaccttaaatatttgtctttatgctagaaacattcaaattatcctcttatagctattttgaaatatatgatagattattgtaaacaataggcaccctactgatttgtcaaacactaggtcttctttcttctgttaaactgtatatttgtacctattaatgaaactcccttcatcctcttcaccaccccacccttcccagcctctggcaaccatcagtctactttctatcctgaagatttgctgttttagctttcacatgtgagtgagaacatgagatatttgtctttctgtgcttggcttatttcatttaacataatgacctccatttccatattgctccaaataacaggatttcattcttttttatggctgaataatctcacattgtatgtatatactacattttctttatccattcatccattgatggacacttaagttgattatatattttggctattattaatagtgccataataaaaacaaggagtgcagatatctctttgatatatttatttcccttctttcggatctgtatacccagtagtggattgctggattatacaatagttcattttttagttttgcataacctccatacagttttccatagtagctatactaatttacatttctaccaatagtgtttatgagggttcccctttctccacatcctcaccacttatctgtcattccctttttgttaaaagccattttaacttgggtgagatgataacattgcggttttgatttgcattgctctgatgattaatgatgttgagtatttttttatatacctgttggccatttgtatgtcttttgagaaatgtctattcagatcttctgtccatttttaaatctgattttttttatcttctcctgttgagttgcttgagcttcttatatatcctggtcgttaatcctttataagatgggtagtttgcaaatattttctcccattctgtgggttgtcgctttactttgttgattggttcctttgttatgcagaagcttcttagtttgatgtaatcctattcatttatttttgcttttgttgtctgtgctttttgaggtcttactaaaaaatttttgccccgaccagtgttctggagattttccccaatgttttcttatagtagcttcataatttcaagtcttatatttaagtctttaatccattttgatttgatttttgtgtacggtgggacactgggatctagtttcttttttctgcaatggttatccagttttcccagaaccatttattggaggaactaccctttctctattgtatattcttggcacctttgttgaaaatgatttatctgtaaatgcatggagttatatctggattctctattctgttccattggtctatgtgtctgtatttatgctagaatcctgttgatttggttattatagctttgtagtctattttgaagtcagataatgtgattcttccagtttagttctttttgctcaggattgctttggccatctcgggtcttttgtgttccgtataaattttgggattgctttttctgtttctatgaagaatgccgttggtattttgatagggagtgcattgaatctgtccattgctttcagtagaattgtcattttaacaatattaattcttccagttcatgaggatggaatatccagtttttggtgaactcttcatcagtgctttatacttgtccttgtatagatcttgcacttctttggtaaaattgattcttaggtattttagattattattttttttttgagacatagtctcactaggtcacccaggctggaatgtagtggcacgatcttggctcatctccaccttgcctcccaggttcaagctattcttgtgcctcagcctcctgagtagctgggattacaggcatgtgccaccatgccaggctaatttttgtatttttagtagagataggattttgccatgttggccaggttggtctcaaacttgaggccaggttggcctcaagtgatctgcccgccttgggctcccaaagtactgggattacaggcttgagccactgcacctggcctactttatattctttgtagctcttttaaataggatttttttcttaatttctttttcagattcactgttggcatatataatagcagctgatttttgtatgctgattttatattcttcaacttttttgtttttgagacagggtcttgctctgtctggagtgaagtagcacaatcatagctcactataaccttgtgctcctgggctcaagcaatcctcctgcctcagcctcccgagtagctaagactacaagtgtgcactagcacaggtggctaatttttagaattttctgtagagacagggtctcattatgttgaccagctggtcttaaactcctgggctcaagcattcctcctgcctcagcctcccaaagtgctgagattacaggtgtgagctactgtgcttggttatatcctgcaactttactgaactcgtttatcagttccaagagttttttggtggtctttaggtttttctaagattatgtcagctatgaacagtgctaattttatttcttcctttccagtttggatgccttttatttccttctcttgcctggttgctctaggcaggacttgcaatattacgttgaataaaatggtaaaaatgatcatccttgtcttgttcctgatcttagaggaaagactgtggtttttttttttttttttgagatgaagtctcactctgtcgcccaggctggagtgcagtggcgcgatctcggctcactgcaagctccgcctcccggttcacgccattctcctgcctcagcctcccgagtagctgggactacaggcgtccgccaccatgcccagctaattttttgtatttttagtggagacagggtttcaccgtgttagccaggatggtcttgatctcctgacctcgtaatctgcccgcctcggcctcccaaagtgctgtgattacaggcgtgagccacggtgcccggcctaagactttaactttttttaaattcagtatgatattagctgtgagtctgttttatgtggctgttattgtgttgaggtatgtaccttccatatccagtgtattgagggtttttgtcataaaggcatgttaaattttatcaaatgctttttcagcatctgttgaaataattaggtagtttttttcttggtatcacatttattgattagcacatattgaaccatcttgcatccctggatgactcttacttaatcaaggtaaatgaccttttttttttttttttttttaatactttaagttctagggtacatgtgcacaacgtgcaggtttggtttgttacatatgtatacatgtgccatgttggtgtgctgcacccattaggtaaataatctttttaatgtggtattatttaatttggtttgttacttttgaatttggtttgttactatttggttgaagatttttgcatctattatcatcagtgatactggtctgtagtttttttgttgtgtccttgcctggttttggtatcagaataatgctgattttgtagaatgggttggaaagcattccttcttcttcaatttttttgaagagtttgagtaaaattagcattcattcttctttaaatgttgagtagaatttagtaatgaagttgtcacatcctgggctttgctttacttttaattatggctctgatctcattacttgttattagattctttagatttttttattccttcctggttcagtcttggtaggttgtatgtatctaggaatttgtccatttctaggttttccaatttttttgtatatagctgttcataatagtttctaatgattctttgtattactgtgatttcagatgttatgtgtccttttttgtttctgattttatttatttggatcgtctttcttttttcttagcctgggtaaaggtttgtcaattttgtttacctttcctgaagatttttcatttccttgatcttaatattgtttttttaagtctcgatttcattgatttctgctctgatctttattatttctttccttctaataattttgggtttggtttgttcctgcttttctagttccttggggtatataattaggtggtttatttggagtctttctacttttttgatattttcgctatgaatttccctcttagtatgcttttgccatatctcatagattttggtatgctgtatttccatttttatttgtttcaatgcattttaaatttttttcttattttctttattggcctattcatcatttagtaacatgttgtttaatctctatgtgtttgtgtagtttccaaggtttctattattgatttctagttttattccattgtggtctgaagagaaacttggtatgttattttactataaatcatattattcagtgatttattgagaacttgttttgtggactaacatggtctatcctcggtgtatgctggatatccatatgctgatgaaaatagtgaaaataatgtgtattttgcagcagttgggtgaaatgttctgtaaatgtcagttaggtttatttggtttagtctgtagttaacctctgatgtttctttgttggttttctgtttgcatgatctgtcagagagagtagatagtagtatttgctttagatctataaacacttgctttatatttatacacttgggaactcaggtgttaggcgtatacatatttataattgttatattctcttgctagattgacccctttatcattatgtagtgaccttctctgtctgtttttatagtctttgctttgtagtctattttatctgatataaggatagtactcctgttctttttttttttttttttttttttttggtttccagttgcacagaatatcttcttccaccctttcccttttggtctatatatctttatagatgcggtgggttatttgtacccaccatattatggggttttatatctttatgaactcagagactctatgccttttaattgaagaattgagcctatttacattcagtgttattattgataagtgaggacttattactcccattttgttgcttgttttctggttgttttgtaattggtctcttccattcttacagtcttcctttgttgttaagaaattttctcaggttgtatgttttaatttgttgttttttatttttagtgaatctattacaggtttttgcattgcggttaccatgaagcttacaaaacatatacatatgacatgttattataaagaggtaacaacttagattataaagaaaagaatagaagcaaagaaaaaaactctacactttaactttttaccccttatattttgactttgtgttttgtcaatatacgtatttcttatattgtctgtttcaacaggttgctattggtattgctgtttggggtagatttgtcttttgggctttatatcagagttatgagcagactgcataccatagtgacaatattattctgggtttctttgtgtatttacttttaccagtggattttagaccttaaaatgttttggttttgcgcattagtgtttttttctgttcagattgaagaagtgcccttagcatttctcataaaacaagtctcgttgtggccacttctctcagcttttgtatgggaaagactttacttctcattcatatttgacggatagctttgctggagagagtattcttggatggtgttttttttttcttcttttagaatttgaaaatttcatcccactccctcctggcctgtatggtttctgttgagaaccccgttgctagatgaattgaagcacctttagatattgtttgcttgttttcccttactgcctttaggatcctctctttgtctttaacctttgagagtttgattattatatgacttggagtagttttctttgggtagttttattttttaggttgttgcctttggcataaagacaggcagttcactttcatctattaatattatatttagccatcctgctaaacttttctattatcactaataatttgtttttttttcttgagtgggtgtgtttttatcaaaatgaccatatcaggtataaataatgatagttttatttcctcctttataatccttttgactctaatttatttttcttgtcttagttcctagctaagaccctccaataaaaccacttgcaacttaaaagagaatgcctcttaccatttctccatttaggatgatgtttactccagcttttttatttttaatgttctgttattaattagtgtgtttattatgaaagtatattaaattttttcaaatcctttttctgcctctattgagatgatcttctgtattttcttccttttgctaggttaatgcagttaattatgttcggatttttctaatattaaatcattcttccaaacctgggataagcccacttggtcagggtgtattctctttttatgcactattgggttaaatatagtagtattttgtttaggtttttgcatttaaatttttgaatgaaatgtgtcttaatttttcttcttctgtaatggctttgactcgttttagtattaaggttattctggcttcatgaaatgagttggaattttctcttatttttagtgccttgaacaatttgtgtaaaattaaggtgatatacttcttcaaatttttgtagaattgacctgtatatccatgtaggcctggtattttctttgcgagaatattttaaaatactgcttcatttcagtagttaagggactattgtggctctttattttttcttgagttggttctggtaagatgtatttttttaaaagatttcttcatttcagcttaaattttcaaaatcatttcatacggttgttattaatattcttttattcttttaaatcttattttatttttagttatatttctaattcctagatttctcacttgcatgtttgtgtgatagtggttttatgtattatattaacctaccactctttattatttcatacttttattagggtaggaacctggctgatcttatttctccttttagccgccttcagtccttcctgtaaattgacttaaactgaatctttctgaaccactgttttgattattttatttctatattcaaaatgtcttactctttgggtaaactcctaattactcaaggccagtgacttaacaaggtaaagaataaccccactatgactataaccacactagtacaaatgaccaatatgctcattgtctcttgaacaacaagcacatcaaacatcttaatttgttcttttgttcacactgttctcactttttaaagtgaatttccttctctattctctagttcctaccaagctttcaaacccctattaaaatttcacatttgtgaaaaaactttctctgatactccagtataaaatgattttttcctttactattttgtttttctggtgttcatcccttttttctgtgtatctttctttatagagtcttcatgagcaggacatttatactttttttcagtatcactttctcttgggaaagctactgttacattctcaacctttttccttgactattaaaaaatttaaaattgtatgtatttatattgctatagctgtgactcaatgaagattgacaataatttttttaacttaatatatatatatattgtatactttaagatacatgtgcagaatgtgcaggtttgttacataggtatacacgtgccatggtcgtttactgcactgatcgacccatcgtctccattaggtatttctcctaatgctatccctccccttgcccgcaaccccccgacaagccccggtgtgtgatgttcccctccctgtgcccatgcgttctcattgttgaactcccgcttacgagtgagaacatgtggtgtttggttttctgttcctgtgttagtttgctgagaatgatggtttccagtttcatccatgtccttgcaaaggacatgaactcatccttttttatggccacatagtattccatggtgtatatgtgccacatttcctttttccagtctatcattgacgagcatttgggttggttccaagtctttgctattgtgaacaatactgcaataaacatacatgtgcatgtttctttatagtagaatgatttaaaatcctttgggtatatacccagtaatgggattgctgggtcaaatggtatttctggttctagatccttgaggaattgccacactgtcttccacaatggttgaacaaatttacactcccaccaacaatgtaaaagctttcctgtttctccacatcctctccagcatctgttgtttcctgactttttaatgatcgccattctaactggcgtgagatggtatcttgttgtggttttgatttgcatttcactaatgaccagtgatgatgagctttctttcatatgtttgttggccacataaatgtcttcttttgaaaagtgtctgttcatatcctttgcccactttctgatggggttgtttatttttttcttctgcatttgtttaagttccttgtatattctgtgtattagcctttgtcagatggatagattgcaaacattttcttccattctgtaggttgcccgttcactctgatgatagtttcttttgctgtgcagaagctcttcagtttaactggatcccatttgtcaattttggtttttgttgcaattgcttttggtgttttagtcatgaagtctttgcccatacctatgtcctgaatggtattgcctaggttttcttctagagtttttatagttttaggtcttacgtttaaatttttaatccatcttgagttaatttttatatatggtgtaaggaaggggtccagcttcagttttctgcatatggctagccagttttcccaataccatttattaaatagggaatcctttccccattgcttgttttttgattgactataatttatataggcagtactttaagctatttttatattattcctctggacatctactcttcttttgtataagctttgaaaagaaattctctagtctggggattacaaaatcaaatgccttcagtatcaggttgtcatcatgaatgtgtgaattggattgtgtgtaagaagtagagagtagaagtgccctgataaactaaagactatataccctggcgtaggaattcaaaccaaactcttaaggttctgggtcagtcctacttgagaccctctgctctagcctcatttctattattgaactctactgctttattttaaattatcttaaaagccagagttaaagtagaacacttaggtaagctaaagatttttaaagttgagaactacctaaataattcatactgcaatagattttttgtgacgtgagttacagttctttcaaatagaactttgactatatataagattatttttatgtgagatttaggaggacaaggaccacatctttcttattcactgttcagcctttattacaatgtctggcacgtagtaggtgctcagtaagtattatttgaatgaatgaatgaatggctgtacacctttaaattttcttttgttttttgttaattttgtactatgtatagcataaccacttggtggcactaaactcattttaaaacttgaagacaatattctcatacccatgtacattgtaacttttcttctcacagacacatacaaaatgagttctaatatatcatggacagtgtaaattattattgacatcaaaaaagaaagtaaccacaagaattttttctacttcttaaaatcctaaaataatggattacaaatttgaagtccttagattatagaaatgtttgataatcttttctgccgtagcctcactgcctagtttagcattgggtatatattaaatctttaaggtgtcttgattttgaaagaatgtgttaataagtataaattttaacttctcctaactttactcctcccactgtgctatcctcagataatttcaccttaggtaatttagacctaagataagggagtactaagtgttacagtgttttagtcaaccacatttataaagtcctctttaatcattaaagtttgcatccaaatttactaaagaactgtgattcggatcaaaatacatattcgtataagtcagcagcaatgctaattggattctggatctatcactactttttcctaattcatcaattttaagacagttttgaatacaaaatgcttaaagagaagaattgtagaagcatggtgatgttatagttattgagaattaggagtacgagactattctgtaatggagagtgcagtcttattaaggaatttctcaaatatacttcagtcaacagttcaggaactggtagatattcataagatcttaaaaacctctaccaacatgagaaatagagaactataagaattaaagaaggaaaataattgaatttttttcttctgaaatcaggcaggataaaaatagataatttactaaaatgtaaaatcataagctaattagcattattggaaagactaattacaatatagtaacataatactgtagtaggactaagctgtaatttaaaaaattattcagctctgtgattaaccttgctggtgttcacactgatcatctaaggttctttccagcttcatgatctcaataccataggtgcttaggcagtgtggaagaaactgctgttcataaagtggtttataatcttgttggagagaccacgtgtatgtacagagatagcctagcatgatggctatgtacacaaattctagaacaagatcagctgtgtgcccttgggcacttacctctttgtgcctcagcttctacaaatttaaaatgaagatgataatagtaatccttctgcataagttgttgagaggattaaaagaaataatgcatgtagagtgcctagaaaagtaactggcacatagtaaatgctatctaaatgttttttcctttggctagaatgtaaggtccagataatttgttaaatgattatagctagatgatagcaatgtaaagactgtagatgattgagtgaaaaaaaatatgtggacattgtataccctgtttgggaatttaaatgagggtggaaactaatgtgagttgggttcagaatttctctacaatcacacaggtgaattgaagcttatgctcggttataaaatactaattgaatttgaataggtagaaatgagtctaggaggaaatgaataggagagggggacaagctctgttggcttaatcagctatgttttccatcaggatgattgatcttgttaccctaactggattggtttttggtaatattatgagttcattgagttcatttggtttcctagaattttcaactccagaagtgcagcaaatttctgaaaatagattaggatagaaattaaacatatttattctgtttatgctgagacttcataaaatataatttgaaaactgttcatgttttggggccattgtcaccagttaaaaaccattttttatttttttaaacacattgatatcttcacttttatattttataggtaattaataatgcttgtgctactcaagccatagtgagtgtgttactgaactgtacccaccaggatgtccatttaggcgagacattatcagagtttaaagaattttcacaaagttttgatgcagctgtgagtacaatcttcttattcctaaaatgtcatatttgtgaaagtttgtatattaataggctactttaaaaaattattttagatgaaaggcttggcactgagcaattcagatgtgattcgacaagtacacaacagtttcgccaggtaaagagactttatgttaaataaatactgtttctttctttgcttctttgagtttcactatttttttatttactgtagacagcaaatgtttgaatttgatacgaagacatcagcaaaagaagaagatgcttttcactttgtcagttatgttcctgttaatgggagactgtatgaattagatggattaagagaaggaccgattgatttaggtaatgcagttcctgttcctgatatttcacttttgacaggggaaaatctgttgggtatttaccctcattcagtgctgcttaaattttcaaggtaaaagtgactatgaggtaacataatataatgaaggccttaagctcttcagtgtgttatattaatatataggaaggacatcttgactaccatagttcagttgatgcctttgagtttttcccaagtaaaattattttttaacctataggttacataatttatattttattttccatttaacatttaaaaactacccttagtgaacgtaaatagttactcttgtcatttttaacccattcgtaagggatagcaagcatttcttaacatccgtattaaagtattttcatttggaattggataatttattgttttgcaatcaagaaaatatttttcttaaaatttctctatttaaatagtgcgttaatgtgttatcctttctgcaaaaacatagattgttctgatcctaccccgtctctaatgctgagcaaaaaatgataaacacttatcaaagttgaaggtacaatctgtggctctgaaagattactgaaataataggttcacaaaataattttaactccttattttgacttcattaaattttctttttctttttttaataataggtttgaagtccaacacaacttgttttagttgaatctaatgttataggctattcataaaactttatacttttagattttaaaaaaattaacatgggtgcattttgtttgtactttttgccatgccccatgcgtagaaccaatagtttatccaatgcagatttacatgctgcctctatatttaaaaatatttatttttctatgtgtgttataaaaatttatttatggaattgaaacaacataattatactaaaaagagttttactgctctaaatttattaaaatatttgtaaaaaaatattttgggccaaacttttgcattttaaagttgattgttcttatttttatttgtgttaactgttttaaaatttctttctaggtgcatgcaatcaagatgattggatcagtgcagtaaggcctgtcatagaaaaaaggatacaaaagtaaatgctcagctaatctcattggcataatattctgttttttaagtattttttaaacttgtattttattgttattttagcagtgtgcattgaacatctacttttttttttctttttaatttttcgtagagacgggttttcaccatgttgcccaggctggtctcagactcctgagctcaagccatccgcctgcctcgacctcccaaagtggtaggattacaggcgtgagccactgtgcccagccaaacatctacttttgattgggttaatgcatttaagaagtctatttcagaaaatctctaaatttcatgtagtagtatgtcatcttgtctttagagaagttaaacatgcagatttccattaagttagataattttttattttcttttttttattttttgagacagagtctcactgggtcgcccaggctggagtgcagtggcacaatctcggctcactgcaacctctgcctcccgagttcaagcgattctcgtgtctcagcttcccgagtagctgggattatgggcacatgccaccacacccggctaatttttgtattttcagtagaggtggggtttcaccatgttctccaggcttgtctcaaactcctgacctcaagtgatctgcccaccttggcctcccgaagtgctgggattacaggcatgagccactgcacccggctaggtattttgtactgttggataattgacagttattttgtagagttttatttttgagggtttatttttaatattaagctctttattttggggtaattgtatattcaatttcagataattatatatatattcagttgtaagaaataatacagagacatcttgtgtattttttatctttcagtggcaacatcttgcaaaactatagtgtaatatcacagccaggatactggcattgatgtagtcaagatacagcaaaatttgctctccacaaagatcccttgtattgttctttttaggcacaaccacttctctccctgctgcctttccctttcctttacttcttaatccctaattctataatttttgtcatttaaagaatgttatatatgaattttacaatatgtagccttttcgcattagctttttcactcagtttatttcttggagattcttccaagtttttaagtgtatcagtagttcatttttttattcatagatggtattctgtggtatggatataccagctttttgcctcttcatccattgaaggacatctggattgttttctattttttggctactgagaataaagctacaataaacgtttttgtgcagattttttgtgactgcaagttttcatttctctgggataaatgcctatgtgttgcattgctgggttgcatggtaaatggatatttttttttttttttaagaaactaccaaactcttttccagagtgactgtaccattttatatttctaccagcaatatatgaacggtctagttcctctgcatcctttttagcatttggtgttaccaccatttttagtttaaccattctaatagatgtatagtgatacttcattgtggttttaatctgcatttccctgatgactaatgatgttgaaaatcttttcgtgcctttagctcattttctgattggattgttttttgactcttgagtctgaagttctttacgtattttagatactaatccttcatcaaacacattgcctgcaaatattctctcccagtctgtagcccatccacttgtactcccaaaatggtctttcacagagcaaaaggtcttaatcctgatgaagtacagtttatcaatatttgacactatgaattgtgtttttgttttcagtctaagaattctttgtctcggtgtagataccaaaatttttttcctgtgtaattttcttaaaagtttatagtttaatgttttacatgtaagtctatgatgtattttgagttaatttttgtatatggtatgacatttagatcacgggtcatttttttttttttttttgcctatgcatattcaattactcaggcaccggtggttcaaaaggctatccttcctccactgaattcctcctgcacctttgcaaaaatggagcatattggtgtgggtctatttctgggctcactagtctgtccattgttccatttatctgttcctctgccagtactacattgtgttgattactgtaactctaagtcttgaaatcaggtagaccgatgcctttcattgtattcttctcttcaaaattgttttaactactatagttcctctgccttcccatataaattttagtataatcttctctatatctataaaagtaagactttggatcttatttaaaatttctgtgtgagctggtttttatggacatggctctgacagggtaaatgtaaattgtgggtgccacctcattacaccaggtgggagtagaagtccagcttccctactaggccttcagtgacaactgaaatggaataaggctccttgttattgctgggcagagatgggtgttctagcccccagcagagtttctgttgataccactctggctgagaggggtaggagtgccttgctattgctttccactcatactgaagtggatgaggctactttgccactggatggcagtgacaattttggcttcccattctgtgtcctttgataccacaaatgggtgttgtcattaccacatggcagggatgaaagtccccattccctacccagcctttttaaataccaacctaggaaccttgttaaaggttggaagacaagactggaagtccagctctctattctgcttttactggttttgagtaggggtgaggtcacagatttttcaatcatgtttggctatagtggaatgattattgtctaaaagttttctgtcttctgaggctgcaccttttctatttggctagagagagcagacttttgttggggcttttttttgtctgtgcctgttggtatttctgggttgctggtttcttcagctccaattctgggatatatgaggcagaaaaaaacctcaggaaattcactattgtatcattcttggttcctgagttccccagcttgtctgctttttttctacctttcagaatgttcttgcttgctctttttaaaaaacatattatgtccagggtttttagttgtacttactggcagggatagggacatggaagtcccacaatcagtgttttaaagacatttttacatagttcaaattactatagttatgttggggccatttgttttcagtgaatagaactgtgtatgagaaactcttagagataaactaatgcaaaatgggctcatattttctatatattttcatcttaatgccatttacatagtgttatgaataatgcttttaatgtcagttgctaccatgaaccagcttgttatgagatgcttcattgatatcagagtagtgaaaatcaaacattcagaaattttactatacgatataattatatattatattaataaaatatgttatatttatttacatataagataaaatttaaaatatataaattaaaaatagaaagttcatcatgacttggaaaaaattatataatacggagcatagttaatacccatcaagatgccagtctaaataatttaagaaatatggagtctccatttgtttttttctgagctcttaagttaatgtgttgccatatttcttataaaggtagggaaattgatgaaaatgttttttatttcaaatgttttatgacattattttagaatatttaaaaaacatttgtgattgatggaatttagccaattttgtttttctacagttgtctttcctatatgaaagcttttttttgtttttttttttaagagacagggtcttgttctgttgcccagactggagtatagtgcactatcatagctcactgcagcctccagcttctaaactcaaaggatcctctccgctcctgagcctcccaagtagctgggaggcacctatgtgcctgacctgaaagctttttaaaagtgtccatttttattgctagccaattgatagacttttgtttatactagaaaatcaagaggggaatcacgatggattatcttaacggtaatagttgtacaattctttattacattataaacttaaataattttcttctaggtacagtgaaggtgaaattcgatttaatttaatggccattgtgtctgacagaaaaatgatatatgagcagaagatagcagagttacaaagacaacttgcagaggttcgtggccatgtttctaagtacaaagttctagcttggttattctctcaggaaaagtatttactttaaatatatatataatcaagtggtctgaatggtggctaagcgaatacacactggattcaggctgcctagattcggttcctggctttgcacttagtggatataggaatctgagtatatttccttgtgcctcagtttcttcatatagcataaaaataataaatagtatttaccttagaatattgtcatgaggagtaaatgaagtattatgtgtaaatcacttaatgactaacaaatggtaaatgctaaataagtgttaggaatgaactattttaactattttctgtgacttcattatataattaagcaagttaattctcaaagagttaactgggtatatttagagtcacatgtagtctttactagtctatgattacctttctatagtaaatgtcattggagaagagattaatagacaaagtttattttacaatcctttgagcacattttcttaagagtatatttaagaaaatttattttatagtgtattaggagaatatggcaatagagtatattacagcgtaggttgtttttagatgaaaattcgtattattagaacatagaaatatggaaggtactattttggggcttttatcctttaatgctgctgttaggcgggcatgctgctatcaatatgaagagtaaaaatttgaaaataatcatactgtgtttatcattttaaaatattctgaatgtaagcctcaattattagggtgtgctatttcttttccttcccccaaggaggaacccatggatacagatcaaggtaatagtatgttaagtgctattcagtcagaagttgccaaaaatcagatgcttattgaagaagaagtacagaaattaaaaagatacaaggtatgtttttaaaaatgtgttcctttaatgttttaatatagagcagtatatttcaagatgaaggtacattgaatatctgatggctttccctcctatcatttaccagatttcaaataatttgttgattctcttatcactacaaagataagtagtgagatgtctttcatttttatttttgtaaaatattattaggaatagaattttaacctatttggtgtttcagttcactgtagttattattccttttttttttttttttttggacagagtctcgctctgtcgccaaggctggagtgcagtggtgcaatcttggctcactgcaacctccaccttccaggttcaagcaattctcctgcctcagcctctcaagtagctgggattacaggtgtgcaccaccatgcctggctaggctaattttttgtgtttttagtagagacagggttttgccatgttggccatgctgatcttgaactcctgacctcaagtgatctgcccgtctcagcctcccaaagtgcttggatgtggaatgtatatgtcatttgtcatgtgttatggtagtaaaggattatttttcatttgaacctcagtgtaaggcaagaactgtcctttttgttgctccccacagtgtcagtaaagtgttttgcatcatacttaacagacaacagatactttgcatcatacttaacagacaacaggtgattgttaagtgaaatgaatgggccttaaactagtaggatttcttcaggtgaaagtggtaggggcaggcaggcaggctctagagtattccaggcgggaaaaagggagggacaagttcatggagatagggaaggaaaaaataatagctttcccaattattttccatttcacatgatattaaaaaaagtaaattacccatctttatatatacttatgtgtttattatgtaattaactaacttttaatatctgcccaaaatacaacacaaagtttccataacttccataaggtgtcctgctttattgtttgggaatgctttgtttaaaaaaagataaaatgattgtcatactgctataaaacaaacatgttaagctttaatttaattaattaactgaaggaactctagttaaaggagaagtcagagaagctcaaatttatatgaagtttaaatgaatttataagagatggaaactttctatggaagggcaatcaattatacttctaccaggcagaatatataataggtcagtggcagtaaaagcctagaatcacataacttgagaggatgttatctagacagtgcatagttttccactgaagtagaaattttttcctgcagtgtaccccctttcgataaaaaataatctgaaggaaagattgtgcttgatcacaaaataaagctggtctcattagactttgcctgattatttgcacaggtgaagtagcaaatgttaatttagcttgtagatgtttagttgtttttataaatgacattttcataagtaatgttagattggacttttaaaggcctctattatttgctaagtcaggggcaggaggcccttgcccaagaaactccctccacatgttttattgtgttaatttttattctcagtgggaatggaatctcattatttctaaaatcattttcttatgagaatggatataccatttctattttgagttggatgcaaagaataaaatatcaaaattagcagaaatgtagttagtgtggattgatgttttattttcagattgagaatatcagaaggaagcataattatctgcctttcattatggaattgttaaagactttagcagaacaccagcagttaataccactagtagaaaaggtaagtattttattggtagatacttaaattaagtttagagtctccaaaaacataaaatgtattttttattttttgcttgaatagaggtaaaatttttggaagcttgtacgtttttattcttttgcttttgcctcttgttttctactctgtaagaattagttcaattgagactgtaaaacaaaaataaagaattaccccactgctttaggcttccagattcttagtgtcaagacctcaggttatgctgtattaaaataaaatttaaaacacttcctttaagcaaaagtagatttttaatgctgataattgaaataatattttcctatttagcaaaaatttgagttgatataacagaatttaaaagtagaatggacattgttgggtttaaaaaaaaaatagcctgtactacgaaataggttttcttatttctaatttagtatccattccactgagggaaaactagcataagttagtgaagaattctgatttctatgatttttttcataagtaacaataaaatatttgttgaataagtaaaatgcagttaaattgtttttaagttcatactgtaaatcagtgtttctgaaagtgaacatcagtggatactctttaaaatacatgttacctggcccctccccagatattctgatataggggaaggattctttaataagttccccaagtgattctaatgcaactggtctgtgtaccacagtttgagaaacactttgagaagacactactaggcaaataaaattttggaccattaacttaaagacgagaatacatggtaggtatattttccttattaattttaaagtttacaaagcaaagattgatttcaaccaagctgtttcatgttatacattctaaataatatgagatgtgagctaataagttttttgtgtatattaccttattgattgaaacatgtgacccaacttttagcattaaatgtaaaaattattgcagaagactgctaaatcttctcttttccattataggtttttctgttcatgcatctcagggtgtattctaagatgggaaactgtttttaaagttttagattaatacagggtcctgtggttctcaaaattgcttggttaacaagaatacctagatatgatgttattaatcatatcaaatgtttttctgttaaaaatattaaaataactataaaatgtgctaaatatgtgatacatcagattttaagttagataaatgttactagggactaggacccttagataaatattaaatgtataaattttgcattaaaattgatctgtgaacagaattttttgtgtgtgcaaattagtaagtaaaagaaccactgttgtttgatttttaattacactatatccccagatttttttgagagcatagttagagaacaacagcttgtcagcttaacattagaataattattccttagttcacattttttggacacaaggtggcagcatataaatacctgatgttagtggaacaccaactctgttgtgtttgccttcattttcttaaggaaagtagttattgaccttctagttgcttatttctctaagctgttcttttattaatattccagaagcaatattgagatagatttatttcttatatacatgcaataactattattctcctaggttctgaaggagcttagactcatttaattggaattgttgaaatgttttaaattattcatcaaacatttatctagctgcgaggatattccaggcactctgttaaggtctagggatgtatacataactgagacatattattttctcttaagcaactcatggtacaatttgggaaaggaataaatgaacaattatggtattgtgctaaatagtattattttgataaatgccaggataaagtcaggctaaagatccccagcaagcacagggtagctcctaaatagctttatagccacttaaaatttcacatccataaagttttaaatatgtggtgggaattaagtgcttaatctgtagcactatatccgtttcctttgcaagaatatatttttgttcatcttattttggaaaaaaaagataccatattaaaatatcattttctgcagataaatgcaaatttaaaaaataaagcgtgttgaaaaactgttagaataaagattagattttataattatataaaatctttaccagtgatagttaattacttaatggtaatacttctaagaaaaattacctatagaattcagaaatagataagttggaatagtggatcttactgtgttttgttttcagggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctcggcatggctataatgaacttggttagaacctataaatgtttttgttatgtgagactttttaaccgatgaattcgttgaatacacaccacatttaaaaactgcctaggaggtaatccaaaaatatatagttataaaacttcttgtattatgtaccaaatctctttcttaaaatataaaataaaattatctagtttaagattacatttgtgagacttctatttattcaggtatatttatgattaacaaatttttgtctacacatttgtatgtaattatgaatcattgtctatcttaaatttttaactaccaataacttaacgtgatgtaaaatcataaattccattgctatggggaaatccaaacaacttcacaatattgaattttgtccacattttactatgactttgtgattcaattggtaataagtaagcttcagatctttttctatttcttaatagaaataaggtagaagaatagttaaggctaatcacaacaatatctacattagtatctattaatgcagaattatctgatttgagtcagtactttttaatatcattggtacactgtatagaaggaaagtatttttaacagtatatatttttccatgttatttatatgattttatttttattttttaacaaaaacagaccaaaatacaggctttgaatttaaatcttatatatatgttacttattagctggagcttttaggcactatttactttcttataacctctttctcatctgtaaactgggaatcatacctacttcacattcttgatgattaaatgagatcatatctgtaaagtgtataaattagtgctcaattaattgtgataattatttttaattttaataaatgtatagacactctgccttatatgtgtttgctcatttaattatgttgtaaagtttatatcagaaaccagtaaatttatttcttgttaatccttctcaatattctattaagtatactcagatcaataaggaaagaagcacatacttttattttaaattatgcctaaaaccaaattatatttattatttgaggacagaaaactttgtatgagatgcgatacacatatcaaattacaaattatgcttgttaactaaaaacgttgatgttggcaattaactttattatttttaatatgacacacagactatttgctcttattcattctaaggcacagcactgttttatcatactgttaaataataattatactacctaatacattacaaaaagagattgtaattgttttaattgctgtattttttatttaaggacgttttaaaaaaagttgtataatgtagaagtctaattcattgactcttctgaagtggcacagtggaaaaatattgcattgtagtactctaaaatcttgcttttagaaatgtcttctgaacaccagcagaactggcatcatctgagagtttgttagaaatacagaacctcaggcattttactaaatcagtctgcattttaacagggtctctaagtcattggtatatacattgagaagcaatgctataaagcatatgtctttgatctgtattgaggacttactgtatactagctgtgggactttggtcaagcttgataacatctataagctctggctttttcatttgctaaagaataaaacaagtactgtgttcaagctatataattgtaatgaagatctattgaactagtatgtaaaaacatttttttttaggtcatataaataaagtttgttgacaccaaggatacataatcctttagtgacattatgttaaagtcacttaaactgttatgttaaactcatttattcacatttgcagaaactaatgtaagatttttcttatgctcatgtgaataggaaatgggcaaatatgtgtatatatattgttttggaatactcatgaatgagtttgactttatggaatttttaaattattacaattataataattcatttcaccttcagataggaaagaactgcaaaccaaacatgatcctttcttagggcaaagaataactatgtaattgtccaggaaaagtttgttataagtctcaagttataaaacataatgctttagaagtcttataaacaatgtatttcaagcctttcagcttgagaataccctcttaggcacattttattctaatatagtctaaaactgacttttaaaattttgtaacatactatttttaatttttaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaatttt

SEQ ID NO: 38587 - DNA, 2437 bp, Homo sapiens
gcagtgtcactaggccggctgggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggtgagtccgagtcgcagacccaggcggccgggcgcgctggcgcgaatcgctaggccgatttcttaaaccccaaactgttctttgcgagcctgacgcccaaaaccaggggtgtgtagcggccacgtcctttcttaaggctctgggttcccttcccgcttcccgccctccgaccctccaaagcagctttccgccttgctctccggctcccggattccccaggtggccgggggcgcgggtccaacggctctgggaaggcgacttcccggcacctccgggcggcgcgagagcacccttggccctgaactgggccggttgtgtccatccctcgaccccttccctagttaggtgtccttttctgtttttcgaacgaccgggtgatgggtgagcggaaagccgcttccaggagaccaaaagaaaggggtgcctttagaggacgggtgttccccaagggctcggactcaggagtcccagatctccctctttaacttcaccccggttgcgcaattcaaagtctgaggggggaggtgcgtccaggtggggccaggtggggcctggagcgggagcgcagccgataagccctgcgcccctctcccccttccttccactgtgcaggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccatagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatcctg

SEQ ID NO: 38588 - DNA, 23780 bp, Homo sapiens
gcgcgcccggcaggaaagggcggtcctgcgctgtggcccacgctcgctcccgctgtcggactctgggcctggaccgcgcgtggccggcgccaaaagcgagaggcatgagcgcgcgcccgggccagtgaactgctcggggatggactgcggctcggtcggcggccagaggacccagcgcctgcccggccgccagcggcttctcttcttgcccgtgggcctcagcggaagaccgggcggcagcgaaacctcagcacgccgctgcctctctgcgctctccgacggtctgggggcgctgcgccctcgcgccccggcggcccgcggcggcgtgtcacgtgcctcaccgctgctcctcctcctgctagtgccctccccgcgcttggccgccgcagccccgcgccggcagctcggggactgggagcgctcgcgcctcgggtatgccgcacccccggccgggcgcagcagcgcgtggaggtgctcaccgggcgtcgccgctgccgccggcgcccttccccagtaccacggcccggcgcctgcactcgtttcctgcaggagaggtgaggcccgggcgggagaggagagggggctcgtctcgcggggttggacggcggggcggggatctcagctacagcctccccgaggaaaggcccggcaggccggagggcgggtcctccaaggccaccggcatctgcccggagcgtgggtcgaaggtccgggcccgccctgctcggccgcggtggcggggcttagcccagaagagacgaattcctgggaatcccgggcgctaaagttggagggaggtgcgtgctggggcggggagttggtgcccgcccactcctagggtctgcttttgggcgccgccttccaggagttctgtttggcagcgcccagcctgttgggcgttcaaggggaaggggtgtgtatgtttgagcagcaaagctctgggaaatgaagggattgctttacagtttgatttcaaattctgatggaatcattaattcgtggagtcctagcgtctgccctgtccctggcgcttttctagatgtgtgagatatatcagtccacaaaatcttccctctggagcttaattctagcagagcagacgcagtaaatatgtgtgtgtggatatacgtatgcataattgatgtatatataatttatatatacaaataatttttatatattcgtaattcgatgcctggtatagaaaaataggataaggcttgggaagtggaatgggtctccagttgtgaatttaaatagggtgatcagaatcgatttcattgagaaggtagcatttaattagagtcatgcatctcttcaggacagtcgcctactgagaaatgagtcattaggcgacttcttccttgtgtgaatattgtagagtgtgcttacacaaacctggatgctacagcctactacacacctagactatcaggtagaggctagtgctcctaggctacaaacctgaacagcatgttaccgtactgaatactagaggcaatctgaacacaatggtatttgcgcatctaaatgtagaaaaggtagagtaaaaatatgtattatagtctcatagaccactgtcgtgtgtgcccctctgtcctgggctgaaaggtagttgtggggctcatgactatttaaaggaggtgagagagatcactgccctggagatgaggaaagtaaatagaatcaatttattagatagcatattgttgattaaagaaaaaaatcatttctgataatcaacagacttggcaaaattatcactttgggcagtctatacatattcattagtagccatcactaactacacatttttcatattttcttcaacagataggcccactaaatgttgaccatatctataatttaagaatatcattggctggggtaaaaactgattagtagagcaataaagtgaaggaaactttatatacagagagtggggaatgagtagtgaactcggtgtcactgtccttcagtaattaggagtcggagatgagtttggtctttattctgtattttgccttttgttgcgctttttctgacaagctagtaatttccaatttgtttttctctcaatgcaagagtatagggcaaaaagagagtgttctttctcacggatttgctgaccaatcggtaaggtggtactgttgttttagtgtcagctatctcattcttcagtcatcataaaaaatgagtatggatgcataaaaacagaagagagcagagacacagttaaggaagcatgtatgcccattaaccagccaatgagcgtttcccaaccatttgtttgcttggtgcctgaggttctcggttgagctacttaaggatgtcatgagtaggaagtttgtatttggtttcctcatcctgtccaaggctacctttgggcctctattgtaattgtgggtttttaatattctcttgatatgctgaaggtccccagaaaggggaattgcatgttacacgttgacacagctcagttggctcgcttccttatgatcagtgaggagtctgggagttggcggtgtcctcaggtactgccctttgacagaaggccaagagggcatttccttccctcatcaggggttggagtgaccaatggaaagtggccagcccttctgtcgacctttcagaggcaggatttcttggaaataagcttgctgtttctggttccaatctttttgaaaaagaacaacaataacaaaaaaactgtagtatccaaattggcgttacaaagtagtcatgtgattgttttgtttatgtgggggtgggggtgaggaggttatgttttaaatacatgaatgattattttcttactagaaacaaggaatttaggtctagagtaaccctgtcactcttcacaagtcattccagactcaggtgttttcgagctccctgacacatggggcagtccagtagagttctggggcaggtgaggtggtccttaggaggtcccctggagaagtgctttcattccttcactcccactgtttctcaggctaggtctcttctgtgttgggcagacatcctgggtctcttctcatggaggccagttttagtctcaggactggaaataaactaaaaaagaggtaccagatttaagtgagctcgtttatgtgaaaagggaagaactgaggagaaaggaattcatctcaaattttccctctagacagtttcataatccagattgtagaagtcattacagttcaattaccaaaaaaaaaaaattattcctagcctgctgtatgccaggccccttgccagatgctaaagataaaaaatgagcaagactggctgctcctgggcagcttggacaaatagatgatacagatgaggaaataatgtagtaagtgctacgatgagctatctgtactgagctgagaacacaggtatgggctcaataaaggttgctcccttagctgggtggaggaagcagagagaaccataaagtgtaaaaaagaaaatgccacacctggaacataatgtatactcagtaaattggcaatttaatgaagaagggtaaaaagaatgcttaaagtttaacgattgggaaaggggagcaagccatgcttaagcatgcaattgcaggaaatagaatagcttaggttgctagaaagaaagctgaaaggataagcgtggtcataaatagcaagggctttgtatgccaggtcaaggacctcctgtcatagcacagtggttctttgaatctcagggcccagttttaccaacaaacacaaacacacataagtcattgcactttatattgtgtcagtctgcaaatggttcttgatacagatatggattattgcatctcttgcactcatctggatgcttacagtgaccacagctaccctccccttcccaagctgtgagtaggctgggaacaactcccataggctgcagcaaagcgtcacatttgtagggttcagtccatttttttgttttgtttactctcgatttcattatagggtaatcggggtgaaggactgagagtggaagctgatcagctggagcatctttctggtcattcagaggcctgctggggaaacctttgacctttgagttggcaggtgacccttcttgctcctaccagacttctacaacaccagacctcagactggtgccagttaacggcaaaattagaaaagtaatgacaaatatgtagcaagattttcatatactaagttgattaaatggaagttcttttgattgttcatctttttttttcttttggtgtcataatgtcttttttagtacaatatttaatagtagtagtaagcagctatatttaaaagttctttcatgacacaattaaaaattggcaactcaaatattgtttatttatttttaattaatttttttttttgagatgaagtctcgctgtgtcacctaggctgtagtgcagtggtgcgatcttggctcactgcaacctccgcctcccaggttcaagcaattctcttgcctcagcctcccgagtagctgggattacaggtgcctgccaccacgcatggctaatttttgtatttttagtagatacggggtttcaccatcttggccaggctgatcgtgaatgcctgacctcatgatccatctgcctcggcctcccaaagtgctgggattacaggcgtgagccaccacgcccggcctttaaatattttttttttcgatacaggatcttgctttgtcacccaggctggagtgcagtggtgcaatcatagctcactgcagcctcaaactcctgggctcaagccatcctcctgcctcagcctcccaagtagctgggagtagctgggaatacaggcacacaccaccacactcggctaatttttttttttttttttgagaggaggtcttgcagtgttgcccaggttggtctcgaatacctggcctcaagtgatcttcccaccttggcctctcaaagtattggaattacaaccatgaactagttcacctgacccaattaaaaaaaaaaagattttagcagttcataaaatccaaaagccaactgtaccatatactataccacctccctcagatgagtaccttgaaacaagaagtttacagaatggattggatctgtggctaaatgcacaaaaacttatagaaaaggtaatgtaaaaattgttagaacatagctctctaaagataggcttttgcaaagacattacaagaaaagaatgctattgaccgatatctcttatgattaaagatgagaaaatccttaacaaaatactagcaagccaaatccagcaacttataaaaagtacaatgtacttaaagtataatgtactttaaagtataatgttcctaaataaatggaaagacatccatgttcattgatctgaatacttaatattaaggtggcagtacttttcaaactgatctacaaatgtaacacatccctatcaaaatcccaagtggttttcttgtagaaattgacacacagatcctaaaattcatagggaaatacaagaaaacaagaatagctaaacaatcttggcaaacaacagagtttataacccacaccttgggaggctgaggtcgagtctgtagtgagctatgcttgcaccactgcattccatcctgggcaatagagcgagaccctgtcttaaaaaaacgtcaagagcaacaacaaaaaaaacactttctgatgtcaaacttaaaacaaacttaaaagtaatcaagaaagtgtggcactggcgtaaggacaaacacatagatcaatgcattagaatggagagcccagacacaaggcctcatgcttacagcccactgattttcaacaagagtgacaagacatttcagtggagggaatggtgctgggacaactagatatctacatggagaagaatgaagctgaacccactaccacacaccatttaaaacactaatccaaaatgaggaaaagacctcaatgtaagagctaaaactataaaactcttagaagacatgggtgtaaattttcatgtacttggattacctagtggtttcttaggtatgttatcaaaagcacaagcaacaaaagaaaaaagcacaggcaacaaaagaaaaaacagatcaattggacttcatcaaaagtaaacttctgtgcttcaaaagacagtatcgaaaagtgaaaagacaaccgacagaatgggagaaaatattttcaaatcataatcagataaggagcttgtatctagaatatatgaagaactcttacagctcagtaatagaaagacaaccctattaaaaatgggcaaaggactttgccttagtctgttttgtgctgctataaggagataccacagactggtactttataaagaaaagagacacatttcttgcaattctggaggctaggaagttcaagattgaggggaccacatctggtcaggcccttcgtgctgcttcataacatggcagaaggcagaacagcacacgtgtcggggaaggggtggcaaactcattcttttatcagaaacctacccccaggatagcagcattaatccattcatgaacagagccctcctgatagcctagtcatcatcccttaaaggacccacctctcaacactgttgctttggggattaagttttcaacacataaactttgggaaacacgttcaaaccatagctgacttgaatacacatttctccaaagaagatatccaaatggccaacaagcccataaaaaatgctcagcatcattagtcatcagggaaatgctgattaaaaccacagtgagataccactttacgcccaataggatgactataattttttaaaaacccagataatagcaagggttggtgaggatgtggagaaattgagaccctcgtgcgctgctagaaggagtgtaaaatggtatagctgctttggaaaacagtctggcagttgctaaaacaaacatggagttatcatatgatccagcaattctactcctaagtatattctgaagatcattgaaaacaacgtccatgtaattcgtaatcgctaagaagtagaaacagctcaagcatccttcaactagtaaatggatacacaaaatttactgtagctatacaatggaggagtattcagcaatacaaagaaataaaagtactgacgtgctacaacacggatgacccttgaaaacatgctaagtgaaagaagccagtcacaaaagactatatatattatatgattccatttctatgaaatcttcagagtaggtaaacaaaagagacagcaaatagaccagtgcttgtcctgggtatggttgggggcagttgagaagggctgggggaattggaaggtgacagctaaggggtacaatttgtcttgacagtgatgaaagtattctaaatttgattgtgggatggtagcacaactctatgccaaaacctattgaactgtatgcttgaaattgggtgaattgtatatctcaacgaagctgttataaagtaccacgaaggctttggggtatgccttattttctctgggtgctgagttgcttttgttttgcatgaagtctgttttgagcttactgtcctttccaccctagagctaagcttgtctgctggatccctgcagctggagcgcaaaaggagagatttcacctcttctgggagcaggaaactctacttcgacactcatgccttagtgtgcttactggaagacaatggtaatcctctgtcattcgtcatttagtgccttagaaaaacactttaaattatgacttctcttatggtttcatttaatttctcatgttcctctttgacttctattttttatttgtgtttaattaattaatttatttagagacaggctctggctctgtcacccaggctggattgcagtggcgcagtcttggttcactgtaacctgcctcccaggctcaagccatcctcccacctcagcctcccgagtagctgggactacaggcacacaccaccatgtctggctgatttttgtatctctttgacttttaggcctatgggcaatcttttaattaatctccatttttttaagtcctcattttttgctggaggacatttttgcttcatcaatagaatggagacttttctcacacattgtctctttgtccaagtgaagtgtatttctgtaacatcaccatggaagtacagtgttataggtaaaaatttagacacaagtcagcaaagctgaggaatgattcctatgacaacagtgtctgaagcacagaagtgatagttttattactgtgcatcttgtgtgctttttaaaatcctgtgaaattgaaatgttgctgagtagcagttcttgataatttcaacttactgttcttttttcttttttctttttctttctttttttttgagatggagtctcgccctgtcacccaggctggagtgcaatggcgcgatctcggctcactgcaacctccacctcgggttcaagcgattctcctgcctcagcctcctgagtagctgagattataggcacgagcctccacgcccagctaatttttgtgtttttcatagagatggggtttcaccatgttggccaggctggtctcgaactcctgaccttgtgatctgcccgcctcagcctcctaaagtgctgggattacaggagtgagccaccgcgcccagccctcttttttctttttaatactcaggctaacattcttcgttattgctgttaagataaaagattgttctggtatatatggcattcattgaaaatgcactttagacttagaatgtagggaacattctcatactaaatcatatttagacaaatacaccgattataattctctatatggtgacacattctcaaaaatcagaatttcaaaatagtgtaaattatgcttgtgaaataaatttgcctgtgcttttacttcattgtgtagttatttgtccagttgtacatgtttgtgtcagaaaagctactctctgtagaggtactttacatgcctaagacaaagtgacggaatgaattattctgtgctttgtgggagacagcagctctgggctcgagcctaaccctgcagacttctagttgcctagcttaggaagcttttttccccttctcagtttccatttatttgcccatctatagtatgagtgtaatacgaattccaaagacctttttgaatattaaacaagataatacgcatgaatgaactttggaaaaactgtcatatgctgtgtaataattttcacaacttttcctgtcaaacagtaggcttttttcgccaaaacttctttcagtacagaatttaaaagagaaaagtagaagcgagaagggagcatgtaaagttatgctgataaggccaggcgaggtggctcatgcctgtaatcccagcacttcaggaggctgaggtgggaggatggcttgaacccaggagttcaagaccagtctgtgcaacatagtgagagcctgactctaccaaaaaaaaaaaaaaattgataagcagaagtcttcctagttttcttgattttaaaccttaacccatggttatttgcatctttcaagactgtggtgtgagggccacactgcagtacgtggtatggaggggctgttcaatccaacatggatgagttgggggtgtctgagatgactggctgagtaggaggccaggaaggacttttcaaggcatattctaccctttctttatccagacctgtgtcttcaggttaacaaaatttctcatatgcctgtcatctcaccctggttctgtcctattccctcgtgtctacaaaaaattaatttctgcctcataactcagtaggttttcagacttccacttttttttttttttttttttttttggagacagagtctggctctgtcttccaggctggagtacagtggcacaatctcggctcactgcaagctccacctcccgggttcatgccattctcctgcctcaggcttccgagtacctaagactacaagtagctgggactacaggcgcctgccacaacgcctggctaattttttgtatttttagtagagacggggtttcactgtgttagccaggatggtctcgatctcctgacctcgtgatccgcccgcctcggcctcccaaagtgctgggattacaggcgtgagccaccgcgcccggccaagacttctactttttcatatccctttctcctcccacaagtggttataaagtatatggctttagagtttgttttacaatcaacataagttctctttctacctttatttttcttttcctcatcattgccaaacctaatttttttcttttttttttttttttttttttttttgagacagaatctcactctttcatccaggctggagtgcagtggcacagtcttggcctactgcaacccccacctcccggtttcaagcgatcctcccacctcatcctcctgagtagctgggattacaggcatgcaccaccacacctggataatttttctgtatttttactagagacggggtttcaccatgttggccaggctggtctcaaactgctgacctcaagtgatccacccaccttggcctcctaaagtgctgggattacaggcgtgaaccactgtgtccagttgccaaacctaattatgtttaaacatgaactctttttttaattaaaattttttaaaattttatttacattaaaatggagatgggatcactatgttgcccatgctggttctgaactcctgggctcaaagatcctcccgccttggtctcccagagtgttaggattacaggcgtgagccaccacacccagccagtgaactcttcttaataaaactttaaaatttggcaaaagtttagtttgagtttttaaaaactaggaagacagacgagaaaaaagaaaacagagtcagagctaaacaatgttaacattttggtgagtaaccttttgtattttttttctagacatgtgtataacatgttgaaaaattaaagaattttgacgaaagtgatgggaataggtctttggaggtttttttccttctcctttaaatctgtgtctttggtttttttgttcattatagtcccatgcttcatctcagccacacaaattccattaattaagtactactttattccaagaaatacacaattaattacaggaatcaatagattcttctgaaattcttatagctggaagcatttaatagaactatttcccaggcactcagttttaagcatttaattagaatttatgttaaataggagttactatccaatgtttttaaaaacaataccaagtactggccaggcgtggtggcttgcgcctgtaatcccagcacgttgggaggccaaggcgggcagatcacctgaggtcgggagttcgagaacagcctgaccaacacggagaaacttcatctctactgaaaatacaaaattagctgggcatggtggcgcatgcctgtaattccagctactccggagtctgaggcaggagaatggcttgaacccgggaggtggaggttgctgtgagctgagatcgcgccattgcactccagcctgggcaacaagagcgaaactctgtctcaaaaaaaaaaaaataccaagtactgcattgaatctctatcattcaattcagtatcatttattgactaccaaagaacatattttttctactttgggtcccccagactagttactgaagagaattgtggaggaaaaatgaaagaactgattttgtcttttaacatgaagttagccaacagctagattactatttatatagtcaatgatttgactgccttatgctggacataaaacaactgagctttcctatttaaggaaattattttttaataatgtacacattataaaattaaagaaatattgtccaccgtagaaaatctacataatgcagagaaacataaagaagaaaataaaaatgactatgaatttttgttaaattataaaaacaagaattgcatctgtaattttgagtcttgccttttttcacttgatgttgacttgccggcattgtctatgtcattaaatagtctctgaaaacatgacttttgatagctaggaacgacttacagatcagtcagcaaagccaccggtacctggggaagccaacttgtatgtttcgtgcttgctctgagtgaccggcacgtcatagtttgtggctgtaccctcctccctgcctcctaccacactgtgctgtactcttcctcctggatttggacattcacatgaatgtgtgcatttgctgtgggcttttgtaactctgagcatgattttttttgcttgtgtgcttgcttagggtttgctactcaacaagcagaaatcattgtgtctgcattggtcaagatcctggaggccaacatggacatcgtctacaaagatatggtcaccaagatgcagcaggttagccttgttgggtggtttagcaaattaggactgtgaagatggggtattatttgtagtaatgttttaatataattttttggataataccccgttgaaaagtatatagtaacttttaccatgattaagaggcaaaagattacagtggcataaaaaatacttactcagaactatttagtcaacagttgtagaatcgttatgcttgaaagctcactgttcaaaattattccagtgaaatatactttaataaatggagacgtggcctgaattgtagtattatagcatcatgttctcgagtcttcacatcaccacccttttagctgtgattcacttggtaacaataaccagatatgtggtttttgtttttttgtgttttgggggggtctttttgagacagggtatcactcatttgcccaggctggagtgcagtggtgcagtctcagctcactgcagcctcgttgacctcctgggttcaagtgatcctcccacatcagcctcccaagtagctgggactacagccgtgcactgctacagctggctaatttttgtacttttggtagagatggggtttcaccatgttgcttaagctggtctcgaactccttggctcaagtgatccacctgccttggcctccccaggtattgggattacaggtgtgagccaccttgcctggccagatatgtgttgtttttttcttttccttttccccttttggaataaaggatgaccctactgaacctctttttgtgtccacattgtcctggtttctcaataagaagatagcacattgagatgataggaagtggactttttagggtagactagattatgtgttttgtttttcttttcctaggaaatcacttttcagcaagtaatgtctcagattgcgaatgtgaaaaaggatatgattattttggagaagagtgaattttcagccctcagagcagaaaatgaggtaaaacagagcctctcacacttagaaagttgattatattaagacattgagataaattatatacacataaaagagcacacgttaagtgtacatctcagtgaattttcaaacagtgtgcacttccagtcagatcgagcaggaaaacttgcccactgtcccagaagtctctctcatgcctctcagttgctcctgccccagaggaaacgctgtcctggctgataacaccattaactagtttcgcctattctagaaccatttgatggtatcatactgtgtgtcttgtagcaagagatcatttttttcattgtctatagtcttaacatcaataggccccatcattttattgtaatgtgtattagaattgtttccagtttttggttattttgaataattgctactgcgaaatatctcttgtgtttctttaaacagagcatatgggatcagcatttaaataagtgctgtctatgcattttccttttattttcggtcctatttaaagtcccataatagggaaggccatttattgcctgttgaccctagccttgtaagaaaccttctagcaaaaagtaaagtggtaaagtttcagactctctaggttgttcttgaaatcagttatttgagggtaggattagttaaaagataaaccgaaggagatactaaataaagcagggtcactgaaggcaaatgtgtatgccaaacacaactgagttaactttacatagccttcaagatgaattcaaactgatttcaagatacgtgtgttgtaatgccattctgcaatcaatacggtgttctgaatgaaggaaaaacctgaggaacttgtgcataaatatgtattgtaatatttgttggttactacgttttatgttgttctttctaatgactttttttttatgtgtttttagaaaataaaactcgaactacatcagttaaaacaacaagtaatggtaagattcactttcctgtttgttggctggtttgtaattatataaacttattaataagtataatattagaaatggatgtttttaaaaacttaattctttgtgaaatgtttgtgtaatatgcctcaaaagtacacattggaagatttagctaagaacacagccaatgaatgaattactgttgtctgtaaccatattcattaagaaaattgtggccaggcatggtggctcatgcctgtaatcccagcactttgggaggccgaggtgggtggatcacctgaggtcaggagttcagaccagcttggccaacatagtgaaaccctgtctctactaaaaatacaaaaattaagtgggcatggtggcaggtgcctgtaatcccagctacttgggagactgaggcaggagaatcacttgaacccaggaagcagaggttgcagtgagccgagattgcgccattgcactccagccgtggtaacaagaacgaaactgtctcaaaaaaaaaaaaaaaaaaaaaaagaaaattgtgttctaggaggaattaagtcatttttaagtaaaagtttttctaaagtgctgcacggaaggaacccttaaattctcttagactgtctttagagaatcacacgtgatttttaaatgcttactgtgccagctatttaatgttttttaaatagaaaaaacatagatgttaaagaaaaaaaggctttgatatgtatcagagaaaaggctctatgtaaactggattttaatattttgctgctttgagtccatctttgctttccaaagttgtttaagatcagctttattcataagttccattcggagattgtatgaggagtcttgaggttaaaagcagcaacaggccgggcgcgatggctcacgccagtactcccagcactttgggaggctgaggtgggtagatcacaaggtcaggagttcaacaccagcctgaccaacatggtgaaaccccatctctactaaacatacaaaaattagccagacgtggtggcatgcacctataatcccagctactcaggaggctggtacaggagaattgcttgaacgcaggaggcagaagttgcgtgagcagagatcaccccattgcactccagcctggttgacagagtgagactccatctcaaaaaaaaaaaaaaaatggcagcaacaacccactctagactggcataagcatagaagggggttatttgtgtctaactgggaagtcctgggacaggctgcctccagatgtggcttggccagagttccctgatgccaggaggcctaggtccatttctctggaagcccctggctctctccctccctgggttgcctcgcctaggatagggacagtgggggcagtggtcccagtgtcacgtcctcatagagtttgggtttcttactttggatttttccttctttgttgtttgccctccttttaggatgaagtgatcaaagtccgaacagataccaaattagacttcaacctagaaaagagcagagtaaaagaattggtacgttcctttactaaaaacacattatgaattaatttatttttggaatggaatgcttggttaagcctaagtttatgtacatgtcataggtactgttaaatatttatctgtttatcagtgttaggctgtattttctctattataataattttggattaagacttaaatttgttgctttcaaaagtaacattaaaattaaactcctagtcaaattagtcagtttgaatatttgtttcagaaatattagagatatgttacatagagattcataaagaaattaaatgcaatcttgatctatttaatactgacttaaatcttcataggtcttgatcttgtaaaagttaagttgattatttcaggcttgaataatagtaaattattaacattaaataatattaaattatatactggaattcaagattaaaacatttctggccgggcgcggtagctcacgcctgtaatcccactactttgggaggccaagatgggcagatcacctaaggtcaggagttcgaggcagcgtgcctgcccaacatggtgaaaccctgtctgtactaaaaatacaaaaaataagccgggcatggtggcgggcacctgtaatcccagctactcgggaggctgaggcaggagaatcgcttgaacccaggaggcagaggttgcagtgagctgagattgtgccactgctctctagcctgggtgacaagagcaaaactccatctcaaaaaaaaaaagaaaatttctatgttgtcttttaagtgcagtgagaagttgtgagggtattttgttttgttttctatttttgttttttttgagacagagtctcagtgtgttgccgaggccggagtgcagtggcaccgtgtctgcccactgcaacctccgtctcctgggtttaagcaattctcctgcctcagcctcccgagtagctgggattacagacgccaccaccacacctggctagtttttatatttttagtagagacagggtttcaccatgttggccaggctggtctcaaactcctaacctcaagtgatctgcccaccttgtcctcctaaagtgctgggatcactggagtgagccactgcgcctggccggcaagtgtgttttttttttctttgtttttgtttgaggcggagtctcgctctgtcacccaggctggagtgcagtggtgtgatctcagctcactgcaagcttcgcctcccgggttcacgtcattctcctgcctcagcctccagagtagctgggactacaggcccctgccaccacgcccagctaattttttgtatttttagtagagacggggtttcaccgtgttagccaggatggtgtcgatctcctgacctcgtgatccgcccacctcggccttccaaagtgctgggattactggagtgagccaccgcgcccggcctaagtgtgttttaataaagatatgtgtcgggttgcctctagtgatttttaaccctgtctgaatattcagccgtcttcttgctcagactttatttgaatttggtaacatcaggtgccttttttattcttagcataatgagaaatagggcagagagagcatcttgcactaacacaaaactgaatacacatgcagaaactgagtactcacaactgtttgttgttttctcatttttgacaatttgcttttagataaaatgtgctataatgataagtgaagctaatactgaaactcaaaaaagtaacctacttgtgttttggaactgccactggatttcaagagttaatccaagcttcgttatacaaaataattattaaggctgtgttacctgtctttctagtcttacaacaacagtctccacccataaagattaaatcacctagtgttactaaatagttactgactatagcatgtcactggtgtctggaagaggagaaactcttttggttacctttatctttatgggttgtatactcaggaagaactgaattcacttgatataggaaaatgactgtgtgtagctaaccaacctgggaaaaactacatcaaggacatcaggaaatacagggcatgaatgtagattaaagccagtgaatttttttaaaattttatatggagtcattttaataacataactaggctgatatatatgtacatttttcaatcatgtaacatttagattttactcattttaagtcattaacatcatccagcaaacaaaaattttccagaaatttttttcacaattacagttttagtctttaaaccaaaatgaaaaaatttctgccgggcatggtggctcacacctgtaatcccagcactttgggaggtcaaggtgggtggatcacctgaggtcaggagttcgaggccagcctggccaacgtggtgaaaccctgtctctaccaaaaatacaaaaattagcccagcgtgatggcccacctgtagtctcagctactcgggagactgaggcagaagaatcatttgaacccaggaggcagagattgcagtgagccgagatcacgccactgcactccagcctgggtgacagagtgagaccctgtctcaaaaaaaaaaaaaagaaaagaaaaaaaatgatgaaatttcattcttgcaaatactcatatttttaaattattggatatatagagtggattcattcagtgttcttataagaaaagtaaagcttataatattttgcagacttgataatgcagcactcaaaatacttaccctgattttattttacttgaatttactagttaaatatgctgataaatatgatttacatgtaattactttatctggaatgactatattgaccttaatctccagaaagcaaccaatgcacagagtttcaattaaatcctgtccatcatgatagtaactttttctacatgacacaaaagtgtctgtggtatatttgaacagtaactgtgactatgaattgttcttatagtctttttttagtgtttcattattttaatttcagtgggttttgggggaacaggtggtgtttggttacatgaagacgttatttagaggtgatttctgagatttttggtgcccccatcaccctagcagcgtacactgtacccaatgtgtagtcttgcccctcacccacctcctaccctttcccccaagtcctcaaagtccactgtatcatccttttgcctttgcatcatagcttagctcccatcaagccagtgaatttatgtcatttagtaacctagcggggaggttgttcttggtaatcataaacttggattactctgaagcacaaggcagtagtaaattatacagcgagtgtgtttgtaacatgcattggtgaagatgagttttctggctctcgttctttcggtaaagttataatgttaaatattaaattgcaaattaactatgatatttacagccagttccaaaagcagtatggcatataaacttctggggcatggggatatagagctacatagatgttatttttaaaaccatgacagcgtcaatatttaggctcttcttttgtgggtgagtcaatgttgagttaatgaagactgaggtttagtggtgcacaaaatcttgttccacgccgccctctagtggtgatctgatgcatcgggctctcctggtctgaaaccctgaggtttaaagagcattgttcttggttttacaacctactccttggcttagggttttggggttttttgtttttgtttttgtttctctttctcttttttttcttttttttttttctacttctaagctcccagtagtcccaggagaatattttatagctaggaagtttctatatacttcaaaggattaactttttctttctataacaaggttaatgtagttcttaaaagtcgtcattcaaattactgattgtcatatgctcaattaaatcttgttgcccactactaaggagataagtctgatttcaatcttactgtctacaaaactgcactaaatcttttcactgacattaatagccaaaaggcgagatactttaactctgggtagaattagttcctttagtaacgctggattatggctacgcccaagtgggtttttttattgttattaaaaccaacatgtgcaggaggctaaggcaggagaattgcttgaacctgggaggcagaggttgcagggaccccagatcaagccactgcactccagcctgggaatagagtgagactccatctcaaaacaaaaaaccaagccaaaaaaaaaaaaacccaacatgtgatgagttagtgtatttatgtatttacattgtattttataatcacaacacaatgtctttgtcatagaataataatccttggcagctatttgttccccaacttcataccttttctgtcttttgttgagactcaagtagtgacgtgttttgctactagttatgatgggatagctcctaaattgagttgagtctccattttcaaccctctcaaaaccaaaaaccatatgactcagcatccttcgaaattggtccccagggagtgctactacaatagtgggagggacctaaagacatcacaggaaatatgcagggagaagtgacagatgactaaggaaatccagatattagaggaatgagtaagtataaataagaaactttagccagcacggcaggtcatgcttgtaatcccagcaccttgggaggccgaggtgggcagattgctcgagctcagaagtttgagaccagcctgggcaacatggcaaagccccatctctatggaaaaaaaaaaaaaagaaacctcaagtaacacatataaagaagcaggtaggctacttaatcccagaggtgactttctggtgttacgtattctaggaggtactgagaccagaatatttaaggcaccagagaaggagaagagagaggagtagatcagaatctgacccatgttacgtgtttatttcagtattcattgaacgaaaagaagctgctggaattgagaacagaaatagtggcattggtaagaaacaagactgtgatttttctttgtctttgtactcatctttgcttcgttccatgcatggttgtttgtaatgataataggaagttacatgcaggtttactgtcatgggaattttttacattgtgctaaaatacacacaacataaaaattaggatcttaaccattttttaagtgtacagttcagtacatttaaagtacattcacattttggggcaaccatcgccactggctatcacagaactctttattttgcaaaattgaaactctgcaccctttatacattcccttttccagcctctggtgacctccattctactgtctatggatttgactattctacatacctcatataaatagaatcatagcatttgtctttttgtggctggcttatttcacttaacacagtgtcctgaaggttcatccatgttgttgaaatgacaggactttcttcctttttaaggctgattagtattccattatatgtatatgccacattttctttattcgtctgtcaagggcacttgtgttgcttccacccgttggcctttgtgaatagtgctgctgtgggcatgggtgcacagatgtctgttgggatccctgctttcagttcttttgggtatatatgcagaagtggagtgtcacaggattttttgcacttcacaaagtgtttggttatcgtaatggaagatagttatcctatgaaagatttaaactttcttaatgaaagtttccttttcttctttctttttttttttttttttttttgaggtggggtctcgctctgtcacccaggctggagtgcagtggctcaatctcagctcactgcaccctccttcacctcagcctgtagagtagctgggaccacaggctcacaccaccatgccctacttgagagtttgtttttcttaacggaagttttattaagaaagtttaaatctcagtaattgaagaatagtgaggaatggagaagtcttattctatttttaatttatagcatacatttctccttttccatactgtatggaacctgggacctctgaaacccccaagaggctttcatgagagaattccagaatcctgggatatttctctggaatacttttttacgcatccaggcatttatttctttttttctctgcctgaattggtagccatagggaaagatttagttgctgtaggagttttagtgaaggattcccatggtttttatgctttaatgcagttctacaaccccctatagcgtcggccaaacccactgcctttttgagggttgattatgtgtccagtttaactgtattgtatttggggaaggacacaaattggccgtgggtagccaagcctcatagtaatgaaacacttgatatttgaacatgaaagaagaaagttttttaaaaatatgactagaaatagctcaagacaagcactgccgctttcacattatctaagactccatttcttgaaaacatttttgagtttactgtctatctttgactaaggaggatttagaaggatgagacgtagccgttgcctttgagaacagactggcctcataataccacatcatttgtatagcaacctagagcttacaaatgctttttcacatagattatcgcatttgattctctaaacagtccaggtaaaggcagggccactggcttggttgtttcgttttgttctgttttcattttttcaaatagaagaaaactaaggcctagagaggttaagggtcctgaccaatgcagcgtagaattagggttttagaactgagactaaagcccaggcctccatagtcttacccaggtttccctgtgactgcaccccgttgggaaggagctataggatggtgagcagaggggacgtgctgtggtctaacgctgtgactctcttcattttaaaagcatgcccagcaagatcgggcccttacccagacagacaggaagatcgaaactgaggttgctggcctcaaaaccatgcttgagtcacacaagcttgataatattaaatatttagcaggtaagctattttgtatctatttaaatcaacctgaaaagaaaataaatttataaaataagtcgttgacagatactgcatttcattgattccaacactttctgaaatattttaacatctctgaaattggaaagcatcttacaatttccagtagatgaagtatcatagtttaattggcactttttctttcttagtagtaaataaagtaattgtgtacgttataattgatagaattggaaatttgataagatactataattgaactatagttattagggattttaatgagattcaagacaggaaatattttatggataaaatggaaggtgtttcagttgtaatctttctgcttcaattgcttaaactccttttaaggagttattttactttcgcgatttttgatccaaaagagagaatgaacattcatgtaccaccccccacccaaattaaccattatttcaagtcagatttaacgtcttggattaattaaatattttaaggttacagcattatttaacagtgaaatgttgttctttatattaaattgtgtcttcctgtctctatagtgcatatacatagaccttgtgaccacagaatttttgctattcgaaacttttattgaaaagttttcttagcctaggcaacacagcgagacctagtctctacaaaaagatttagccgggcatggtgtcatctgcctgtagcttcagcttcttgggaggctgaggcaggagggtcacttgagcccgggagtttgaggcacagtgagctgtaatcataccattgcatggtgcactcctcctgggtaccagatgagaccatgtctctaaaataagaaaataaaataaagggtgtgggatttgttttttcagtaggcaggcgtttcacggaatatgggacatcagtgagcaatctaagtttctaggttttcttttttaggttttcttaaaaaaagatgttccctcaagtaactcttaatagaactaatagtactctcaattgtttttttcttacagggtctatatttacgtgcctaacagtagctctgggattttatcgcctgtggatctaataaagtgtctatttaaagtg

SEQ ID NO: 38589 - DNA, 224675 bp, Homo sapiens
ctgcggtcactgctgaggttttcagaactttccaggcaaaggccagccaggtcctttgcctccaacccactccgcgcctacctcccgcctggggacacccctaggcccaggagatcctactctcccccgagcaccgacgttccaactcgtctgcgcccccgactgctgtccggctcctgtgccaaggggcgcgcgcatcttcccggggccagcaacgctcccaacttctcgactcgccctcctcctccccagagcgagagtggggcgggctgagcccggatccggggtgcactcgagcgttcccagcgctcggcattcaccccgcctcagagccgactttcgaagggggattgagcctcggaggtccaggcgtcttactccaaagctcaagtcggcccccgtcttttctttccacacccctgtgcccgtcgcatgctggccgggtgagcggccgggccgaggattcgggtgcccggggccgcgtcgccccgtcgggtactgagctgagcgcaccatggccggctgctgctgcctgtccgcggaggagaaggagtcgcagcgcatcagcgcggagatcgagcgacagcttcgtcgggacaagaaggacgcgcgccgtgagcttaagctgctgctgctgggtgagtggctgcgtctccgactccagtgagccgggcgtttttcttccgagccctcccggcctctccactggcacccgcgcggccctggagcccagcggggtgcagggcggcttcgtccttctccccctcggagctcacggatgccagcaacttggggccttaggtgcctgttctttccatctctggctgggcgacttgcaaaagcaacaccttcccctgccccaaaacaggatagggacctgtaacacttaacctcttgaccgctgtaccttatgtgttccggtgtgcccctctcctcaaaaccccgtccactcctccgcccgcagcacacccagcttggggtctgtggtgacccacatcttgggttcagcgctagctctgacccgtacgctttcagttctagatgaagcatcttgagaatttaccatgtgccagatcgtgctaagttcttaagggcatcaccacctggtgatgcgggcaggtgatatcgctattctagagaattaaaacatggaggcctggagaactgaccaacttgccctgattgagaaaaggcaaagccgatgctaggtcagctgtgggggtgaagcccatgccgttgctgctcctctgaccgtgagctcctatgcctgcctcccatgggggtccctcaggcctttgtgtttgcagcggacccaaacctcccttgcccagcttgactcagtgtgtccacgtcctaggattcagcttggctgccctggtgcctctggcaggtcttcatccagctcttttggtgtctctgcaaaggtctgggtaggacatccactttcaaacacagaaagaacacagtttaaggtttgcccaagttatgccatgaggcaaggatcccatctcagactttctagaacgctgtcaacacatttgctgtttgaggaatattttaccttttctacctttcagaccatgatatcagctgtcaatttttttctagatagccacaaagatttcaactttttttctttcaccccttttgaacaggaatcttctcttataccatctatttattcatctttattccttgtataggaatcaccctcccagaaagcttcaaggaaagaaaaagttgatctagttagtgtaatatagagaaggctctcagccagtatggccttcagacctgggcggaagaacccccttatccttatcccctgggtttaaagggcccagtctggccttctgggggttgggggggggtgtgcccctccccacagagctggaagtctgtaggtccaaaggggcttgctacccagagaccatgctgccccctccctcccaagacctggatggaatgaatacccagcccaaagggacccataccagcttctaaggcctgagccctagaaaagaaggcagacctgatccctggagagctcacaaaggggcagctgtttgctggggcgtaaaagtgcttggaaatgtgggctgggtaggagtggagggagtccccgtgggtgcccaagaggcccccctaggagagagggagcttgggtggggaagggaaggggctctgttcattggccaggtctgctatttctgtgtctgacccataactttgaaaagtctgaaaattctaaattgtccctggccttctaggctgttataaagctacctttgtcaagggaggaggaatacgtgagaatttgctagcttgattaacactagaaaataactatgggtgcggggctttgtacttttgccctgaaccccacaaaccagaggggtttagttgcgtatgtaacttttttctttataagggcaggctgaaccctatttcattttgcaatgctttgatttgtgtcaatgtatgaagtacagtgtccagaatataccaggagcttgacaaatgctggctctttgtatgaaaaattgtgtagtcagctgagctgtactgtattggtaataagcctgtttgatgtaaaattctcgcatttacccacaaactaggggagaaatgtttgtaggtaaattgtttgctctgaaagtcacattaatcagggtgacccgagggtcttctttatcttcccaggccattgctccaaccctcctcctaccaccttgaggcactgtctgacctctggaaactcccattttcatcttgcggagttgtgactagcatatccccttagtgaaaactttcctgtgaaaaatagtttctaaaccacacagagccgttcagaactccaaggatggacttcaaaacctctgatttatttcaatctgtaaagtcctggggcatagctccatttcttctcaaggaagagccaatgactcagaagtgacaggaattaggggaggatgtgcaccattttgtctgaagtcatgcaattcgagtgaaaaattcacccatctctctagtgggtagattagagcatccactgctcaggtgcctcagttaaaaacctcactttgcaaatgggagtttggaatccttttgtggagtatgggatgacccccaaagacaccatctctttcacaatgaagcatgcttttgcaaaaaaatgatgtgaggatgtttctgaagtgcagtatcctgtttctgcttaataaaagcacaggtcagtgtctactagggaaagataaaagctgttgtttggttaaggctaataattgcaagatgttggtgtgacactttctcatcagaaagagatggagaaaataaaggagatggttgaatttagtagaaagaaatttcttatcagttccttgcataaaagtaggacaaaaaagttctgataagaacattggtgagtactgatcagcatagggagaaagtgtcaggacaatagctattaaataagggaaaatgatgttttattgattttcctgttaaatgcagattggtgaagtgtggcttgttaattgggttgagtgttttaattctggatgcagaccttaccttggagctctctggaaggaagaggaattgagcatttaacagatatggctgaattagtttgctagggctgccataacaaaataccacagactgggaggcttcaacaaaggaaattaattttctcacagttatggagctggaagtccaagagcaaggtgttggcttggcaggtttggtttttccggaggcctctctccttggcttgcagacagctgccttctcactgtggcctcacatggcctttcttctgggcatgcacattcctgtgtctttttttttttttttttttttttttttgacactctttaggttggagttcagtaatacagtcacggcttcctacggccttgacctcctgggctcaagcatcctcccacctcagcctccctagtagttgggactataggcgtgagccaccatgctgggcttatttttatttttcttggtttttgttgcctaggctggtctcaaatgatcgctgggctcaaacgatccctctgcctcaacctcccaaagtgtcgggattacaggcatgagccactgtgtcgtgccacttcctcttcttataaggataccagttcctattttattagggccccactcattttatcctaatcacctctttaaagacattatcttcaaatacagttacattctgaggtactagtggttgggatttcaacataaaaactttggcgggaggactaaattcagccagaaacactggtgtagagatgaaaaatgtagattcttagcccagtctgcctgggtttgaaccctagccctacagtgtcttagctgtggactaaattctctgggctttggatggcagtgagtgctcagtatcagctatcatcactctgttttttgagtattttcaggccctagagaggtgtcattttccattttagttgaccaactgtgggttgcatagaagtttgtataaactgttgtggtagtgctttaacagaaatgttttactttgagtttcccttagtgttttctgagccataaactgatttaaaattcctcttcctgcttacaccaaaaagttgaaaatctggtcccaaaaagttttattggattggttataacaaaatcccatttcagaattagccatcatgttcctgggcaggaagtccattccagaaaatggtgcaaatagtgtgagttttaaggtagaaagtgacaacaccgattgggtgcggtggctcacccatgtaatcgcagcactttgggaggctgaggcgggcggatcacctgaggtcaggagttcaagaccagcctgacaaacatggagaaacactgtctctactaaaaatacaaaattagccgggtgtggtggcacatgcttgtaatcccagcttctcaggaggttgaggcaagataatcgcttgaacctgggaggtggaggttgcagtgagctgagatagcaccattgcactccagcctgggtgacaagagtgaaactctgtctcaaaaaaaaaaaaaaaatgacaacaccttcccactctgaagaagaaaaggaatgaaatggtaaatatgcccacgttcctttatctgagcttagttcaatgcaacagccttttccaaggtgccagccacagtgcagggattccttcccaagggctgagttggagaaggacagttcacaaatagctgttatgaggaagatggtcataaaagcttaacagagattaagaggtagaacaggcagagcgtaaagggggagcctctggaggaggcatcatctgagtgggccttgaactatggtgagggtaagatgcaaacaattgtctgcgcatgggggcttgggtgagacatgcacaaactctcctcaccatctagggaaatttctgaggacagtaaatggtgttcttaggatctgggatcatatgaaggatcccttggggaccagatttcattgagttttgtgtttgattttatttttgtttgtttgttttttgagacagagtcatgctctgttgctcaggctggagtgtaatggcacgatcatggctcactgcaacctctgcctcccaggttcaagtgattctcctgcctcagcctcacaagtagctggaattacaggcatccactaccacgcccagctaattttcatatattttttagtagagacagggtttcaccatgttggccaggctggtctcaaactcctgacctcaagtgatctgcctgcctcagcctcccaaagtgctgggattacatgcatgagccaccgtacctggcctgtgttttattttaaccagttatgtgagtattgtgttcactctaaaatagacattaaaataaaaatgcttgcttttttgccataatatgcttcagaaaggaggattgtgtggttttgtctgtggcttctgttcatcctggctggagcaaaccaatctcactagatagtttgcttccatctataacacagcagttcctgaggcctttcaagaggcaaatgcacgtacctcttcttctgtctacccttaaatgaatacagaaccttttgaaatactggacttttaccctctgtaccttttgcaaatcatctttattgaatacagtaagtcaccaggcttaagtgtacactttgagttttgacaaatgtatgatcacaatctataaacacttccatcatcctggaaagttccctgtgcctttgcagtcaatctcctgctccaaatctttttttttgtttgtttactttttatttggaaccgatttaaaatttacaaagaatttgcaagaataagaatagcacaaacaacataggtatgcccttttcccttggcagtgtttgagggtaagttaaatgtattgtggcctttttttccctaaactcttaagcgtgtttttctaaaaatagggataatctcttacataagcgcagtacacttatgaaaggtctgtacatttcactttgatgcaatatttgtgtccaatctattatccatatcccagttttgttggttcacccaataacgtccttagtggtgttcccccacctccagtacagggtccagaggaggctcagggattgcatttggttctcatatccttttagtttctttaatctggaacttttccacaaagtcattgcttctacgacactgaatttttgaaaaatacagtcccctctccctttttttttaacagacggtttctcatttgggatttaactggtgattttcttacgattagcgatccccactgtgcttttctggctggaacactggatacgtgctgttgtgtccttctcgggggtggcatctggaggcacaccatgtccatctgctcctctgtggtggtgataactctgatggcctggttaagatattgtctgttttatccactgtatcataattttgtggagagacactttataaggctagtaaataccctgcttcttatcaagatttaggagtcattgatggtttccagttgatccaatctataacatggtatctgcagaatgattttccaactccagcactctccacatttaccagttggcatttgacattctactgcaacagccttacctttgcccttccttccttccttccttccttccttccttccttccttccttccttccttccttccttccttccttccttccttcccccccctcccctcccctcccctcccctcccctcccctccttccttccttcccatgcaaattcgtgaatacctaggtttttttccctcaatgattttttacttcattactgttcttaatcattttggtgctcaaatcatacccgacttgtgcaatgagatccccttcaagctggctcctgtgtcactgtgacatgcctctgtctgttgtttttttttttttttttttttgagcattttattgttttctggcataacatgccccaggctcgtcttgtaccaattcttccccagctggggaagaaatcagctgtttctcagaggggctctgcttccttttattggagaactggatcttttaaaaaaaatctttaagccacttgaaacaaagatatcaagtccctaattcagatcaattactagtacagtatccaagtacctaaagaatcaaggtgctaagtcatgtcattagaggatgaaatttttgaggctttaataagtcttaagctgtgggcagatataaagtggaaaaatctgacagtggagtttggcaaaaagcaatgcaaataaagtcttaatcttcaaatggtctttttttctttttctttttaaaagatgccttctagtctgtcatcttttgctttctcatttcccatgatacttaaaccacaaagggaaaaataccactgtaacaactcccatgtgtagggctatatgaagggagttcatgatattgggaagtcagagagggattttcagtgaattattggagcaaagctatgatgatactaaagatggttgaaattcaaagaggagacaatcatttatcggaaggactgtcaccagggcatctcatggaattcaaagaggatttgaataataaatgagaaagagcaagtgccagggcagttgggttaggggactcaaggcacagccatcaacaggacttgaccccatccccttccaagcttgagagccctctctgcagacctttatagccaggttgtggcatcagggtgcactcctggatcaatcagttctggccaggggacatgtatcatggacatgactgtcacctgagtgcagatggccggggactgggatccctgtgagccaggtagccacagctacaactactgttagaggaagaaaatatactagcggaaatccaagggctctaaagttggaagggaccacaaaagcctctgcaagagccctcacattcattatgaagattggctctctgctgatgggtaaattagccatgctggccaagattcttgattgttgaccatgtaagcagagtaataatttattagagtggaagcaggaaatagaattaatggaaattggagaggaggctccgcaaaagggcaggatttaagggactctggacatagcaaatgctagtaccagacaagactgtcaaggacacagtcagtggactccaccaccctgccagtcgctgctgctgctgctgctagacacttatattcacagcagagctgcaaatcacctgtgaccatcttctgcaccctggtgtcacttttcaaaacctccatctgtctgattgtgctcatctaccaggttgttggggggaggcagtgtgacacagcggttagcatgttctttggagccagccttgctgggtttaaaatataggcttttccactgataagctgtgtgcatcctggaatgtacattagtttcttcatctgttaaaggggaataacaacccaatgaggcacgtactattatgaggattaaatgagttgtcatttttagagcgtttagaatagtgcctggcacatagtcagtgctatttattttaggtgcttgttaaataaaattctgccagccttagctttctaccatagggaaagggggtgggctgctgcctcctacctttcttgaaactcttcccccagaaggtaagtgctcagatgctgggcagcgccaaattacaaagatctacaacaaaaatgtgatattttccataaaataacttttcctaaatggattggtaaaggcaaactcaaaaactaaaatgtaagctttcagacagtggaatcatgaaaagaaaaggaggcagatgtctttaaatattaaggtgtatttaatattgctctagttaatttcttgaatttgttttttaaaatcatgcctttattctacagggctatgaaaatttcacacatgtatcctattatcccaggaaattgccacagcccatctgccagcattgtctctggtgttaaacatttgccaaatctcaccacttcttcccctatccaaagctgcaattcacctgcgttattgcagtgtcctcttgatttcccatctcccacatttgcccttctttggtccatttaaaaacttagatttatattattaccttacttaaattcagtgtcttttacttacacttggaataaatgccaaatgctttcctacctctcggaatgtacacagggtcattctcccactggtttgctgggctgaagccaaactcacctttgtgtttttcaaacacaacatttgttacctctgggtctttaagcttgctttttttcctgcctggaacattcttttctgttccccactcttgttccacatacatggctgtttcttccttatcttcacgtctcagctcaaaagttcatctcttgacaaggcctttccagatcacactacctgaaattatccttgcaccatttactcttagttgcctggttctataacttggctttatttcttcatagctgttatcttggaattgacctgatattcttatttgcttacttgttgacttgtctgcccccaaatagattgcaagctctgtgagagtggggctgtgctatcttgttcctgtatcctggcacctgaaccagttttgtgcctggtgcaatgttttaataatgactggatggtacagtgtgagcactgaaagccagaatgatacttgaccaatctgaaatgagataggctagttgactatcaaatatgaaatattcttccatgaatacatgttgatatacccatgttacagatagaacaagcaagtgctcatgattattcagagagagagtcgttaattacttcactataagactacatttgatatttaatatattgatcttccagtattttttcagaataaacttttgcatataaaaccagagagtagcaataaaagctaaagttttctagaatatgaacacaaaagaaaagtattacctatgtgatatgcctgctcctggtactctctgtattaacaacaaaaacaatttttcttttcatggtttactaaagccttggcctcctgggctcaagcaatccttccacctcagcctgccgagtagctgggactacaggcatgctaccacacccggctaggttttaaatatttctttggagatggggtcttgctattgcccaggctggttttgaactcctggcctcaagcgatcctcctacctcagccttcagagtcattggaatcacaggcatgagccactgcacccagctcaacaactttaacaatagaatagataacaagttaaaatatactttttaatttaagaaaattatagggttgctgataagatatagaaattccttccatatgtggtttgaattgtgcaaaatttaaattttctctgaagttgatgggtgagatgaggtcaacatcttctcaatggccactgcaggttttagggccagatctctgtttttttcccttttcagtgtgtgcttcttaggtttaaagagtctattataacgagagtcaaggtaaaggagacagtgatattcttggaattgtggaacaaaaaaggaaattaatagcaaagaacagtgaaaagtggtaagactttggaagctgaaagttcaagccagcagaaatctgattagttcatgacccagtacctcttaatggaaactatttttttcttcaagaagttagtactccaggagctgtaaacatcaccagtaaatgtatgttttaccttggcaagaatcgtttcaaaaagtagcaaatgttcatgtttgcatagatccttgtacttgcatgtactcttcaaaaaactgtgctcctaaaaactgcaatgatcttatggctaataaccattaggtagttatgcttctattaatggacttaggagtgctgaggaaccatattctagtaagagccatcatatatcagtcttctcgttgaaaattcactctccatggaacattggcttgtgctgcggtttgaatgtttgtctctttcaaatctcatgttgaaaatttgatccccagtgttggaggtgggacctgctgcgaggtgtttaggtcgtcgggtcagatccctcaagaatagattagtgccctcccttgggagtgagttctcactgtattcttgagagagctggttgttcagaagagcctggcacttccccacctctcttgcttcctctcttaccacattatctctacacacaccagctctccttcaccttcccccaagagtggaagcagcccaaggccctcatcagatgcagatgcctagttttgagctttctagccatgagattcatgagccaaataaacctcttttctttataaattacccagcctcaggtattcctttataacacagaatggattaagatggctgatatttccatccaaagagtaatactcctgttgtcaagtttgctttttaaaaattgactgacaaattctaatattttgtgcttttttaatgaatgagagaaaaaagtaaaatgtatgttttattgttttgcctgaaagccatcttctgtattgatgatcagttgtcagttattattagatggattatccatgccatttctctcttgaatctgccataaataagaccttcctttctgagtaacccatcccagaatatttgcttctgttgctcagctactgtgtaattgaaaaatatgttaattatattactaataaaaatcaaatgaaggtgattaatcttttgtagaattatcttctaatccatttagtggtaagccattagtagtcttcatcaacaccactcaaaatgcacctgtgtttagaaacctttatagcaatttaacattgctgtggcatcaaagagtatttttattgaagactgatacatttatgaaatacaactgatggaaaattttaaaaattggttccttcctacagtgtttgagaaacacaagtacaaactttgatcctatggatggggtggcaaaggtccagaggagtgaagggactcagcagatgtcacggggccaggtgattagtagctaattggcagaagggcccagagttagtctgagtcttcatgttgaatttcctagtttctaaggcaacattgattatgagatatgccattgatttgaaaacagcctttcagaaaagcaaatgccaccatagtaaatatacacatcaatgcaaaggcatttcaccctcaaaaatgttaatttatatggacataagccttggactcaaggatataggtaatttacttttctctcttttttccttaccagatagtacaaatttaaaacaaagcaaaactattcaaatactatgtcaaaactagttattgacatagtatttgattttatgaaatcaatttaagtgctaaaattagactagaaaagaaacctctgtgtattgccatcagcccactggtttctgtttcaagtggtcttatatgcgatcttgaaaatagttacttcttggaatagcatgctgtcatttatacagaaggcttaaaaacataatagtgaccatgcactcacttcagcagcacatatactaaaattggagtgatacacagaagattagcatggcccctatgcaaggatgacatgcagattcatgaagcattccatattttttgatttttgggactcagggaaaatggtgggggagggggtgaaggctagaagactacacgttgggtccagtgtacactgtttgggtgatgggtgcgccagaacctcagaaatcaccacttcagaacttacttgggtaaccaaacaccacctgttccccaaaaaaacctattgaaataaatgaaataataatagtgaccaaacgtgtgtgggaactccaatgtatgatattatatgctccaatgtctgaataactgtggattgactacatcctggcaatttgatgagtgttgaagagtttcacatgagaccttgaactccatgagatctctgctcactattgaacccacaatgctaagtgcagaacttagctcaaatactggttgaatgaagatatgtctctctctttatagtggtttacatgaaataccagctgagtagtataaagaattccttacagtagctgaaagtcttttttgtttgtgattgtctaagaaggttcataaaaggaacacaggcctgggctgggccttgaagaaaggaaaattggagaattccagaattgattttttttggataagtggtataaggatatgaaaattgagcctggattccaggaataagatgagatttggaaaataatacttctcgtattctgcctgcctgcctgcctttttgcctcctccctccctccctctgtccctcactcccttccttccttccttccttccttccctccttcctttcctttcctttcgcttccttccttcctttttttttttttttttctttttgagacagggtctcactctgttgcctaggctggagtgcagtggtgtgatcaacttctgtctcaaacttctgggttcaagggatcctctcacttcagcctcctgagtagctgggactgcaggtgcatcagtatgcccagcttatttatttatttattgtagatacaaggtgtccctgtgttgcccaggctggtcttgaactcctgctctcaagcaatcctcctgcctcagcctcccatagcacagaagattataggcatgaaccagcccattttcttgtattttcataaagacttttcctagtaactatacatggtaagattttgatatgtaaccaaaactacagttgagaaatttgtaaattgttcttttctgttgctttactttgaaacagttggctcaccagaatcgagtctttttttattctttttctgtcatacctaatgctaataatggaaaaggcaatattaaagcagtgacgtttatacattcagtcattattctgggtactttaatcagtgatttcatttatttctcaccatgtttgaggtagaggtagtatcctctccattctacagatgggaaaattgaggcctatcctatggcaagattgactggccagagtggggccagggtttgaatccaggtggtctgatgccagagccttggttcttaatcacagttctgcttttgcctcctagagccagacagctcaccaaaatctaccccatgggggcaaatatctgctgtgcccgcttcttgccatcctctctgccacccccatctctatctgaattgctaaatttatctatcattccctagccccaaattcactattcactctgccagccagagtgaccttttaaaaatgtaaattggattgttgtttttctgcttagaacatttctatgtcttgggtgcaaatttaaatctgtgcatggcctgtgagaccctttatctgtcccctaatgaccctctgccattattccccatgattacttagttctggccacagaaccatattttagaatcttcaacgggccagactcatccttcttaggcctctgcacatgccaatctgtctgcctacaacactcttttctgctggtcttctagtgaactgatactcattttgagaatgcatcttaaatatctcttcctcctggaagcctttgctgacaccccagtccaaattaagttcctcagaatatttctcccatagcaccttctacatttctttttaaaaatagtgcttttcctagtttgaaattgtacttatcatcctccttctccgctagcctctaaattttatgagtgtagagactattgtaacatgagaatcctcagcaacttgtatagtgcctgggtgtttcataacatttgctaaatggagaaatacattacttttacaggatctttggggtatttttctgtctggaaacctctgtggctggtggcacctttgcctgagttttgctaaggcccattgagcttgttttgctcacttggcctggcaagctgtgcttggctcacattaccagcctgagtcccacacctgccaagggagagtcaggcatggaatagtgaggggtgtgtgagcgagcatggggtccggccactgtgcagagtcagacatgccttttgctgtagcagggtgggcagctccaggtgccagcaaaggcaccggctctctgtgaggctgcggccagaccaggcacgccacaagcagcttccactgctggcactggggaacatggtggcatccagaagcttggagactccaggaaccttagggccccaaagggagtcacagccctggcttaggggacgcctaggtctggggtcctcaaagggccacagctcttctctcctctttgtccacaatgtggcaagcaaggggcatatttcagccctgtttgtgttacagctcttttagcccctacagggccacagaggggaggaagtgtgcaccgattggtccatgggtggccatgggtaggcctggaaaaggcaccacaagttcccactctggtccatgggactggcagcccagccaacagccttcaggccctcactagggacccacctcctgtccaggagcctgtctgcctccagctgctgttcatggcacccatggcacccaggatgcccatgtgccaagaggtgcctgtggcccagcaccaagcttccctcagtgccccccttggcttcccatggccccaactttgctctgagattggagtgggtgccaacagcagggagaagccaggcagcagaagcaggcacttccaagcctgcaagggcagtgggggccttcctgggctgccaagggtataggggtgcctgggtctgcagctgtggttttggcagctgcagcggtggccagcagggtagggctcctgcctgctcctgagccctgagagcacagggatgcctgggtctgcagctgcagtttgggcggctgctgcagcacccaggcagcttccaccccaactcagaaggggcgaggatcctgcttgtgcctgcctcttaccagctccatggaacatgcagccccagccacgctttcctgctgcagccggcatgatggcagcggctgctccagatggcccgccactgccatcattaccatttagtatcaacattattgcataaagaaagaatacttgaacttcaaatagtagaagggcctaatggaagataacactttaaattgaataaacttaaatgtatgatgaactcatgctcattatgtgtttttgttttattttactttttgctaatgaaaacttcactagatactgacattgtactgtgggccaatgttctagagccactgatttattgtatgcatcttatgtgcttcctaaactttcagattttctttatgcacatatgtgaatagatgctcttgatggttttttactttttttttttttttttttttacataaaaagtggcatatttgtggcagagactgctagcagtctcctgaatacagattctctgtaatacaagatgttttatctgggcacatggatacccagctaaatactatagttcttagcttagctgctgctaattgtggccatgtgatgatgggatgtaaactgaagtgatgtagcaatttctgagtgatgacctgaaaaggaaaggaggctttcttcccttctagaggaagatgtaacctgacggtaggagctgcagcagccatattttaccataagatggaagtaaggtgttaagggtgaaaaagcaacatgataggaagggtctatgactctgagaccatgaaggtgtcatattagccttgaactataaatgattagaccctttttaaatggcagctaacctgatatcctaactaataaaataatatacgctgttttgctcttagcctcttgatactcaacaatatatctgggaattctttccaaattttttgcaatcctaaggcagaaaaaaatagactctaatgttgggggaagggtataggatgatgctgtgggccagctggtgagcagtgctctgttgatgtctctcatcctcccatcttcatcagtactgtaaggggatacaactgttttctctgctgctgagttttcaaatatttgatagggtctttctgtgtgcaaagagacatttgtagctgcatgttttagttgatactgactttattagagcggaatataagctaaaaaaaactagtttttctaaggctttaatgctcattttaatttttataaatctagttttttgcatataaaaattaaagggatgtttcttaatcctttgattaggtttcaatttactgtttgcttcacttattaattcagttaattaaattattacattttctttaaacatttttaaacctatttacacattttaaaaacccaagtatcctcaaatatttcaaacctccgaaaaagctgtcaagcaaaatctaagcagttaagtgattctggtagatcgattaaataaatcttactctcttggccaggcatggtggctcatgtctgtagtcctagcacttgaggaggccaggacgggaggattgctggagaccaggagtctgagaccagtttgggaagcatggagaaaccgcatctctacaaaaagtgtaaaaattagctgggcatggtagcacacatttgtagtcccagctactcgggaggctgaagtgggaggataacttgagcccaggaagttgaagctgcaatgagcctcgacatattgctaatcaagccactgcactccaacctaggtgacagagtaaaactctgtcaaaaaaaaaaaaaacaaaaaacaaaccccacaaaaccatactctcttaattctaaacattctaatattgtttctaaatgtaatcaaatcaaataatcacatttattactgttaaatcataaactaatcacaactctgatagattatttaatatcagatttaaataccataaataaggacaagattttaaaaattcagtgctgactcatgtttacttattttaaagtttgtcttgagagtattcttttttttatactttaagttctgggatacatgtgcagaacgtgcaggtttgttacataggtatacacgtgccatggtggtttgctgcacccatcaacccgtcatctacattaggtatttcttctaatgctatcacttccttagctccctaccccctgacagaacccggtatgtgatgttcccctcactgtgtccatgtgttatcattattcagttcccacttatgagtgagaacatgcgatgtttggttttctgttcttgtgttagtttgctgagaatgatggtttccagcttcatccatgtccctgcaaaggacataaactgatcctttttatggctacatagtattccatggtgtatatgtaccacattttctttatccagtctatcattggtgggcatttgggttggttccaagtctttgctgttgtgaatagttgctgcaataaacatacatgtgcatgtgtctttatagtagaatgatttataatcctttgggtatatacccagtaatgggattgctgggtcaaatggtatttgtggttttagacccttgaggagtcgctacactgtcttccacaatggttgaactaatttacactcccaacaacagtgtaaaagcgttcctatttctccacatcctctctagcatctgttgtttcctgactttttaatgatcgccattctaactggcgtgagagggtatctcattgtggttttgatttgcatttctctaatgaccagtggtgatgagctttttttcacatgtttgttggccacataaataccttgagaggtgtctgttcatatcctgtggccactttttgatggggtttttttttcttgtaaattcgtttaaattccttgtagattctggatatgaaccctttgtcagatggatagattgcaaaaattttctcccattctgtaggttgcctgttcactctgatgatagtttcttttgttgtgcagaagctctttagtttaatttgatcccatttgtcaattttggcttttgttgccattgcttttggtgctttagtcatgaagtctttgcctatgtctgtgtcctacatggtattgcctaggttttcttctagggtttttatggttttaggtcttatgtttaagtctataatccatcttgagttaatttttgtgtaaggggtaaggaaggggtccagtttcagttttctgcatatggctagccagttttcccaacactatttattaaatatggaattctttccccattgcttgtttttgtcgggttggtcaaggatcagatggctctagatgtgtagtgttagtcctgaggcttctgttctgttccattgatctatatatctgttttggtaccagtaccatgctgttttggttactgtagccttgtagtatagtttgaagtcaggtagtatgctgcctccagctttgttctttttgcttaggattgtattggctatatgggctcttttttgcttccatgtgaaatttaaagtagttttttctaattctgtgaagaaagtcaatggtagcttgatggggatagcattgaatctataaattactttgagcagtatgaccattttcacattattggttctatccgtgagcatgaaatgtccttccatttgtttgtgtcctctcttatttccttgagcagtggtttgtagttctcttgaagaggtccttcacatcccttaaaagttggattcctaggtattttattctctttgtagcaattgtgaatgggagttcactcatgatttggttttctgtgtgtctattattggtatataggaatgcttgtgatttttgcacattgattttgtatcctgagactttgctgaagttgcttatcagcttaaggagattttgggctgaggcactggggttttctaaatataaaatcatgtcatctgcaaacagggccaatttgacttcctgtcttcctatttgaataccctttttttctttctcttgcctgattgctctggctagatcttccaatactatgttgaataggggtggtgagagagggtatccttgtcttggccagttttcaaaaggaatgcttccagcttttgcccattcagtatgatattggctgtgggtttgtcataaatagctcttattattttgagatacgttccatcaatacctagtttattgagagtttttagcatgaatgggtgttgagttttattgaaggccttttctgcatctattgagataatcgtggtttttgggcgttggttctgtttacgtgatggattacatttattaatttgcgtatgttgaaccagcctggcatcccagggatgaagctgacttgattgtggtggataagctttttgatgtgctgctggattcagtttgccagtattttattgaggattttcgcattgatgttcatcaggtgcctgaatttcaggtggcctgaaattttctttttttgttgtgtctctgccaggttttggtatcaggataatgctggccacctaaaacgaggtagggaagagtccctctttttctgttgtttggaatagtttcagaaggaatggtaccagctcctttttgtacctctggtagaatttggctgtgaatccatctgttcctggcctttttttggttcataggctattaattactgcctcaatttcagaacctgttattagtctattcagggattcaccttcttcctggtttagtcttgggagggtgtatgtgtccaggaatttatgaatttcttctagattttctagtttatttatgtaaaggtgtttatagtattctctgatggtagtttgtatttctgtgggatcagtagtgatatcctctttatcatttttgtgtgtctatttgagtcttctctcttttcttctttatttgtcttgttagtggtctatctattttgttaatcttttcagaaaaccagctcctgcgttcattgattttttaaagggttgttcgtgtctctatcttcttcagttctgctctgatcttagctgtttcttgtcttctgctagcttttcagtttgttagctcttgcttctctagttcttttcattgtgatgttagggtgttgattttagatctttcccactttctcctgtgggcatttagtgctataaatttacttctaaacactgctttagctgtatcccagagattctggtacattgtgtgtactcattgctttcaaataacttatttatttctgctttaatttcattatttacctagtagtcattcaggagcaggttgttcagtttccttgcagttttatgattttgagtgagtttcttaatcctgagttctaatttgattgcactgtggtctgagagactgtttgttattatttcagttcttttgcatttgctgaggaggtgttttacttccaatgatgcggtcaattttaaactaagtgcaatgtggtgccgagaagaatgtatattctgttgatttggggtggagagttctgtagatgtctattaggtccgctttgtccagggctgagttcaagtcctgaatatccttgttaattttctgtctcattgatctaatattgacaatggggtgttaaagtctcccactattattgtgtgggagtctaagtctctttgtaggtctctaagaacttgctttgtgaatctgggtgctcctctattgggtgcatatatatttaggatagttagctcttctttttgcattgatccctttaccattatgtaatgcccttatttgtctcttttgatcttcgttgatttaaagtctgttttatcagagactaggattgcaaaccctgcttctttttttttttctttccatttgcttggtaaatattcctccatccctttattttgagcctatgtgtgtctttgcacatgagatgggtctcctgaatacagcacaccaaggggtcttggctctttatccaattggtcagtctgtgtcttttaattggggcatttagcccatttacatttaaggttaatattgttatgtgtgaattttatcctgtcattatgatgctagctggttattttgcacattagttgattcagtttcttaatagtgtcgttattctttacaatttgatatgtttttgcagtggttggtactggtttttcctttccatatttagtgcttccttcaggagctcttctaaggcaggcctggtggtgacagaatctctcagcatttgcttgtctgtaaaggattttatttctcctttgcttatgaagcttagtttggctggatatgaaattctgggttgaaaattcttttctttaaaaatgttgaatattggtccccactctcttttggcttatagagtttctgctgaaagatcagctgttagtctgatgggcttccctttgtgggtaacccgacctttctctctggctgcccttaacatttttttcttcatttcaacctgacaactatctgtcttggggttgctcttcttgagtatctttgttgtgttctctgtatttcctgaatttgaatgttggcctgtcttgctaggtgggggaagttctcctggataatatcctgaagactgttttccaatttggttccattctccccgtcacttttaggtacaccaatcaaatgtaggtttggtcttttcacatagtctcatatttcttggaggctttattcattccttttcattctttttttgtcttcatgctttatttcgttaagttgatcttcaatctctgataccctttcttctgcttgatcgattccgctattgatacttgtgtatgcttcacgaagttcttgttctgtgttcttcagctccatcaggtcatttatgttcttctctaaactgtttattctagttagcaattcgtatagcctttttttcaaggttcttaggttctttgcattgggttaggacttgctcttttagctcggaggagtttgttattacccaccttctgaagcctacttcggtcaattcgtcaaattcattctccatccaattttgttcccttgctggcaaggagttgtgatcctttggaagagaagagtcattctggtttttggaattttcagcctttttgtgctgatttttcctcatcttcatgaatttatgtacctttggtctttgatgttggtgacctttggatggggtttctgagtggacatgctattcctttctgtttgttagttttctttctaacagtcaggcccctctgctgcaggtctgctggagtttgctggaggtccactccagacccagtttgcctgggtatcaccagcggaggcggcagaacatcaaagattgcagcttcttctttcctctggaagcttcttcccagaggggcatctgctagatgccagctggagctctcctgtatgaggtgtctgtcgacccccgctgggaggtgtctcccagtcaagaggcatgggagtcagggacccacttgaggaggcagtctgtctcttagcagagctggagcattgtgctgggagatctgctgtcctcttcagagctggcaggcaggaacatttaagtttgctgaagctgcacccacagctgccccttcccccaggtgctctgtcccagggagatgggagttttacctataagcccctgactggtgcttctgcctttctttcagagatgccctgtccagagaggaggaatctagacaggcagtctggccacagcggctttgcagtgctgtggggggatctgctctgttggaacttccctgctgctttgtttacactgtgagggggaaaccctctactcaaacctcagtaatggcggatgcccctccctcccagcaagcttgagtgtcccaggtcgacctcagactgctgtgctagtggcgagaatttcaagccagtggaacgtagcttgctgggccccatgagggtgggatcctctgagttagaccacttggctccctggcttcagccccttttccaggggagtgaacggttctgtgccgctggcgttccaggcaccactggggtatggaaaaaaactcctgcatttagctcagtgtctgcccaaacagcagcccagttttgtgcttcaaatccatggcgctggtggtgtaggcacccgagggaatctcctggtctgcgggttccgaagaccgtcggaaaagtgtagtattggggccagaatgcaccgttcctcatggcacagtccctcagggcttcccttggctagggtagggagttccccaactccttgcttcccaggtgaggcaacgccccaccctgctttggctcactctccgtgcgttgcacccactctaaccaatcccaatgagatgagccaggtaccttagtttgaaatgcagaaatcacctgccttctgcattgatctcactgggagctgcagacaggagctgttcctattcagccatcttgccagccactgtgagagtattattaatatgtgtttgatttacttattcttattctttctcctttatggggcttacaaaaattcaacccaattaggaagagatttacaatctcagcccaagatttaggatgattcttcaagttcacacattttcttacagcccaaagtgtcacttattttttttattccagtttttaccatttcaaatttttttttctttttctttcctttttttttttttttttttttttttttttttttttttgagacagcgtctcactcttttgcccatgctggagtgcagtggtgccatcttggttcactgcaacctctgcctccccgggttcaagcaattcttctgccctcagcctcctgagtagctggaactacaggcgcatgccaccacacctggctaatttttctatttttagtagagtcagggtttcaccatgttggccaggctggtcttaaactactgacctcaggtgatccgctcatcttggcctcccaaagtgctgggattacagtcatgagccacctgtgccccacctgaaactgaaaaaaaaatttttctttttttttttttttgagacagagtctcactctgtcacccaggatggagtgtagtggttctatctcagctcactgtaagctctgcctcctgggttcacaccattctcctgcctcagcctcccaagcatttgggactacaggcacccgccaccacgcctggctatttttcttttttttgtatttttagtagagacggggttttcaccatgttagccaggatggtctcaatctcctgacttcgtgatctgcctgcctcagcctcccaaagtgctgggattacaggcatgaatgtttttgtatttttagtagagacgaggtttcaacattttagccaggatgatctcgatctcctgactctgtgatccgcccaactcggcctcccaaagtgctgggattacaagcatgagccaccctgcctggccgaaaaaaatttctttaatcatctaatttagtgattcaattctgtacccacacccatctacaatggcaactggtttcttcattgtctaacttgtgttgaaggggttctacactttctaagttcttttagctgcctcacgaccaatatttcttattcttttgctgttccttaaatttgaagaagaaaattagatctcagtttcaagaggtgagagatatgagctcatttcttcttgttgttgttgttaatttcaaagactgtgtgcacatgaggtcatttcttaaagcttgtccatattctgatttgcatgttctgtattcaaactcatcagtctaatattgtttacacaagtttcttttctttcatttaaacatttaagctatttaagagtaaattaggcctggcgcagtggcttgtgcctgtaatcccagaactttgggatgctgaggtgggagaattgcttgaggcaagggattcaagattgcggtgagctatgatcatgccattgcactccagcctgggcaacagagtgagaccctgtcttaataaaaagaaaatgaattaacgaacaatatgaaatagagcaaatgaaatataaagcactagtcataaacaataggcctatcaaaaactccaccagctggcagccttcaaaacaaatatttgtgtttaaatgcggcttctttgttctaaaatgcctaaaagtcgacgaaatcatcccttttaatatctctctgctttttatttgttgatatggaattgtagatggtctacaggtagctcatgtgtcagaaaactgcttgagcttcccctaaccatcttcaaattgccattggtttagggtaatgatgaagtctctctcttacctaataatttaatttgtgtctatattaacgggtggggcaggtggaggaaatgagaaagaggttttggtttgttttacgtaagccaaccaggataagagtggacactaaacatagggtctatcaattaggcatggtctggtgaagccaatttattctgtgtgtgtgcacttgcatgcacacttacccatacacaccaccagataatttgaaattagcacttaaatggccatttgaatttgttattaggctaatcaaacctattctatctacaatgtaattatatcttggtgcaaaccagaaaatgaccaaaaatttatccaaaaaaattatcttcatttgtttaaagtgttcattttgagcatctgaaatttctgtttaaagtcatctttgctgggtgcagtgactcgcacctgtaatcacagcacgttgggaggctgaggcaggcagattgcttgagtccaggagtttgagaccagcctggtcaacgtggcaaaactccatctctacaaaaagtataaaaattgactgaacatggtggcatgctcctgtggtcccagctacatgggaagctgaggtgggagggtcacttgagcctgggaggtggagactgcagtgagctgagatcgtgccactgtactccagcctgggtgataggagtgagaccctgtctcaaaataaataaataaaaaataaagtcattttaaaaaattttatttaaagagaatcatgttggccaaacagaaagggatttttttttttttttttttttttttgagacaagattctccctctgttgcccaggctggagtgcagtggtgtgatcttggctcactgcaacctccacctcgcgcgttcaaacaaattctcctgcctcagcctccagagtagctgggactacaggtgtgcaccaccatgtctggttaatttttgtatttttagtagagacagggtttcgccatgctggccaggctggtctcgaactcctgacctcgtgatccacctgcctcgacctcccaaggtgctgggattacaggcacgagccaccacgcccagcaatggatttgtttctaattattaggatgattaggaaaacttaatatgttaattatattatgatatttgctagagctctaattagaaatattgtttctaatttgtattttgtccggaattctaagcattccttattatacttgctgcatcatctgtttgatgaattgcttttccctttaatacttttaaactttcaatcacctgaaaaagctggatgttatctaaagccttgtggatgagttgccagaaatctttggtataaatcccagtatggcttctaatgtgcatggtgaccttcaacaagtcacagagtcacagaggctcctcatcagtaaaatgaaaaggctggatttggcaatctctaaatccttccagccctgagtttccgtgttaactcttcaacaatagtggaaagcttagttaccttgatcattcaaggcagatagactctgtgtgtgtgtgtgtgcacgtgtgtgtgtgtgcacacacacgtaatgtgcctccagtgtaactgaggaaataatatctagttgctgtttgacttggtgacaaacggtagaaatagatttctttatatttctttgttctctgtgtttgaatttttatgtagcaagaggctttacatgtgcagtaattccagtgtatcaaaacaggtttgtcagggacagaaatgaattggtagtctgactggtacttctaattgcagaattatctagtagcataaaaatggctcatggactgacacatttgtcactagctaaaaatttagcttcaattcaatgtactttaaaatataggagcatttaatagtaacaatagcaataacattatgtagtgctgactataggccagacaccattctgagggttttatatctatcagttcatttcatccttgcaagttgttgtggtatgcactatactttgtccattttactgatgaggaaactgagctaaagaaagatgaaatgagctgccccatatcacacagtactaaatgcggagctgggttccagggatttcttgctcttactgttccctactgctgcccttggtaaatatctcattcggccaggcatggtggctcatacctgtaatcccagcactttgggaggctgagcagggtggatcacttgagatcaggagtttgagaccagcctggctaacatgctgaaatcttgtctatactaaaaatacaaaattagctggatgacacgcgcctgtagtctcagctactcaggaggctgaggcaggacaatcacttgaacccaggaggcggaggttgcagtgaactgagattgctccattgcactccagcctgggcaaaaagagcgaaactctgtctcaaaacaaacaaaacaaactcgttataggaatgcctggctgggttgacgtctgagtggaggcaagggtctggtatgtgctcttgtatcttctcttacagttcagtggaactttgaacaagtcatgtaatctctccaaaccagggctgtccaatggaaatagaatgtgagatgcaaatgtgagccacacatgtaattttaaacttcccagtagccatatttgaataaagtaaaatgaaatatgtaaaattattgttaatatatgtcttaagtatattatttaaatatattcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccaggtacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaatatatatatatatatatatatatatatatatatatatattcaaatgtaatcatccagcatataatcaacaatgaaaattttcagtgagataccttatattcattcactatccacattttaagtacacaatggctccacgtaactactgggtaccatattagacagcacagcaccgaaccctggagagctactgtaaaatgagaccatagcaatggatcatcactaaaaccttagatctgaaattctagaaatctatcatgagaagcacctgtgctccttaagtagtttacctttatgagatcacttgtttcttacctgcttcagtagcacggagaaaacattttaagatactaattcaacaatgaaatgatcctttaagaatcacaaaggcaaagcagtgtcaagagaatgtgtgctatgagagaagattttcagaaagcagccatgctttagtgggttttgttgttgttgttgttttttaaatcaattagtccttcaaatatctgagagctttctgtgggctaggtcctattctaggcctcaggtacttagaagagaacaaaggccctggtcttatggtgtctttactgtgatttaacagtaaatagacatgaaggatgcctttgggttaggtaagtactatgaataaagcagagtaagagattagagagtggaggctggagacctgggaactggtgggcctaattttgccaggagtaattctctgaagggtgacaatggaggggagactggattaagagatggtataaactatatgaagacccagggaacaatgtaccaggaagtgactgggcattctaggctggggagacagcctgaggtggaaatgggcttggtgggtttgaggaagaacaggaacgcattgtgtttggagttgagcaagagagagagtgataggcagcatggctgggaagtaggagtttggattttaatttaagtgttaggggaggccaagaagagtcatgattggcgtggagaagtgatttgatggtctttttaaaaagaaagctctgattgctggacagataacatgtggtaatggtggaggcaggaagaccagttgagatgttatggaatgtccaggtgacctgtcatggtgacttggactagcataaaagtgaagggggttgatcaaattggttagatttgatatacgttctgaaggtagagttgattggatgtattggtagatggcccaggagtatgcaaggatgtcatcaggatgactcccaggtttttggctcaggcaactgggtccttggtagtgtcacttactgagatgggtgagagaggttggagaatggatttggtggagtgagggggtggaggtagacagtcaacaaacagttctgtttttagacattttcaggttgctacatctttataattgtgaatatcccattcacaattataaccacattgtggctagaggccgagcgcagtggctcacgcctgtaatcccaacactttgggaggccaaggtgggtggattgtgagatcaggagatcgagaccatcctggctaacatggtgaaaccctgtctctactaaaaatacaaaaaaattaaccggtcgtggtggtgggtgcctgtagtcccagcgactcaggaggctgaagcaggagaatggcgtgaacccgggaggcggagcttgcagtgagccaagatcgtgccaccacactccagcctgggcgacagagtgagactctgcctcaaaaataaaaaataaaataaaaattgtggctagagggatttaacatctttatctaacacatttggagaagggactttgccctaacacagagagctggaggtggagttattgtttcatcaaggcatggactcaggataaggatgaggcctttttgatgcttttctttggatagtgatgttagtgacagaagcaggaattatgacgtagagtaaataaaaactttactgctaagaggtcctgtttctgtgcttaggaaagagctgtttccaaagtttgtaatcacctgctgagcatcagcatgcctgtacctcgtgtgtaatactgaaatattcctatgtctcttggtaaatacccactgcccctgagtgcccccatcttcctgctgctgacttagccatcagagccttgcttctggtggtactcctgacctccctctactcagcacataataagtagtgccttgcacagcagttagcttccttggcttcgttccagccattacagtggaacagtatccgttctgattagtcagtgcccatgccatgccattagcattgccaaatcttttgagtatcaccaatggttctacccatgggtagggtcacgcctaagcaatgtgaagttggaaagagtaatcttaatgaaccagccacttccaaatagtcaagaatgttgatgtccttgatctcttgaatgaattttaggtttccattctgctttaccattctgtgaatactgcacaatgtgtgctatggtagccagtgtctgggttgacaaggcctctcatggtttacttgtatcccaacataaatgcgatagattgggcattcctcatcctatcctattgcaaagaactctgagatttcagacaaaccctgcatgtatagcatgaactgtgggtgaagaccaagatatgaagtatttcagtgaccataatgcaacaacaacaacaacaacaaaaatcttgctctttccctttgactctatgttatctactttgggatttctccaaaaaaaaaaccccaaaaaacaaaaaaacaaaaaccaaaagaactgatgattctgttggacttggaaggttcgcatgcaaagtgaagtgttggatatggtaaaattcttcactgattatttaaacgtgtgtgtgtgtgtgtgtgtgtgtgtgtgtgtgtgtgtgtgtgtgtgtgtatttcattttcaaccaccagcagtgggttgggatggtctaagtacagaaatgtgtatgatgataaacatgttgatgaaaagacaaaaagcttttggtcttgggtggggaggagtgtgagtttggaccctgcttggtcattctgctctgatggaggttcccatctccttggtgatctgcagcagaaggaagtacatgctgaatgttgggtaaggggagagcagaaagtgctgtctcctgcagtctgagcttgaacaagtttttctggaggtgatgggaactcctcaggactttgccaaataggtggcactgacctgatcagaagaaagaaggtgtttcagatattccatattgtaaataaatgtccctgactattggtttacctttagtggctaaaaaaaaaagcattgtctcctgaaaccccaatttgggataatttctgggaggcactaggagagtctcttctctgagaaattgatggctaatttggagactgaaggaatcaagtggctggttagttacatttcttcctgtgtaaaagctccatgacagtgctgctgttacatttgtttcaacaactaaaccatgtgccttgattccacaggcaatggagaactttctctctgtgccaagaactgtgggtaaagagaaaagcaagactgacaaacataagtggattttcagtgaaattagacttttaaaccccctggtctttccaagttcataaccctttaggaggcaagctggcttctactgccttaaatatgtttggcatttacagtaaattatgactgtgggagtatttgcaatctaccacccctgacgatttctttgaggaaaagattctttctcactgggtcagcccgtgggctcttcatggggagaatctaggcagtggatgatgcagagagaatgctaatgaactgagggaagccaagttgatctattaatataatacacagctgaagtggggaagaaggaaggcagaacagccatgagactgcatggcagggagcttttttggagggagtgttgagactaggagagtttcggggagcattttctctctgtgtggaagatattaggagggtcagggataaagagaatattttgaggatgcattgtgaaaacgaagaatccatctccttgttggcgtttcatagactgagaaaggattggagaattaagtacatgttcattgcctcactgtgcttatttgaattaatacagtggcaaaattatgcagcatggggccccaggatttattgagaaaacactgaaaacactaaaatggggtactgtcagataccccaaaaacttgaggatccagggtggttaggctgaccctgtgtgacagagacaatgagatggaaggagtatgtgtctagttttggtcactgggatgtgggtggaagtgatatgtaccatttctgggactggcctataataaatctcctattctcagtcctctttgtctctgtctagagtcatctttgaggcctttggttagagaaggcagagctacaagagaaaaatgcctgtgctctgaatcgctgcatggaggaaagctggccaaccatgaacatgtacattgaactccatgtacaggagggaaaaataagttttaattgtgttaaatcactgagatcttgggaattatttgttactgcaacagagcccagcatattctgactaatacattctatttccaaacaagaagtatagtggtaacctctctgccactctgactaactacactactagctgctgtttcttcccttacatttgggagaaacagctgctaatccttaatgaacatgttcctctcatttccaacaggagtaaaactttggcaaggaagaggagagaaagtagtgggagccacttagtggtaaatcattagcacatcgcacattatggtgggattttcctgcatcagttcatgttccacaagattagctcatgaataaatgagtctttttaaaaaccactttattgattgacatgtatgattgacgcatagaaagctgtacatatttaacaaatacaacttaacaagtttggagaaaagtagatacctgtgtaaccattatcaccatcaaggccaaaaacattcttcccctccccaaatttcctcctgccccttttgttattattagagataacacacttaagatctacgctgttagcaaattttaaggatacaatgtattattgttagttataggcaccatgccgtatagtctccagaatttatttatcttgcataactgaaacttcgtatcctttaactgtcatttctttatttccccattgtcctactccctggcaactgccattctactctctgcttccaagagtttgaactcttttagattctacatctaagtgtgatcacaaatttagtgttaagtttgtgagtgtagagaagcatattatggaataaaagttttgtgtgtctcttaaaatttatatgttaaaactttaattctcaatgtgatagtatttggaggtggggcctttaggaggtaaataggttagataacgtcatggagatggggccctggtccaatggaatgagtgtctttctctgtctggcttatttcacttagcataacgttctccaagtccatccagttgtgcaaaatggcaggatttccttctttttaaaggctgaataatattccatgtgtgtttatgtcacattttctttatccattcatctgtcaatggacatttatccataacttggctattacgaataatgctgcaatgggagcattatacgtggagtgcagggatctcattcagatcctgctttcatttcctttggataaatacccagaagttggatttctggatcttatacttgttctatttttaaattttttaactgccaagtccaatattttttaatattttgagaaacctccatactgttttccacaaagactatacaaatttacattcccatgaacagtgtactagatttcccttttctccacatcctcatcaatacttgtcatcttttttttttttttaaataatagccattgtaacaggtatgaggtaatatctcactgtggtttgatttgcattcttttgatgattagtgatattgagcaggagtgaactttgtctttcttttgctcttgtgtctttgtttacattttaggttttagtatttgctttttgtttttatttacttatttaaacgttttgcctgattgtagactcacagagcatgagagccctgagagaagtgtttggcctgacaagatacagattaagtttggagctactttccctgcaggcttggtaggaatgatgtctggaaaaggatcttagaggagaacttttcccatgcctgtggcaccttggctaccttgtagctttaatgtttggtgaggactttgattttagttctttgagtgggtgtaatcttactttttctttcttgtcagaggcaaaatagtggattgggttagagcttagtttttggtgtctactttccagctgctactcactgtttgacccttgatgagtaacttaatttctttgggactacatttatttccttatttgtaaaaccaaataatagatgtagatctttagcctagtttctagtatattataaccactcaataataactattttatcaatattgttattattagtgacaatattattatttcctgtctagtttctttgatgttaatgcttcttaaattgtgcattgcttttgggtcttagtactttacattttgggggcaactgaagtttaggaacttctagatcatgagagcactcagagtgtatttgtgtccacaatggtaagtcagtgtagaaacccaaaagctaaatgtattttggctcactcagaatagcctcttccatttttaacttcagcatcagggtatggtgggtgcgagaatgggaagttactcaaacccaccaacagcagaaaaatgagttattttcattgccttggctttgcttctttctttttctctgatgatcatacgtgtaagaaaaaggctggaaaggggacaatacaaagggaggagatttaaagctattgtctgaactctctgctttccaccttcatggctattgttgggaggtaattccttatgggcatctcatgtttcttgtgtcttgcaagtgaggctctaaatgttcttcttagggactctcctttcaaagatgttgggatagcaaacagtcttggaagacagaggcaatgtctttctccagagtaaaggacagacatgcttactgcccactataaaagatttagtttcctatgttcagagttcccctcctgtaacacaagcattgagcattcaggcatccatctgggcctgcccatgtagctcccttgggatgctggagcaggagaactgatgcaaatatgtagatactcatgttactttctatgcaatgaataataaagccctctgtctcatgccttctaccagcatctatagcatgctaacatgggagcttgcaagtaaggtaaaatctccaacccttcttagttcttgatagccactatcttggctaccagtcttctagctgccttaaaaccacttgagaatagggtaatgtaaaacaaatgtaactagaatgaagctcagactagatccagtctcagagtgtgtccttacctacttacttcctatctttctacccctcctcctttcctattcattctgcattattaaaaccccaatttggcaaggacaaaatcatctttgaagtgcaagggaggagaaaaacttaaggagtgaaaccagagtcccctttcacacaaatgagagaggaaaagttgctgacattcatttgttaatcctctctgtcccattataagcaagatccagtcttcttacatcttacagatatttgcaataggtgattcttgttcttctctgttctagtctgtaatattataacagaaatatgtatcagaaatagcttatttggttgctatcatttgatcaaactcatagatattggcattaatatataaatggcttatttagctttaagtttgtgagtgtagagacgcatattatggaataaaagtttgtatctctcttaaaatttatatgttaaaactctaattctcaatgtgatgatatttggaagtggggcctttaggaggtaaataggttagatgaagtcatggagatgaggccatggtccaatggaattagtgctcttataaaaagagacaacagagattttgcctctgtctcttcaacatttaaggtgtaggggcagaaggaactttccaccccatgaagatttaataatttgattctgtaaaacaaactgacaatagacagattaacaagagaaaaggcaaacatatttgttaatgtgcaagcacacaggagccacacaaaataggaaactcaaaaggaccagaaggctaaagtttaactattctataggggagagggaggtgggggatgtaggtaattttagaggaagaatacatgatttttaggggaaataaatgaacccaaagaacagacaacagcttaggacaaagttcctctgggaaggtgaggggtggaactaaactgtaaacaaagtttgtgttattattcagataaagcctctcaggtaataaaagttgttttggagcagcctccagaagaataggtagtagccagtctgggtgtggtgttgacttttaatatcttctgcagtgattaatcttccctggttgtttgatgagcttcctaaagaggtggatcaagacaattgcaatccttctggaaaatcttcccttggtcagatacatgaacctccctgcatttcaaaaaggaaagaggtggtggcgggctggatcaggagaagatcagagagagactttgattctgaggcttttaaatcacatttgttcaaagcgctcagcatgccaaagggccatattttgaggatttttttctgaaccccaacagaggatacagcaataaggcgtgatggctgcctgaaaaatcaggatgtgttttctccccaggaatcaaatcaaccagcaccttgatcttggacttctcagcctccaaactgtgggaaataaatttctattgtctaagccacctagactggtattttgttaggagtattttactttggtaccaaggatggtgtgctgccataagcaaatatctaaaaatgtggaagtggctttgaaactggataatgggtagagcatggaagagttttgaggtgtgtgctagaaatatggatgttaaaggcaattttggtgagggcttagaaagaaaggggagagctggagagaaaaccaccatctttgtagagaatacttaagtaatcatgaatgcaatgctggtagaaatatggacattaaaagcggttctggtgaggtctcagaaggaaatgagaaacaggttattagaaactggaggaaactgctactttattataaagtgacagagcactagattgcattgtgtttgtgttccagtgcaggcagtgaagttgatatttagctgaggaaatgtctaagcaaagtattgaaggagtaccttggttcttcctgactgcttctagtaaaatggagaaaagagaaatgaatttaagaaggaattcctatgcaaaaaggaaccagaacttgaagatttggcaaattcttaggctatccatattgcaaagaatgagaaagattattctgaaaagaacactaagggtgtggctgaacactatttgataaggagatagtatggatgtgaatgaaggatttgatcagctatttcaacagaagccgggaatggggatgggattataccaagagaaatgttgccagctgggactaaagggggcagaaataaacaggagtgactgaaagaaggatgttgggccatcgccaaggtgctatggggaaattaaagtaacaaaattagaaaaaattattaaaaagcaaaaaaaaaaaaaaacaggatattgggcttcgtacattgtcaggataggatgatggggccatttggctgtgaacatgctttatctttcaagaaaagggaagaataatcccaaaggcaatttggagagcatcagagctgccactcttaccacaggtcaagggggcagggctggttcctcatctgtttcaaagggttgggtggccattctagtttttgctggccaggatgcctctgcccatgacttcattctcccttagagaatcacatggggtgggcctttccagagagccaggagactgggctctcacagggaagaactcattccagatttaactccaaagtctcatctaaataccatctaaattaggtataggtgatactcaaggtacgattcatcctgaagcaaaattcctctccatctgtgaacctgtgaaatcaaattatgcacattcaaaatccattgatgatgcaggcataggttatatagatattctcattctaaaagggagaaatcagaaaaaagagatgacatgttccaagcaagtccaaaacctagcaaggaaaattcgattagatgctaaggcttaagaataatcttctttggttcagtactctgccttctgtccccattaaggtagcagcatcatgcccttggctctggggccgtcttgcccccaaggctttttgtgagagccccaccacctttgcattcaagatggacatgaattttgggagcccagaggaagaatattatggcctgaatgttccccctaccccaaattcagatgttttgaagccttaaccctcaatgtaatgttaggagatggggcctttaggaagtaattagggttaagtgaggtcaggagggtgcggtcccagtccaatgagattagcacccttatgagaaaagacactagagtttttttttctctctctccaccatgtgaggacacagtaagaaggccagtgcctgcaagccaggaatcaggccctaaccaggaactaaattgttggcgaaaatcttgatcttggacttactagccttcagaactgtgagaaataaatttctgttgttaagccacccagccctaagaaacaaatacagagcagcaagtaggtatgaaaagacattcagcacttaaagaagtttgcaaagttcttagagttggtttccttggaaaccttgttggtattacagcctttctttattgcaccgatgttcaagtgtgtgagatgcagatgaaggttatctgcagaggacacatataatgttagacctagcatgccctccttgagaaccttactacagccactccaactcccatacacacttgaatcttctgactcaaacagtggttccatcaagcctctcttcctgtgtactgacttatggtggcttcttcttttaggattcatcagcaatcacttattctgatttcttacatatgccttctcagcatgtcacttggcatctctcgtctgtgtgagccagtgattaacttgaaattctcttactctaattctgtggtaactgttctatttattattacagactgttgaagctcccagaaaatctccaatcattttgtgcaaatccattattttacagataagaagagaaaaatgtcttaatcagcttgggctgctgtaacagaataccgtagactgggtggcttaaataacaagcgtttatttctcatagtttcagaggctgggaagtctgagatcagagtgccaccatattcgggttctggtgagggccctctccctggcttgcattgcctgcattttactgtgtccccacttggcagagagaaattctggtgtctcttcctgttcttataataagataaatcccaacctggcgtctgcatcctcatgacctcatctaaacctaattacctcccaaaggcctcaccatcttatatcattgcactatgggttagggtttcaacacatgacctttgggagggacataaacattccgctcataacagagagcttaaggaggttgaagatgttgaggcttacacctttttttcctttcacaacaatccacaaaactgcttccccaggaaccccaaataaggaaaccctttacaacccatttggtggcagcattctgaaagaattcccttctgagcctttgataagttgcactgagcattaccagtatgcatgagacatagcatctaaacacagatttcagtttttatattccttttacttcttttagtgataatggccattcacttcctgaaaagagagggctatgaatattaagaagaatccaagagggtgagattctggttttgtataatcataggaaaatattcattaactaattccaaaaataacaaccaacttaatgagtttgtagggagaaatgttgcttgactttaaggagatttggaaatacttacacttaaaagatgagaaagaaggagtaagaatgaggcttcttttcctagtaactggaaacataaccttcttagaatttattttttggtaggagatggcttttttctttcccttttggaaaacaataacttttaattgctgataatttctcctgggtcaaggctttaaaaggacagaatagttttcttccttctgctagagtaataaagcacttaaaatgtttctgtttcatttcacggctgcccactgaagaatctagtccatcttgttctggtaaacatttcctgaaccacttcattgtttgagttttttccctccattaacaggaaagggagatatctctcaacagaatatatgaaacttatcaggaattaccctctgccaatggatagtctcttacctagttttgttttggagtggaaaaataatgctgcttataataggatcttagaactcgaaaggaatttagaaatcatagaattcaacttcataatttcaagctgaggtaactgagactaaggggcgaaacttgctaactagaaaagattcagtactagaactaaagttctttggctttcagctcagtgctgtttctggcctataatactggtctcctttctagttggataggtctttgtcggctatatttctctttctgtgcctggcttatttcacttaacataaggtcctcctggctcatccatgttgtcacagatgacaggatttccttctttttaaagactgagtagtatttcactgtgttaatgaaccacattttctttatcctttcacatgaaagtcttatgacctggtttagaggagggtcaggaaatctttcctgggttgtatgacctgtttgggggagaaaagtgggaggaaggtgagagtgaccttcctgcctctgtcattttctcaaatgccaatgtgccatattgtaggatagcacatcctgaaccccatcaccggggtggctgggatgtcatctctgtatagaaatcttattccaagcacttacgtgttgaagtaaagagcccatgtttgcatctttccacccaaggattggtcatctctggtcaagacctgaggtccaggatgagctctttcccacagaaactttgacaaatgtgtggacaataaagaagcactgcttccctcattcaccatagctcagctggatttatagatttaaatcttttaacgaaaaagttcatgttgaggtatttagatactttttagagggttaaataccaagttacagtgacatttaaaccgagtgtctagaacatgaaggcaaagagtctgctattcggaggtaaattttatcagtgtttgaaaggtgaagcatttgctcatgaaatgttgaatgaatttctgtgacatggcacgagggtggtaagaaaaagtggaaactcaaagatgtatttttgcttcatccaccagaggactggaatgttgggggatgctgaatcagtgagcaaagcagaaagaatgatagaatcattggtagcatcttcggggtttacgtagtgcttttgtctagtttggtccttgcaacaaccccataggtggtcaggtattgtttctgttctacatgtgcagaaacccagatacattgagccaatggtggagccatgacttgatctcaggcctctgggctctggattatgtgattttgcttccatgtcattctgcttctttggtaaggactgaaaggtggatggtcaggattaccaggtgcttagcaatgagaagccagccagaggaatttatcttactgtgttttcagacagtatccatggaaatgtggacttgagtgatgagcctgtccattgctcatgtggccaggttcacttagaggattagtgacagcatgtgtaaggaacgtgaccaacactgaatcccaccctactctgctgacttcagacttccacttagggctttaccaaagtgagagagactaaacttcagcctttgatgcttgacatttttataggttctggaaacctctatctctaccggatagttgattttctctaaatacaaagcacaggactgtcagtctgtgagaccttgtcttatttggctgtggttttgggtgtagcagaacagagcattgcaaatttgttgactgaagtgtttttagcagcagagaaggatgaaagaggaacacctgggcaggagctcaagcaatggcatctcagccgaaatagctctgaagtcttatatttacaaaaatttgtgggaattttacattatgctgtaaaatatttattaccatattaaaagtaatgttccagattaattgcaatgagtgatagtgactctctagacttttctcagaggtgtttttttttttttttttttttttttgttttttttttttgagatggagtcttactctgtctcccaggctggagtgcagtggtgcaatcttggctcactgcaagctccacctcccaggttcacaccattctcccgcctcagcctcccgccaccacgcctggctaattattttttgtatttttagtggagacggggtttcaccatgttagccaggatagtctcaatctcctgacctcgtgatctgccctcctcggcctcccaaagtgctgggattacaggcgtgagccactgtgcccggcctctcagaggttttgactcccgtgacacattgctggctgcccttggattcctcttctcagtttaagaatttctgattcttaactcgtctcagtttaagaatgctcttcctaaactcacttgattttcattccatttcctctttcaggagagctacctactcctgcaaatgatgtctctttctatgtagagtagaaagaatagaatttctattgttacacaaatatgcattgttttcccaatatgaaaatactggaactcttcattcctaaaacatgtaaggtcagagagctttattctaaagctttattcaaagttccaggcttaccctggaacttgagctcctcctgacccttgatgccagataaaatgtgtggttggggggtttgcatcagtggctcttaggcatttacagccatcagaccaaacatttcacacacaaaagctatcacaatggctaagagaaagggcattggttttggaacagtaggagatgatctctggttttaatataaacataattgttcatgaaagaagaatatgagtacacccatgcagcagtcatcattttgagccagccaactgtgtgaagagctttgtgggccaaactttgggagccactaatttgttggaagcctggtacaaccagatgtttgccctactttaatgaagacaaaaaagagttggcagcaaggaaatgtaatctagggcatttatgagttgggtggcagattaaatgtgtacagtacaggctacatactttgtggggccagtgcaaaatgaaaatgtagggtccttgggcaaaagttatagagaatttcaagacagtaacagcagagcattaaacaaagcacagggcctttcaaagcatgaagccctgtgcaattgcacagatcacatgcccatgaggccggccctgataaagtttcttaaattgggaaagttgtgggtgtagtttgagtgtgaaggaaaaaaaaaacaaaaccattaatacaaaggtaataaatgagaaaaaaggaaaggcgaatcccatgaggaacaaggttgctttgtaagtgaagtgtggaaaagccatggtctatgctggagaggaggagagaggagaatgctacaggctggagagaatgacccagagatctgatgttacaaaccaggtctctcccaggggtgggtcgggagggctagtgggtaatattctagttgacagaataacatccatataaggcacaaaattgattggttaaataattgtaggattctgttttacaccgttcattgaaacccattggtagttgcatttgctatgcggtcagaaaatggtgaacaagttattactatttgttttgttcgtcttgggaaaagaatttagtctatagtgtggaggagtttcagagaattcacctctgaattcatggatagtgattccaatgtctttttaaaagatggaaacttgaacctcagtgaaatataaaggctatgagcataattcaagctttacggcagtcagcaatcaaacacagtactcatttattcattctggcaatatcattcatggtgcaaaaggccagtttcaaatataaacaggaccaggcagggaagacgtatgtgtgaggacaatgaggaccaatggtgactaaggcaagccagagagaatggggcctgttgaaaaatgctcagaatcaaataattgtaaaacatgatgcaggactgagcacagtctgtctggagattaggtttaattggctatcagtttgcatcccctgatagatgagtcactgggaaaaagcagacccattggtggccctggaaagcattgaagtaaaacattgttaccaagagtggagggcttaagagacaaacagtatcatccaatgaatgaaacccttccaactaagagcccggcaccagtgggcttccgtcagatgggactgcccactgcccgggacctatgttgtcccagacaacaaggtagcttatgtattctttctccaataggccagtttggtgagctacgagggtttaatgactaattaggaaattattttactgctcttcctaaactcacttgattttcattccatttcctgtttcaggagagctacctactcctgcaaatgatgtctctttctatgcagagtagaaagaatagaatttctattgttacacaaatatgcattgttttcccaatatgaaaatactggaactcttcattcctaaaacatataaggtcagagagctttattcaaataacgtgtgttctattagcgtaaatgaggtttatatctgtgaacgctgatgttagtgtctgattaatcttgagtaaaagattctttctttcacttctctttcctagccaaagaacactagatctttttgctccttagttcagctaaatctcggtttttgtgtcacgaccaggaaaagttaggcacacagacacattgaagggtgaggggaatggaatttattgggcaaaaggaaaaaagaaaacaaaaaaacaaaaacaacaacaaaaaaacgtctcagcaaagcaagaggggttcctgccaagggctcccacctcacagattgaataccaggccaccacacacgagctgaagagcccacgctcctccccctgcacaaggcgcgaacttcccgtagctccaccttcttttttcccagtgcgcaggcgcatcggagattctcggacgaccctttccttatccgcctcctgtgtctatcattttcttcactcctaatctgtttattgctttgttttgtttttgagatggagtttcactgttgttgcctgggctggagtgcaatggcgcgatcttggcgcactgcaacctccgcctcccgggttcaagcgattctcctgcctcagcctccccagtagctgggattacaagcacacgccaccatgccctgctaatttttgttttttttagtagagacagggttttgccatgttggccaggctggtctcgaactcctgacctcagatgatccaaccacatcggcctcccaaagtgctgggattacaggcgtgagccactgcgtccggccctaatctgtttttcacactctcattcctcatcttgctctctggtctaccctgagtttcttaaaggaaactgaccgagtatggttttgccaacgccggggtgccatgtgacacacattagagagtttgtatcttttgggcctgtgcaggaaagactggagactacaagtttcccacctgtgccaaggagaatactcattcatacctgtgtacgccaggtagcagttaaaggagaaatcaattgctctcacagtttcacaagaaaaaatggtttaaaaaattgtctttactgatgaaagctctttcttgaactctattgtcaaaatagggacgtgaccgtctttaaaaatagctggtttgggaaaaaaattactggtgcgaattgcacggaagaaaaggggtgtactttggctttcctctctcctttaactgcactatcagaatcaaatctgggcttccaatacatttttaaccagagagttgtgaaaaggccctcaaacaaggacattcatgctgtttatagctggcttttgttattattattaatttattttagttgacaaacaaaaatcaatatatggtgtacaaatgatgttttaaagtatgtatgcattgtggaatggctaaatcaagctaattatacatgcagatcactgacttttaatagaaaaaggaaatattgttaccttgcttttaaaattgagatactttatgatgtcagtgcatactctatagttacaattttttgttttgctagattttaaaatttaattgtcattattcctgtcactagccacctcatcctgggagacggacacctataatcttaaacctcaatgtaacttggtgtgatggagaacggaagggatgtctcactaggagaaatgccatagattgaaggaggcccgacggcatgtcagcgcgctgcccagcacaccctcccaatgcatctgtacttgaccaagccattcccggaagcagatcatggcaggctccccggggctggcatatgcttatcctaaattacaaaactggcatttgcctctactcagccctgttttctgtatgactatcaaattgtttactgacaaagtcacaatgagctttcatactccctttgtgggaactggaaaaaggttactgctcagaataaatccactgggccgggttcagtcctcatttactaccctctgtgtagcaggaacggcccattatcccttacagggatgctcagaatcccagcagaggggccttgccattctccttccccctattcaaaaattctccgttctgtggctttttcttccagggtctttattttaccgaatgacctaataacttgatgaataaattcaaacaacaaagatgttaatagcagtgcttgttccagctatgctattatattgccaatgttgtcatcatcgtctagagtactgtttccttactttacatctggtaacaatctcatccattttgccaaactgaactctaatatcaattactctgaaaaatttcctgacccttccaagtgagtaagttatttccctctctgaatgcttgtagtagagtgtttatatattttcatatttcttacattgcttaataaatatttacatgtcagtctcccctgatgtcctgtaaccctttgagatcagaggcagtggtgttcttgtttatatctccagctcatggtttattatttagacataataggtgctcaacaaataaataatgactggatcatggtattgaatgaactggtcaatcaaacttagtacttaccatggtgtttttcccttaattgggggctcctaaagacgactctttaaagcagctgattggagtgtagacagctggaaggacagcaccctcttggctcttttcccagaaaccagctgctattttgccttccagtcagggttagatcaggaattactaagaactctgtgaagaatggcttggccctagttccctgctttttacttgagtttccggagcattgggaatctccacatatatgccagtaaatcctctggttttctggatttgagggaaagttgcgtcttatgttttctctgatgtgttcatgagcagagggcactgtctttgaggcagaataccaggtgctgtaatagatacaaaggagtaccccaaacctgctctgaggaggtaatttataactggagagagaaatgtgtaacgtgataaactacatgaggggtcagaaatcactgcagactttggtgattagagaagtcttcatgggagtggatttggagctggacctggaatgataaattggatttctatttgttcattcaattgacaaatatttgtctagtgtaccccattcttccctaggtatgggaatacaaagagtgctcactcagaagtatactagtgtgagctccaaactttttgggtgatagaacccctaaaagtaatagagttctttgcccagccccataacttactgccaaattagcacaaaaagtctaaatggactaaggaacataccagcaaggttttagtatagatgaaaggaaagaggttccatatgttgacaaaaaagttttttgctttttctgttgttgtttttgagacggagacttgctctgttgcccaggctggaatgcagtggaataatctctgctcactgcaacctccacctcccaggttcaagctattctcctgtctcagcatgcaccaccacgcccagctaatttttgtattttttttatggagatggggtttcaccatgttggccaggctggtctcgaactcctgacctcaagtgatctcgcctcagcctcccaaagtgctgggatggattataggcgttagccaccatgcccggcctaaaagttttttaatagaaaattttactggagaaattttatgggagagttttatcaaatagcttatttttctgtcttcttggaaaagattctattcatttagtgcaaaagtaattgcgggttttgccactttttttaaagtatggcaaaaaccgcaattacttttgcaccaacctaataccaagacgagcactgaagatagaaccataggcaagaccgatattttaaaagcttattgaagaaaatgggtcagaaaaagaatcatttgaattggggcagaagctgttcatcaagttcctcaacatgattgagcatggtgtctggttttgttttcaaaactcagttttgtctttaacgttatactgtgtccactcaaggctgatgaattacagccctttttgctaaatttgttcatcatttctccagagactcaggctatgagacgaaaagggttttacatggtacaaatgcaacatctctagaaggaactaaaagggcaagacgtttggtttgtcagagcagttctgatgggtcaagttaggtcctgaggaatgttgtttgttgggagtgctgccaatagctgtaacattgttcaacaaactccaccaggcttgacattcaagacttgaaataagatagtaaaatgcccaagtttctgtgaacccagaaaatctaagacaggtctcagttaatttagaaagtttattttgccaagcttgaggatgtgtacccatgacacagcctcaggaggtcctgttgacatgtgcccaaggtgtcagagcacagtttggttttatacattctagggagacatgagacatcaatcaacaaatgtaaggtgaacactggttccgtctggaaaggtgtgacaactcgaagcaaaggtgggacagtttgaagtggggaggggcttccaggtcataggtagacaaaacacaaatggttgcattcttctgagtttctgattagcctctccaaatgaggcaatcagatatgcatttatctcagtgagcagaggggtgactgaatagaatgggaggcagcttggccctaagcagttcccagcttgacttttccctatagctgagagatttgggggcccaagatttattttcttttcacacttcctttttctcctttttggatcattttgggatcggtataatctcttcttcctattcctttccccgcatgtcgccacctgacatatgcccccaacaagcatatagtctatgccatatcacaccacagcatcagaggcacttattatgggatgcaggagggaggtgtaggcgaggaggcgtagggtacagcaagaacctttgttaaaagggagtttttgtgatttctcagacctgtttctaatcctaggtaaaacaacaaaaatcagttgtgcaatacaatgttatatgcaacaagtttcttttcagaaacaaaaaaaatcactgtaaaacactgtcatcctttgaaagttgttataatcagctcaatgaacatggcttaatttcagtcactcagaaaattatatctttttgttaatctcaatatttacgtttctgcttgatgcagtcaatgacatttgtttattgacctctataaatgatgagcttaggtgtaactggcattcagagagaaggctgtcatattgcagaaaaatatgaagtggcctttatttttatgttcagaagcatgtgtgatgccagatgttttttatacgcagtgcacttagaaatgcatttgtgaactctagacctgcaggggagataccagctccctccctgcaggtctgagggagccccagtgtgccatctctattctccttatcctgggagacaaatgtagccctgtgcttgggcaatcttccaaaggactcatatcttgtttttgcttttaaaaaaaattagcccagtccatgaagaggtgcttgttttttgaaaacatccctaactgccttgagtgcgtcttatctctctctctcttgagagaatacaatggttgcaatttgaattctgctatggtaaaattcatttcctgcctgtggtgctgcccagatttactttatcctattcacatgcctgtcaagtgatagcgtgggttagttgagagtagcaggaagggaaaggaaatgagaagcgcaatgttttataatcacacaatcagcatcttgcttcgagaacaacagttcggaagggagtagtatgatgggctggataaaaacgggctttgaggccaaaacccactggtgccccttcctaactctgtgggaagggctcagagaagttaaataacctccggtttcctcttctacaggatgaggtgtgtgtatgttgcactcagcacagcagccctcaataaatggtggttctcagtattcacaaagagctggaaagaaatattgaaggcatttgtcatgaagaatcatcttctgtgctcacgaagctatgatggcctctttggtgttgagcaggcacattcccatttataatttatccacctagtctcctcaattccttgatgacctaagccaaggaataaatccaaacattaacttaacaaatattcaccaagcatcagctctgtactgctggactgtgccaagtgatgtggagaatgcaaatataaaagatgtggcaacagcagcaaatagtctaagatgagcttgagacatggcaaacagctccaccctatagcattctgtaaccagtgccaagcaaggggtggaaagtgcgactgtttggaagtggtcagagatggtttcttgtaaaaggtgaaatgagcgaggcaacaggaaaggcttcatttaattccccacattttacacaaaatactgctcacttatttcctgttcccaagggcccacagtgttcctagacaacatgagtctctccttgcttgaaacaaaaacaggtgtttagagtgagcatggacttattcaatgtgggctgctctcccatgcacacggagaaggccctatcattgcccagaaacttgagcaaatctggtagggccaaggccaagtctaatgtcttccactctaagaaagagtttctagttataaactcaggagagggcttctcattatgcttgataaatccttcaagtcctttcaccttttagagacaacagccaaaccattacactttcaaattgagcgtggggcccctttcacaatggagagagactaggaaaaaggacatttttccaactgacaagcttgatagcttcgagtgtcacctcagctcaagttcttcagaactcagcagactacctgtaaatacttgacactttgggtgtaaaactcattttgatttgtttttggtgcttgttctatttagggccagctggagaccacagcagtagatagttcatggaaacttgccttttccttccacactcggagccgatgtggagtggctggagagtgctggtgggcttttgaagtgtctgccctggcagaaaaggcagaggcagacctggtctccatcttgactagaaatgctgactatctggaaaaacaagagcctagatttaaagaatgggcctgccccagcctctgaattcccagttctatactcaagactttttgactctgttgctccactgtgttgctgctgacttatttccttatccctgtaactgttttcaatttattcactctgtgccacgatggagtttcacccctccctgcccagccatatcacctcccctatgctacagagaatccagcagatgaggccttgcttgtgaactggcttcttagattctgatacattaggcaaaaaggaagcagttctacaaagcactttctaaatggtgaaccattcattgtacaatataaggcagctccagtatgatcagactctcgtgtgctcactaggagggaagagtaaaaagaacactttcaagcaagcttttaaaactacatgcacatttgacttctacttgtttttctttcagccttgctctgcattgccaatgtgtccttggacagcatagctgaaaaggagaatgtgttggaaagacagcgatggtgattctttgcaggatgtgttgtgacagccctgatcagagcttagatggtgcaaattgacaggttgctgtcaggctccaagctcacagcagctggctgccctgcccccaggaggccttgcatctccttcagccttcaaaagtcaggggcggtggctcacacctgtaattccagcactttgggaggctgaggtgagtggatcacctgagatcaggagttcgagaccagcctggccaacatgatgaaacctcatctctactaaaaatataaaattagcctggcgtggtagtgcacgcctgtaatcccagttacttgggaggcttgaacctgggaggtagaggttgcagtgagccaagatcacaccactgcactccagcctggacaatagagtgagactccgtttcaaaaaaaaaaaggaatgttagggagggtattttgatcatgcagactacagcttcagcttttacctctgtaattggaggtaataacactgccttgctactcatggttcttgtgtgattctaagggaataacatctctgacaacacacagaacaaaattaagtgctaaccaagtgtagagttataacacatctcttattagagtatcaagaattgtttttcctgcatatgaatctaggacaaagtttgaaattgagcattaggctattataagtgcaactccttctcccccacagtagaccttccccctgccctctaccccagctcccttaatgcctttttctaggaataattgatcattgaaacagcccagcccaggaagaaaagcctgcatactttgtgagctgtgactttcccatgattacatacctgtttttttgttcagttaaaagtgttaatcaaatgcctgcttgtatttggtgctaaaccaggcacagtccagttatgagttctgtgtcaagtggtttgtccttcaggaagggcaataaagcaagaagataaaggatcctacagcaaggagaccagtgacatatggagctaaaaaagaggaaggaaaagtacttataacacagaaaaatcaagaaagaatttatgaagggttgaagatctgtaagaattagatcagagattacaaactcgaatgtttagagaggaagcagggaataacttcatgagtcattcaggctggtgtggtgctatagggagtggtggtgactggggtaaactggagaaagcttgtctcccccaaaggggtggccactaccccggcaaatttaatgttactccctgggaacatagacccaaagggaccagatcttacacagatcttttatactatgagaatctagaaatctacttttcagtgaaatctgccaatttctgacaactaataaaagcaagccttatctcttagagcaagttaacatggtcattcactgtccttcacttatgccatcagggttaacacatgcgcgtgtaagcacacacacacaccacacaattacacagttattagttcacaacctcctacttagatgttaggaatggattcaagcaccccaggctgacagaagaaagtgctggacatggccaggcacggtggctcacgcctgtaatcccagaactttgggaggctgaggcgggcggatcacgaggtcaggagatcgagaccactgtgaaaccccgtctctattaaaaatacaaaaaattagccgagcatggtggtgggcgcctgtagtcccagctacttgggaggctgaggcaggagaatggcatgaacccgggaagcggagcttgcagtgagctgagatcgcgccactgcactccagcctaggtgacagagcgagactccatctcaaaaaaaaaaaaaaccaaaaaacaaaaaacggtgctggacatgaacaagaaactcaagtggttcacagagagctaggctgttgggtgcatgagaagtattatgggaaatctatctagaaagcaggtcagaggatcttgagtgccagacgggatgtttaaaattatcctgttagaatggagagctgataaaggtttttgagcagggagtggatttaccagatagaacaataatctggactaatctaagagacatgtttgatcaaagagagccacgcactatgctaccatatgacatactactgtactgaatgttttccataaactatgcttctcaccctaacaaaccaaggtagaggtaggtattgttaattatcttcatttgacgcctgaggaaattgagtctaatgggagtcccctaggatcatacagctagagagggagggaccagaatttgagtctagggacatttgattctaaggcctggatagttggcccctctggtgcccagatttaaaagagggagagagaatgagagaaaaatctattcttttttaaaaatcctagtactctatcttcctgtaacttcacaccagatactcaaagatttgtggacaaggatggagccttcaactcaaccaggacaacttgatattaagaagcaatttgatgtaggctgggtgtggtggctcatgcctgtaatcccagcactttgggaggcctatgtagtagggaaaacacctgctgtaggaagggtatgatcaggatgattctactcggaaacagcgtgtgatcgtcctgaaaatgcagtatttcagtgcactgtctgccttcctggagggcaagaggaaattaacctggacattcactgtctatcactaaaaatgagatgactttaagtttgccgagtctttcaaggttgtgacccgtggttctttattcctatagaagaacgtggaatcttttgccccccaaaagaggtctgttgtattatttatgctctggcctgtggtaatagcaattttaaaataaaaatatgtctaatgtgtgtgacatgtcatccttacctatttggatgcttggcctgtgcttttctaagggtttaagagccacttcaattctagaatttcttaattctctgaaaatttgctcatgtgtgggatgcttatattaataagtaatagtatcttcctaataactttgtcataatcttattttttttttttaatgtgtgacctaagtattacctttgtttgtcccatgagtgaacgggtcttcaaaaaggttacttctcttgccctgtgctacactacatctgcccttcattctgaagcagacactggttcacatggcttggacaagagtgagcagatgtgggggacagcaggaaagaatacaagaaatcagggctgtcctggaatatgtgggacacctggtagccatgccatgccattttcccagcagataagcaaagaggaagaataattctgtggcacatagaaaatgtgaaattatgctcaccacgtatgtctgtaggttgattgtgctggttttgttgtgaatcttacctgtactccctcaagaatgtgaacacatcagtccccttcagtgcaaagccctagcctagaaacttaattttacaggaggaaatttcttaggacttgatcacaaaggttaggaaaatgatggggagttttgctgagcttaaaactgacttggggccgggtgcggtggctcatgcctgtaatcccagcactttgggaggccgaggggggtggatcactgaagtcaggacttcaagaccagcctggccaatgtggttgataccccatctctactaaaaatgcaaaaattagctggacgtggtggcaggcacctgtagttccagttactcgggaggctgaggcaggagaatcacttgaacctgggaggccgaggttgcagtgagccgatattgcgccactgcactccagcctgggtgacagagcaagactctatctcaaaacaaaacaaaaacctgactttgtactggtttccttatccttttaggggagaagaggcattgattttactcatatttgatgtttccctgattataaaagacgtagtttatagtgtgttgttttaggaagtcaaggtcttggtatggaaggcagtgactctggatggtcataattaaaatccagtgttgccatccaaatgacaatgtgcttttgcaggcaactctggctatcatggttgctttaggcaacctgcggtttacccactgtgtactgactacaggccatagcccgagggtggaggaaaaaggcaatatccagctactctcagaggtttctccaccctggatgagcaaacaaccctctcccctttcaacaaacacagtacctgtaaagacagggctgactcatacgatggcttttgagaatgaaatataagtgatatctgaaccctaaggtgatatattaaacaaagagtgttctccgctcttccaggaaccatgacttccaaaaacaaacaaacaaaaaaacaaaacaaaaaaagaaaaccgagctcactccattttgcatgaataaaatttctaggtcaaagtcaaaggaattggtaacactgacagtttggttgacgcagaaagtcaaatagcttcctccttaagaggctctgggaaatgaagtggcctggcccatcagagctagaaatgaccctgcaagtgagcatttatttccttgtcaggccagtttggcttgcaagaaatgcacctgtgaaaaccaatgccaggttttggtaaactggtcctaaaagttactgagctataatagattcctggggcatacaaaagtgctgtgattccaagtttgatttttaaaaatacattgaagggtctgtatgaaatggaatataaataaagatggctttgaatgctaatgtctaaagcaaacaaacagttctttttagctgtgctggcccatggcttttaaaaatgtggctagcatgtgaacccccaatgtgtcccaggcacttttagacagtggcaaaagcaggttccttcttttgaagaattttctgcgactgcatgtgttcagagcaacacagtaagcacccagtatatatttgtggaacagagaaagctgttaattctctctgggaacatcagaaggacttcctggggctaaggtgacctctgactcagattcaggtttgacagtaggagagtgtcacctgacaaagaagggggattagcaacttttatgctatgtgtgctaacctgccttctaacttagatttttatatgaaatatattttcctgcttccttgctcctctctgttcagtcttatccctgcttctatatcctctgattaaaggctttaaactttccttctcttctcaccccgtgactcattcagctgtcagacacttcctaagcatctgctctccaggcttccttgctcctggggaaagcattgtgctaaatgtgaaattcctgcagatttccttagtcattctccatcaggatcaagaaatcaccaagtcctgcttgttactttcacattcttcattcaaaatacagtgctgaaaaacaggaagtattttatcaattaatgttctgtggttgcaagcaacagacactggctaactgaaggaagaaaaggagttcactgaaggggtgtcagggtgtggtggatggagtgatagccccccaaagatgtccccctctgaatccctgaaaactgtgaatatgttacttgacatggcaaaagggactttgcagatgggattaggatcttgaaatcgggagagtgttcttgactattcaggtagaaccaatgtaatacaagggtccttataataagggatgcaggagggccagagtcagagaagacgatgtgatgactgaagcagacatcactgagacaggaatttgaagtcactgctggctttgaagatagaggaaggggccaaagccaaggaaggcagatggcctttagtagccagaaaaaggcatggaatgaagcctcccttagagcctccagaaggaacagagccctccaacccctaggttttaggatttttgaaatccagaactatgagagaataaattcgtgtgtgtatacgtgtgcttgtgtgcatgtgtttcaattgcagtgaaattcactgaataaaagcaaccattttaaagcaaacaattcagcggcatttagtacattcacagtactatgcaaacactctatctaggaccaaaacattttcatcagcccagaaagaaactccatacatactaggcattcgctccccatccctttgtcccacctcccccagataaccaccaatctgtgttctttcatactacggatatttcatagaaatccaatcttatgtgacttttgcgtcttctggcttcttttgcttggcaaatattttaaagttcacccatgttgtagcatgtgccagtacctcattccttttatggctgaataatattccattgtatataaataccacaataactttagctattcatcaactgatagatatttgggctgtttctacattttggctattgtgaatagtgctgctatgaacatgtgagtatagatactaatatgagttcctgctttcagtattgggggtatatatgcttagaagtggaattgctgggtcatgtggtaattctatgtttaactttttgagaaactgccaaactattttccataacagctgaaccattttacattcccaccaaataactggaatgcataaggtttccaattctccacatcctcatcaacacttgttcttttcttttcttttttttttaagtatagctatccaaatgataacaggagctagaaagaaattatttagtcagatagtgaaggtaagagagtccttagtaagattttcctttaataaaaagcagcccccaaatcatttattttctattaaaaaaaaaaaaaaaaccagcctgtaaaatcgagctgcagacatataggtaagcaagttggaagcttgcacgggtgaatgcctgcagctgtgccaataggaaagtgctacctgggggaccaggcgtgttcaacatggaggttccatcttcctttttcggtcaactacgggtaccgtaaaggaacaggcaacatggcgctggccaggtagagaacctatctgcataataaaaggttagggtggggtggccagcttcttcacgcactatgtaaatgacacacctggtccaaccaatttttgggccctatgtaaatcagacaccgccgcctcaagctcatctgtgcactttgccacggactagaaggcccacttggccgcccctctgtgtgcaggagagagagctgttctctttctttcgcctattaagcctctgctcttaaacttacttcttgagtgtccgtgtccttgattcccttggtgtgggacaacaaacctcgggtatttaccccagacaactatgccactttattagtgggagtgaagtagcacctcactctgaattgtattttcatttctctaatgactaatgatgtcaagcattttttcatatgcttgttgactatatatctttattgaggaaatttccattttttgaccttttttaaaaaattgggctggttatctttttgttgttgtgagagatctttatatagtatggatatgtatgaaaaaagagctctttatatattttggatgctagacccctaattggtgctcttttaagccactgagtttgtggtaatttgttataaccaatttgtgggaaggatgctctggggttctggatgccaggggtaagtgatgtatctgttccagtttctttcaattcttgtgtcctgatttcagaggggagcgcggctgttgtagcctggggagtgtttggcgaacactcaggtcagaacaaggcaagccacttgattgttagcaccactaagactgcctggaaaataaatagaaatactgttacagacagaagggcaaacattctgggaaggcaaaaacaataatacattacaggcataagaaggtaatactaaataataataaatgaaatctaacaacataaaggtctaaaaacctcccgcagcccaagagggaattctggaattataaatgaggaagatgtagcaggggacaagcaccaataaaaacatttaggggatttattggatagacgtcacaggcaatattagtagaggtatactatctgagaaaagggaggtgagaatcctgtgctgctctgtgctggtcataccacactttaggtgaggaattccactttgtgctccatacctacagaggcatataggcaaagcaggtcacattcagagatgagagccaggaggctggaatcatgccattggagtaatggtcagagaaatggtcacaagggtgttgggggaagtccagttatggggagctacccaggaaaagcatggtaaagaaaggtaaggtttgttatgcagctttaagttgtgccttcttcattgataagagactatagtgagtcatccttctcttcctggtaccgagagggagacacccttacaaatggagattttctttgtagatataaatttcccttacaaaaggaaacttcaactctgtgtttggaacttctgtgtctgtagtttctcaaaataatcagctcaaaataattcttatgcctaaaaggaatattttgggatgggatattctggtctcctatggtcatattttggggtggcatattctggtctcatacgcactcttccctctttaagattctgtgatccctctgtcagaggcgtgtgaaccagaacaactccatcttgaataggagctgggtgaaatgaggctgaaacctactgggctgcatttccagatggttcggcattctaagtcacagaatgagataggagattggcacaagatacaggtcataaagaccttgctgataaaacaagttgcagtaaagaagccggctaaatcccaccaaaaccaagatagccatgagtgacctctgattgtcctcatggctacactcccaccggctccatgacagtttacaaatgccatggcaacatcaggaagttaccctatatggtctgaaaaggggaggcatggataactcaccccttatttagtatataatcaagaaataaccataaaaattggcaaccagcagcccttgagtctgctctgtctatggagtagccattctttcattcctttactttcttaataaacttgctttcactttactctacggactcaccctgaattctttcttgcatgagatccaagaaccctttcctggggtctggatctggaccactttcctgtaacacctccctgccccttggcatcatctgagtttgggcttgctggctcttcctgctaccacttcagctgaaatattggttggggtggtggggggtggggggtaagtcacaggactggagacaggatgggttgggagggtagaggctagggatgtttattctctggtgaaaggaaaggcaagctagtggtatagaacagtggtctccaaactttgattgcacaccccatcagtaaaataatgtttgcatatgtactcttcaaattggggattattactttaaaatcataagcatatactattttcagatgcaatatactatcaaggtcatcattaaagatgactataagcctatattccaaataatctttattatcattttgaactgctagaccacctttgaatggtagaggtagattcttaatgttacctttcgcagtttcttggcactgtttaggcagtaaactgaatgggaatgaacaagtgagtccactgctgtctactgctctgagttgcagaattttatttttgcccttgtctcagtattccttttcacacattctctgttgggaggtcatctgacagaccaagtgaggttagctgtgtttgttgagattttatatttttagacaaatataacctaaaattcagatactttattcctgcagatcaatggagcatcgtgtttgtcccttgggtgacatcttttgggtccactagtggaggagtaggaccttgctactccagcagtggtcctccgagctgaggcaatggctttggctgggggtgtgttagaaatgctgacttgcagaccacaccccagatgtactgagtcagactctgcatttttaacaagatccccaggtggtatgcacagaaaagttttagaaacattagtttaggggctgatcaaggattttttggagtgggggagtcggttagagggctgaaagcttggagaagagatgatggggatctcatctcaagcttgtagacacaggagttaggctgttcagtgtctctcacacatacactcagaagtaggtcagtaaagagtcaaacagaaatcatctgaaaagagttttaaaaagtcccaacctcttaatcaaggagaacataaaacgagtaaaattccaaacagttttactggaacttcatgaacttccagagaaatcctttgttttggaatctagagtcagaggagtccagattccttgaattggggttttctgttgccagagcttttccacatttcccagctgcttgctatttatctgcctttttagctgaagctctcatgacctcgggtgtaaatttaatgctttcttgtcttccttgattgttttcttctctgttcccagccccttatatccgaactcagtctttaatgtctggcttgcatttcctgatcagattcacaaaacaaagactgcgttatctcatttgttgggggagaattagcccaattagagatagggtgaagttcttgtgcctatcccaagacctctgagctttgcaccagtgagtgctgctgggaagtgtctgagcactgccttctgttatatttgcagtttgaccgacaatttcagatgctagcactgcattcatcactggggatcttgatttaacatagctgggtacaggtgtgaaaatcaagccttgccagtcagagtgaggtttccattaatcagtcaatggtttttgagtgtctcctgaagacttcccagttccctgagcagagaaagatgagcaagaccaggcccttgactttacagagctcaatgtcttgtggcaaatacagatatacagacctatgttaggcaagcacagatacgtaggcaacaacaggaggtgttgcacaatgtatctgtgattgcctgctatcagtctgtatatcagaccgatgacaggaggtgtcaagtcatatgactggaacaaatgattaaatcttgtggcagctgggatgagggagtgaagggggttgtgtttgaaaagttcagaaatatttatctggtggactggagagaagtgaaaaaaattcagatagatataaccacttatgcaaaatgggcatgcaaattgtcgttgagtgatggcaaactgtaagttcaaagtaatggacaagatctcaggggaggcaggtggacagcagttaaggagattggactctatcctggcggtcagtgtttctcaagcagggtttacctgcctggtggaaagcagtaggggagggggagaggttggtaaagttgtagaggatagggatgaaggtggaaggctagtgagttacaccacagaaaggaaagcacaccactgagggcccactgaagttgtgaacttataactgagtagcagcacaaacctaaaatattctgcagttcctttggggttttcttgtgccaagtgggatcaatccaggattggaagcgttcttgccttgggtggacaaatactgggaggtgaaagtaaagtgttgctgaaagggcattacaatgataggacacatgatccaggttgtggatgaaagaaaatgaaaatggagaaaaaataatttgtgaaacaatggaggctccaaggagcccagggtgtttatgagcttcagggagctggattgagctgaagttgtgattgaagagaagggtgttacaatttaagagttgagaataggaagcttcctgttgatgtcacggttctgaggttccagatttttcatgcacctcttcctctgtgaatcaagcttggcccgtcctccctgtatttatttaaggtggcagaggagagccaccaacagatgaagttggatgatgagagatgatgagaagcatccacaggaatgtggactggatgattgtttcttctgggcattcagctaccctgggtcctaaggattctgtgactgggccaaacttgagatacaacttcagtgacctgccttgtttatcaagcatttacttcctaaaaggatccgattggggtaattttaccaatgtccgaaccagagtcttttgcaccaaaattcccttgaaagttgacctcccttatgtccggccactgtgtagttgtctcggacttggatctgaatccagggcaatcatgtgtggcagaaaacatgtcatagcagtttggatgtgccaggtacattgactcacgttatctttacaaccacatgatgtaggtactatggttatcttcattttacatatgaggaaaccagggcacagagaggttagaagatttgcccatagctaggaaatggtggtgccaggaggtctggctatggactctatgctgtcaacctgttagctccctctgaaaagaactgattccaaacataattcttacaagatggcagcaagcttcatggtttcctcttgcagcctgtctcagcctagcacataactaaggtttcatgtggtcccggtaaatgggactccttccactcccacatctccctgcccgtaaacacaccctgcaaaaagtctatgagaactgcagatagatctagttatctttagggtgaccaagtcatttataattcaaactgagatagtctgagtaaaggtgggtactattgtgtgtgtgtgtgtgtgtgtgtgtgtgtgtgtgtgcctttattgtatctttaagcattgaaacttctgaagaaatcaatgggcagtgaggcagctgctttttccttcacttctttgggttactagagcaactcgtcagtagattcttttaaaagattaccttttgtattacttgcatgcacatgtattactgaggcatgcactggtacaatacagacttctctcatcaggtgcaactagtctagcatccaaacatcatgcacaacaccttggtggcagcagcacactgtgcacactcccatcgtggccctgctcatttgtgtatgatatttggagcatctggaggagtacgaatagtattgggaagaggtgtgaggaggaaacagtgtgagtgcctggctgagaggaggtcagccgaagtgagcagggcaagcctgaacatgtcattggtgcaaacccaagcttcactgatattctttaataggaacatctggtggaacccgatgatggggtcttcatctaccttaagctcacccacaaccatgctgatgatgcagctatctggtgtgggctaattgtcctgtgcctgtgatgctgtactggattttctggaacagaaggctagacaacttctccacaatggcagctttcccctgtcattgctgtccttcccacctaaggcatgacgcgtcaatgtaaattgtacctattcgggttgtatctttatcaaataactggtagtaatgttgaatgaagctggattcagtttgcttccaaatcagcttatctcccattctggagcatcacctggccttgcagagacccaaggggctggcactatggcggcagtggcagcaacaacccagtgtggtttgtgacccaagtgggcactattgagagttatgcttgcataatgggcacaaactaggactgttctagacaaaccaggacatacagtcaccctggttatgtgctatatattaaatgagagtggaaggaagctacaagtgggccgggaatatttccaacccacctaaaaattgccagaagaaggcaaaaattcccaaaaccctggctcataataggttcttaatagattttgaatgaataaatgactagattcaagtgtgctcccaagaggaatgtggagaaggatagaaatgaatcaactagcaaggggattggtggcaaggaaggggcatcactggaaagtgtaaaaactcactcttacaatagcagtaatttctgtccaagcacttcacaattgaacaaattaggacttgccattgacttaaataaatgagtcagcagacctaagggaaacgaaatcgatcccatttttgcatcttggtgagactgtcgttgaaatgtctatatggggggaaatgtagagtctatttggcatgcctatagaaagtaaccttaaatggctgaaggaagaacaatgggtctgtgaaaagcccaagaccagggacttgcagacatcaagatttcctttgaatttgcaaagttaacatcactttataaaactggagcaactagattttggggaaattaaaagaatgtgcctcaaggtcattgactgatcatgaaaccagaaccagtatcagctcggacaagcagctggtctctggttccaaatctttgtctattgttggggaagggcaggacttgaggcaaccccttccctacacatacgcgccctgcagagagcatttattcccagtagcctgtgggtatgggtgtttgttggcaatgtcttctcatctgaagacagttgtcaactccacctgctctgctccttcacattcagttgtgcccagccttagagtgaaggccccttatttgttcccagtgcctgagggccagtcacatgctccagtattccaactttataggtgtgacatagggtgggactgatgccctagatctcagagatcctgggtagagacatcctcatcccatctcgggcagctcactgccagcctcccatggctaaatggcctggagaatagagcagaggcagtggcccagcagttgcccagatgtcatagccagcatcaccttatagtccgagataagggccacagcattggttaggcccacaagtctgtgttttggatgcccatcaagtggaaggccttatcattaatgaagactggatctcagtattctaggtgcacttacagtctctgcccctcttacccagctggttcattcccttttccagtaatgaatcctctttgtatttgaagcctacctcttcatagggacaaaatttgtgcggaaatgaggtttcaaccaaactacaatatgggaagtatgaggttaaggttttaagtgggataaatgtttcaaggacagtctctaaaccaaggctatgaaaagatttgcatgaaaatattttctgtatcttcattcaattttttaaattttatgagttttaagacatatggtgctcatctatatctcaaggttgtagcaacctgtgactaaacatgtccttttctagttccagattgatatttttcaatattgtatctattccaatagttgactcatattggaagcacaatatcaaacaagctctaaacaagtttttcaagcaatataaaactgtcattggccctagatataatagagttttctagagttatgtgagagactgaaatcacagggccactgatgcagggcaggcccaatgatcctcagataaaaggcaagcaagacttaatcttttagtttgtttgtttttgttttgtttgagacggagtctcactccatcaccaggctggagtgtaatggcacgatctcggctcactacaacctccgcataccaggttcaagcgattctcctgcctcagccttctgagtagctgggactacgggtgtgtgccaccacgcccagctaatttttgtatttttttagtagagacggagtttcaccatttcaccatgttggctaggatggtctcgatctcttgacctcgtgatctgcccgcctcagcctcccaaggtgctagtattacaggcatgagccaccgcgcctggccaagacttaatcttgttgccatgatcattcatggtttcactccacgacccttgacctattgtctgtgggttctgatgatgagtatcttcatactgcagtaatactaactcttaaatggtgagataggagtatttatgatttctttgttcacttccttaaaaaaaaacatgactactgggagaagaagttttgaggccatttgatgggaagagcaattccaaagtacctcctgcaactccttctgtcatcctccttctcgattctacagagccctcattgaaagtggtcagtaaacaggaagattctcagagtgtttaatctgcagatggggaatatcagaagtttaaggaggctgtgctaaaatgattctccatgtgttgatggtaaactgtctcttgaaagtctctttggtgaacagaagtcatgtctcactgatgacagtgctagagggagggctgccccacccttgtaggatgatcagatgtgtttgtttttgaaagcatcttgacctgaatccactaagacttgagtttatgagacccacttgttaaatatcgatatagatggaggataaagccagttctgagagctgaactctattttattgttatactaaccaaattggtaaagctctgaactttcatttaggggaacataggattgatctggaattcattctttagaatgtacagtatgtaagaaaatacagggcagtaacttactctcctttcccccaaagcagtaaattcaggtgtccaagctcatttagcttggttgtaagtaaaatgaattcttgagtaattttaatttgggatgagagacttttttccccacaaactcttctgtggatctgcatattagcaagcacctctggtgtctagcctaaagcccttaatttttaattgcttgcagaaaataggagtataactgtttcaaagggtgtttccatgtgttttattagatttctgtgcatgcacatactactacctcatggaaaatgctagaggttagcaaggaagaggcataaatttctgagctatttgctgataaggtggggttcaaatatttgacattttcaggttagcatatgaggctcatattttcataatgtcgtatgtcatttaccctggaaaatatttgctgtgtttctgataacactcataaattgggaaaggtgtatagcattctttttttttttaaccttttaaccgtttgttaccaagtcattgctggatgaatcatggaacatagagcatctccgtaaaatttgaggaaatgagtataggttttcagacctaaaataataaattactgactgggcaacttaattgtgataatgatgtaaggaatgtggagggaaaggtgggaaacattaacctcttggccatatctaatcattagagttccctgacaccatgttaacccattttttatgaagctacacaaatgcatcaactgaaactcttcagtggtagtattgttatatagcataagatgaagatgttactcttgaaataggcttttcctcaaaaaagtcactctatcttcttagaaaaacaaaactataaacactatgctttcgattttttagatgggatgtaaaaatttagatgtttttaaaaattattcagtattcggtacactatcatcagctaaaaataaaaatatgtggatttatcaagagctcaagtcataactatctttatttttgccctatccgatcactggacaaacagcaaattaccctctctttcaacgtctttctcttctccctgaccctccctcaccatatccctcaatctctctcccttaacaagccatgatattgaactgaaaatccataggaatatagttctatgattagcagtatatttatgtctcttaatttaaaaacatgcaaccatagaagattttatatgttaatattataaacaataataaatgctcaccatggttactaataaattcattgcaacaacatttcagcaccatggatagcaccagcggtgcagcttctacccccttctcctgaaacccctttttggtcatgccacctctggtctggtgaggaggtttagggatggctgtgttgacacaaaatggcagttcttatacttgtcttcttgttaaaatcacatgaagaacttcaaatatccccaagttcagcccccgacaactcaatcaattaaatcagaatatctgaggtgggtcttaggcactaatactttttaaaggttttcagacttaaaaccaatagaaaatggtaatttgtaggagatgagatggatttacgtctaaaatagaacttgtcaaccttaactgcctttaagaattacccagcttgtttaaaaacaaaatcattgtctgggcctgtcttcagacattataactcaattggcctgaaataggagaccgatatcagtagtttaaaaaaaatcttcaagtaatttttaatttacaagcgttaataaacatttactatcaagtaagacctggaagtaaatttttttcatgtggaaagtttaggtaaatttgatatctcaataagaacctttcattctagaaggaagtaatgtgtaatgtctagttttctttcttttttttgagatggagtttcactcttgttgcccaggctggagtgcagtggcgcgatctcagctcactgcaacgtccgccttccaggttcaagctgttctcctgcctccgcttctgagtagctgggattacaggcatgtgccaccatgctcggctaataatgtctagttttcatgacattggagttgaaattgagaaacttgtattctagccagatatgaagtcaaatggggccataccagctaccttccgctccttgtctgggtcaaagccccaactctggaaactgagtaagggtatgaagcgtgaaatcattatcttgtgtctccagctgtacttagcaatttcaaactatcctctagaaaagtttccttggcaaccttatttacttcccccctacagggtagacatctggctgatttactcttctacagaaagttgggtgtgaggcagctaacagttagtgctcgccaagttttcccacttcccttgcacttattttagagccatgtgactccaaggagagagtgtcatctgggacaaggcacataagactcccctgtttctcttcttttgttgtagcaatgttggaggccacatgtcacagatagcatagctgcagcatggaggaaggttgcctgcctgactgagtgcaaataagcaagaaaaatattatattaagctactgagattccagagcttgcctgatgtgatggctactgttaattatacctaatgagcctctcaaagatgaacaaatattcctgacagtgtcagttgatgagaatccttgtttctacccattttaagtgaaaaaagaaatgtatttacattaatcctcatattcctacacatttaaaatgcaaggagaaacagtatatgtaatatatgaatttcaagttgcagaaatattttttattccattggtcatcattagctataaactactgtctgtatttaatcacccctccagacccatggcagtccgggaaggaaggaaacacaaatcttgattgcatttgaaattaccacacaaacaacttctttaattttgaagtaaaccactgaaagtaatgatctctctagactttactttgcctttttcttcacacttgaaataccgtcaaggtgcagcttgattgtcctgttgctgagactgctttcagtgtcatgctcttgcttatattcagtggcagcttgcctcactgtgtttcctgtaggtcctctctcttttttgcttaattttaattttagagacaggctcttgctatgttgcccaggctggtcttgaactcctggcctcaagcgatcctttctcctcaacttcccacagtactggaattacagatgcatggcatgatacccatatctttttttaaacataaattttgttgtggctatttgaggtttacaaagtgaggttatggggtgtatagagatacatagatacttgtagatacatatgaataatacaatggttactctttttctaagctccttatatgccaccttctctcctgaccctcttcttctctaaggtggagttagtcacatgccaacactaaagtttcccccaacctctggtctaataaccacagagaagcagacagaagttataaaaacaaagggtagtgcttaagcagtacaaaagtctaattgcgtttggccactgtctttgaactttgtgatgattcttgacccttgtctagcatcctagtccatggttagagattttggtgcaagatttcccctcagtgtattgctcatcctttgccttccctccttccactgtcacaccatcatgaagcctgcagatgccctggagaaaattagccagcttatctcttgagcgcagatcagttgtgtcctagtggaagctgaaacctagatttttatttatttatttatttattatttttaaatttttatttatttatttttttgagacggaatgtcactttgttgcccaggctggagtgcagtggtgcagtctcggctcactgcaacctccgcctcctgggttcaagcgattctcctgcctcagcttcctgagtagctgggattacaggtgcctgccaccatgtctggctaatttttgtatttttagtagagacagggtttcactatgttggccaggctggtctcaaactcctgacctcgggtgatccacctgcctcagcctcccagagtgttaggattacacgcgtgagccaccgcaccctgcctgaaacctagatctttacttttaatgctcccctctcctgcaacccaacatctttgatgcagaaaaattaacagattattctctgaaagcattcaaggattgataaaagtaactttcaagcagagtattaaagtgacctataatctcattttagctgaggtaatatcactaaatatttagcgtcgacagtatattgttggcttattagtcatagtttatttctgcaaatcctaatcagctagttctattgacctgtgctatctacctgtaatattatctccatgaagccacaatggaacatttagtaaattattgctataactcattaaactataaccccaaagcattcagagcatcctaattggatctggcctgacctgatttaaaaatgtacagagtccccaggaggcacacagacaccaagtttttgcaagattttcaaggcataggatgatgtttaggctcattattgcttaatatatttaatttctttgatagacttgattaccttggctaattcaaactaatttgttgtatttgttgctagttaattttagtttctaattgcagattgtgagtctgacataaatatttttaaaaactggatcacaggtcacagatcagtttattacacattgaaacaaagcttctcttctaaaataccttttggggccaatttggaatttgtgtctttttatgtattctataaaactatgatggatatatgatatttcctttcattttatgaaagaaaggagaaaaaagaaatgtctaaaggtaggactgacccaagaaaggaagaatggaagatttgtctggataagtttttggatattatttctcagtctacataattccattgatgcattttataattcttcttccctacgtgttaggtctctgtttctttccttagatcttttcttggaaaacacttttgttgtcactgtgattgcccttcttttagttccttataactcacaggccaaaaaatcatccactgtcaataaagacaaacttgtaatttgcaagattacttgacttttcttcttaacctgggaatttttcatgggcctttctattcaccctgttcagagttctccccaaatccttggtctcagccaccactctctttcagttgctcctcaattgaaatcgctagaaaccaacatttacacaatgtaaatacactgaagtgaaaacacagattctcttatgagcagccagttggtggaaaaaaaaagatgaaattaattttagtaatatatgtttatttaacccaatatatcaaaaaaattatcatttcaacatacacttaatataaaaattaatgagatattttacactcttaaaaataataagtccttaaatgcctgtgtattcacagcacttaacctttttttttttttttgaaggcagaggtttgctcttgttgcccaggctggagtcaagcgattctcctgcctcagcctctcgagtagctggtattacaggcatatgccaccaagcttggctaattttgtatttttagtagagacagggtttctccatgttggtcaggctggtcttgaactcctgacctcatgtgatctgcccgcctcggcttcccaaagcacttccctttttaatgataagtttttgaaatctggtgtgtatttacagtacttcccaaaccaaactagccacatttcaagtgctcaacagccacatgtggttagtaggcaccatattggatgacatagtcttagagcattgatttaagatattcttccatacactacaaataagaccctcttaaatcccacttatcccaaaatatcttcaagatttcctctgtcaaaatttaactccaacccctccacagtacttagaaaaattcctcttattgagaacttatctcagccttacttgtgttcaaatatttatatatttatctgtctcagagattatgaactcatagaaggtacatattatcctttgctcatctttgaacaatagcataagagtgtggaggaaaattggattttgacagataactgactcaggtttaaatgctactactagcaccatgcagttgtggtagctatacaattctagcccattttttgaacctcagttttctcatctataaaataatacctctatcatagagtacatgagcattaagtaaggtatgcctagcacttagttgggtctcagtaaataacttattatattgaatgtaaaagggcaatttactctattaaatatgcacatagattataagttgtactcttatttcagaaacattaaaatttgagagctcagatatttccagtgggaatgtaaaatgatacatcgactttagaaaacactgtggtaattccacaaaaggttaaacatggagctaccatacgacccagcaaggttactcctaggtatacacctaaagaattgaaacatatatccacacaaaacttgtacatgaatgtgcatagcagcattatccatagtagccaaagagtggaaacaacccaaatgtctataatctgatgaaaaaataaacaaaatgtgtggaatagccataatagaatattatttggcaataaaaaatgaagtactgatgcacgctaccagataaataaacctaaaaaaattatgtgaataaaggaagccagttatgcatgcaaaaaacacatatattgcatgattccacatatgaaatgcccagaataggcaaatctaaagagacaaagtagattagtgttgcctgggctgcagtggtgggggcaaggagtcactgctaatgggtaaaaagtttcttttggggtttctttctttaaaacatgataagatgttctaaaatgagattgtggtgatgcttgcacaactcagtaaatatattaaaaaccattgaattgtacacattaaatgggtaaacttgatagtatgttgattatatttcaataaagctgttaaaattgggggaaatggtgttagaattaagttaatatatatttatttgtttagtttaaagttaacttcctccaacaaacaataatgacaaaaattaatcgaaatacaattcttggtcctaaaatgtgtggacattttcgcttccatgatttttgcgtggtggctcatgcctgtaatcccagcactttgggaggccgaggcaagcggatcacgaggtcaagagttcgagatcagactgaccaacacagtgaaaccccgtctctactaaaaatacaaaaattagccagacatggtggcacacgcctgtaatcccagctgttggggaggctgaggcaggagaattgcttgaaactggaaggcagaggttgcagtgagccaagattgtgccacagcactcctgcctgggtgaaagagcgaaactccgtcttaaaaaaaaaaaaaagaaagaaaggaaaagaaaaacatatccctactaccctcctccaagaggagatggctctctctttcactttacaggggcagacacagcccctgaaatattgaacccgggggagaaaccaaagcccccacatagcctgggctctttcttctttccaccttaattcctccctggagcagcccctgttggtggaactcactataccgagtggtctcctgtggagttgtctccctctgaccgttttgtaagctcctggggagcaggagctgtgtccatcttgttcacagccatttcacagttcccaacacatagtaggtcctcgggaaacttgttgggcaggacagttctggcccctccagcactggagaggagtagctgcagcacatccagcagtattttccttcttgagttaccaagtttggccaaatgccaatgatctctctgcctatactgctgtgctaataggactgcatccccctgccccccttgctagttaccatgtcacaaccaggatcaagggaagagcatgcttgaaacatatattaatagcaagagtaagttcaacacaccttctgcggggagggaacctttttttcccaaccccatttaaaaaaaaaaaaggcaaaagagattcatgaggctggagattcagtttaaaatgcatctggggtggcggagctctttaacagaataagagaaggcacatatgggacttgggtttctcatcaaagctgggctaaatagaaagctctttctgcctgggcattgaaaaacttgtctgatttggagatccacctgaaaatatcgagtagcagagacacctgctgatctcagacgtggcatgacagtctctttccaaattgcatcccattaggggtttctgaagtgcgactttactgtctcaattgtatctttgctccctccacaagaccagctgaagggggtttgctgaaggcagccccatctcctctgcagcctgctcctcagctctgtggttgatgagcaggactaacccagggagtgcccccctgtaaattccgagagacttcaccatccctgtaccaccttgtgcacccaggaaagcccagtcagcctttcctcctcaggttaactgttgtgaggggctctgccgtccccaccagcagattccatgccacagatttgccagatccgaatttgcatttctgaatcaaaatttggatttaacttgtatacttttttacctgggtaacttttttaatagttaacattctttctttctttctttcttttttttttttttgagatggagtctctctctgtcacccaggctggagtgcagtggcatgatccctgctcactgcaacctccacctcctgggttcaaatgattctcctacctcagcctcccgagtagctgggattacaggcatgtgccaccacccctggctaattttgtatttttagtagagggagattctacattcccactggaaatatctgagcccccaaatttttggtttcaccatgttggccaagctggtcttgaactcctgacctcaagtgatccccccacctcggcctcacaaagtgctgggattacaggtatgagccactgcccctggccagttaacattctttaagcagtatttgagctatgctaggtgagccaggacctgctctgggagctgcaggtaaagtgataaacaagaaagactactctgtctcagggagcttaccacccaccccacctctttctttctagtcttccttcctcctcctcttcctccctacctctgtaaaacaaattatttagaatcttttgggccaaacataggcaagtcaataaatatcattttagaacaagatacggtgaacattatcacaaacttttgctggccataatggaatacttgtttttttgtttttgagacggagtctctctctgtcacccaggctggagtacagtggtgcaatcttggctcactgcaacctccgcctcctgggctcaagcgattctcctgtctcagcctcctgagtagctgggactacaggcgtgcaccaccacgcctggctaatttttgaatttttagtagagacggggttttgccatgttggccaggctggtcttgaactcctgacctcaggtgatccatccacctcggcctcccaaagtgctgggattacaggcgtgagccaccacacccagccggaatatctttaccctggaaaactgccccacaagcattttttttaaaacttgtggaagaaaatggtgactagttagaattaactgtaattatttgtagctctcatcttattttgcctgctatactgcatactgagaatgaattcaggattcaaattcactccaggatgatagttaaagttagttctttattggaagttcacagcagaggagactgataagggttagaatttacctaaagaggttatggctgtagagtatcttatattgatatgtcattaaaaaaccttggaacatgaatcatgttagtgaaaatttgcatttttgtgaacatggaaattgaaaattggagtaggtcaataatcttgcttcctaaagactaggtaaaatgtaaatatatgggagcaatacattttatattaagtgtacctctggatttgcataacagatttagatatataatgtatttctacttgctgatttgtttggcaggatcatctctaaataataaatatgcagtatgtttgagaacagatactgggcccaggcacatgacttgtgttatcagttagtacacatgaaggttattccaagggcagtatttttgggaaaatagagctttggggccctgggtatatggcaaatacaaataattattattatttttaattagcgtagcatttgagactattgaagttcactctcctgagattcaaattttggccacagttgaaaagcagagagatatactggtcagttagtttataaattaacaattccaggacccaaagtgagttatgttctgggatcataaaagacatttcataaaagggtgagggtagattaaaacttccaaatattacttaaaactctaggacttagagttgtattgtcattcctgttggtggttgtacaaacttataatatttagtggacatattgaagcctttcaaactcttctagctggatttatttatttgttctttaaagattaatttgaatattctcttgtcctgttgatgggagacaacactggcatatccactctgaagggcagtttggtgttgtgtatgaacatttcaaaagcacaggcaattccatgacttaagatctacctttaagaagcactcctggttgggtgcagtggctcacgcctataatccctgcactttgggaggctgaggcgggcagatcacttgaggccaggggtttgagaccagcttgaccaacatggcgagaccctgtttctactaaaaatacaaaaattagccaggcatggtggcacacgcctgtaatcccagctactcaggaggctgaggctcaagaattgcctgaacctgggaggcagaggttgcagtgagccaagactgcaccaccacactccagtctgggtgacagagtgagaccctgtctcagaaaaaaaaaaaaaaaaaaaaaaaaagaagcactcccacttgtggacaaggatttatgcttaactgggtttctcaacctcaacctcagcaccggtgatatttggggccagccagttctttgctttgagagactgtcctgtgcattgccagatgtttaacagcaaccctggcctccactcagtgccagttacccctctaagttgtggccagagtgtttctttgccagatagcatcccattgagaacaactgatgtatagtagtgtccactgtggcactttttttcttctgatttcagatgaactgtaagaagcctaaatgcccattatttggagcagactcattcaatagaaatacaatgttagccacatcagtaatttcatattttctaatcgttgcatttaaaaagtaaaaagtgctgggcacggtggctcacgcctctaatcccagcactttgagaggccaaggcagaaggatcactcgaggcagggagtttgagaccagcctggccaacatagtgaaatcccatctctactaagaatgcaaaaattaggcaggcatggcggcgcatgcctgtaatcccagctacttgggaggctgaggcacaagaatcacttgaacccaggaggcagaggttgcagtgagccgagattgtgccactgcactccagactgggcaacagagtgagactctgtctcaaaaataaagtttaaaaaaaggtaaaaagaaacaggtgaaattgatttaaatatattttatttgacccaatatatgaaacatattattgcttcaacatgtaatcaatataaaacattattaataaggcattttacattattttccccctagtattaagttttcaaaatctggtctgtattttacactctggcacatctcaattcataccagtctcattcaaatactcagtaaccacgtttagctggtggctactatactggacagcagagatttacaggaatggcattttaaaagaaatactttgattcagaagaaatactttcaagtactacatgtatacaaatgccatatagtagttgaaagtaataaaacagagaactacaacatggaaagcactcagaggcatactgttaagtgaaaacagcagcagaacaatatgcacagtaggaaacatgttaaaattattttgaaaaatgaaatgtatttgtattttcatagatgtgtatattcaccagtatatctgtgaatacgtatgtatgtaaatgaacagaatgagtcctggaagaacgcccctggactggaagcagggcaggtggccaaagaaggatttaattgtaatatcttaactttttttttttttaatagacagattcttgcttcgtcacccaggctggagtgcagtggtacaatctcagctcactgcaatctctgcctcttgggttcaagcgattctcacgcctcagcctcccaagtagctgggattacaggcacacaccaccatgcccagctaatatttgtatttttagtagagacagggttttgtcatattggccaggctggtcttgaactcctgacgtcaagtgatctgcccgcctccgcctcccaaagggaggactgggactccaagcatgagccaccatgcccagccataatattttaactttttaaataaaaagaaatgtattcatatataacttgtataataaatgcttttaaaaagtgagctcattaggtctagccatcctggtagtctctgggtatcaatggttctcatcctgggcagtgcctcagaaccaccagggaagcttttttaaagtatgcagcctgacactgcactccagcctgggcgacagagagatcccttgtctcttaaaaataagttttttttttttttttttaaattgtgctgcctggacttttctgcagatcaattgaatcaaaatctctggagacttccatcttaagctcttcagatgattccaaagtgtggccaggattgagaaccacatgtggagaaaggaatagactgtgtccttcaaacaattaccagtagactcccaaagagaatttgataaggatccggtggaaggtcctttgaggcatattatctggtgagagttttctgttgttgactaagggaagatccatattttaaagttaaaatagatcaaacgagctgagggatggagtcgacatctttttgcaaaaatggtggtgtaccagacaagacttcctaatccattgccatccaactttatgacaagtttagtcaagagagcttgtaaaagtagtgctggtcttctggataaactctgacaaacaaacatgtaatgcttcaagaccccaaattgcgctccataggaagttgtctaacagggagtccaaaaaaggattctagacttaaaaagttattctcttagattcttgggttcattgttaccatttgaaagcatgagattaactgtccttggtatttagaaagcaacacttcaattgaactgaaaggaaaaaaaaatcttgtttaaaaaaacagcagcccagtttctcctatttctatgttctgcttgaattcatggcaattacagtgttagtgccatctgaggtgaagccaacataattttcttttacatgataagccctatgaagaatcaggcatattttatacttgacctagggtcaatattggttcggaatgcagttctcttacatttctccatcattgacctctgtacttaaaaatgaaacaaatcagtgtttggcaagacttacagccattatctgtgttttcctaagctttgaaaataaccagaaattgcctgattcagtgaatgcttcattcatttgtcctggagtttaaagacccactctcttgtcaccatggaaacagattcagatcctaaggcaaaagattcagtacctccctcctaatgataatatacagcatgagctctgaagagaaaaatggatctgccttaggtttcattgttgagctgatggtgttccctggcttgatgaatctctttctcatttggttttagctcctgggtttacatttgctgtgcagcagtgcatggtgaggggttttgagcctttaatcccctgccactgaattacatttgtgtgaacaacacaaatgccagactggttttatacagactctaaagttgctggaaatttaataacgggtacctatgtttgctcccagaaattgagaaatctgatattgggatctaatgctggctggggctggaataaactaatgaagacctataggaggccccatgatctgaagatgatctattcaggaaaagaccacttacagtgagttggcttggaatgggacccagcatttcatagtaaatactagggatcagggtagaggatgacttaattggaatttcattttgaaaaataaaacaaaattttaaacataaagttatttgatcttacatgttcaaacttttaggttatcatatcaagaaggttgaaaatacaggctaaatcaagtatgaaacaagtattaatttttttgttgtaaattttccagcaaaattcagtaactaataggtgctttccagcccatgggacttttaccacgtatgaatagacccattttcaatcattgaaaccacttcctctttaccacatagattactgaatcagcctccctttttcatcacatagattactggatcagcctcccattttcatgttactttctacttcctaaaataaatcccctactctagcttggtggctctccttcatgtccctttcctgccccatacatgatcatttttttgggttctgtccctgtaagtgttctccaaataccctccttgctctcaatcctcattcctcatctacgttagctgttccatccctgttaagacgttgcagacgctactttctttctccccagactttccatagcactgagctgttctgctcaaacatgatcatacactgcttcctaactttatttaaatcacagatgattatatgctttgctgactcatataatttccatgagagaagggctggtatatcttcaggcctcgagtacaaaggcattcatgctacccatctgagtatcccattgttaagatgtgtgaaagtgattcctgagttttcttaatccgtattgtgaacctatcatattcctttcagactttgacacttcaaagaaagtcagtggtagattttttgggctttatccccaaaaagggagaaagtgaagtgaagcaaaagaggagagatttcctaagaccgtttttaataccttatttgactggtagaaactagatggccaggaaaagaggaaatggagattttgtgtgttgatgtagtaattagtcagctgaaggaaaatgtcatcaatttctagcttcctaggttttgcactaactaacaaaatttaccctcttagccatttttaagtgtataattcagtggcatcaagtgcatttacagtgttgtgaaaccatcactactgtccatttccagaaatttttttgtcattccaaggagcaactcattaaatccattaaataagaactctccattcccctcatataatatttgcccttttgtgtctggcttatttcatttagcaaatattttcaaggttcatccatactgtagcatctgtgagcatttccttcctttttaaggctggatgaaattctattgtatgtatataccacattgtgcttatctagtcatctgttaatggataaaaacaatgaaactatgaaaccctgacattacttgcatggcattttatagtggcttttctgattctcactcttcttcttttttaaaatatttcttatcctttattcggcctctaaagatggatttgttcatttgagggaacaaattagtttgattggtttgggaaggtattttgacccacagaatgggatagattaaaaccaggtgtgatagataaacttagccacacgccatccttatttcctggttcagccttgtaggggtctgtagaggtctagaggggacaatttaatgcattttaataggtacctggtgacaccttaattgtgaagcctgattcaattcctatataaaagccttttaaaaaattctgacctaagttagtgtttgtagtgaaaacactgggactgttcaaacatttgagaattatgattatggccaagagacttgtctgaagaggacggtcttatgtggtctacatttccatttagctagatgtcagctagaaaagtgaagcttaagaagtcaggaggaatgggtctattcttttgaaaaaagttaaggagacttttgtttggatgaaaatataaaggactcttttttttttccaccattcccttaacttggaggaaatagaaaataagtaactcctcatttaaggcataaggtgaggcattaggcattgtctttctgcaaagttctgtgctttggctactcaagatagaaaggaagctagctgaatccattgttgaagtagctgttggaaccagggtaaggtgatattaccttgaataaaattggtgaggaaagttaaaacatcctccctttaagacaggggagcaggctaggcacagtgtctcacacctgtaatcccagcattttgggaggccaaggcaggcaaactgcctgagctcaggagttcaagaccagcctgggcaacatgggaaaacccaatctctacaaaaaaaaccaaccaaacaaacaaacaaaaaacaacataattagccaggcacctgtgtcgtgcacctgtggtcccagctacctgggaggctgaggtgggaggatcacttaagcctgggaggcagaggctgcagtgagctgagatcgtgccactgcactccagccttggtgacagagtaagactccacctcaaaaaaaaaaaaaaaaaaaagactggagaggaaaaaaaattaattaaactattaagtaattaattttgtcttaagtagtttatttctgctttaacgtataaaacttatatactttccttaaatatagtgtggcttattgttacttatattcatagagtttttaaaaaacgaaagtgtgaaaaatttatagccctttcccagtaattcgcaaacctgaataattgaataaccatggaaatttctaggggcaagctctggcatcacatagtttttttaaagctcgctaggtaattctcatgggtagccatgggtgaggattacatacctaatattttgagaatcaacttctggtctaaagccaatggtgtatgtcgcataacaagggtatactcaccaccgcctggttgaagtattttctatctgtaggtttagctcaacagtttataagctgagcttgaaaatgtgaacctattaagccatgactgcacctccaaagaaaaggatggaaggaccatttgtttatgtggcactattcattaggtaaattgggaaaggggaatgcacatatatcaggttgtttcttaaatggtgctttctttgtgaataaacctgaaggggagaaatggccaaggaaattgtttttgttggactaaccacttctttcactttaccaagctcagatctaaagaacatcttcccttaatgccagcttgcacatatttgcacacccatgcttgccatcactctgtgacatgcactttcttttctgcatgccctgtggtaagctgtgcccttctcctggagcatgccctcttcatcttctccatcaaagtgtcagggtgtagacaccctggcccttcttccctatgtcctctggcccagaagggatgccccgtcctttgtcttcagctcccccagtcctttatctcacttgcacctttattgtctgagcttccccatatttggcaagcacagtgagctacttcccagccagagccctcccaggagctgtgctggttgtcaaaggtggagcttgggaccaagctccaaggagatgcctctgggaagttggtctccttctgagcagttggactttgaacagttaattgatgggaatcaggaagcaagaggcatttcttaatagtaataagaaatttgtggtgtcacaggtaagaatccagagaaaagataggtcctctggtttatgtcaaagtggtgagagcaacaggctttaaatcatcctcaaaaggaagatgctcaaaaggaagaggaaaaacaaagccagccaacgatggagaagacctaaatatttagccccatcctgcttaggttctcaggaggaggttttttgtttgtttgttttttgtttttttttttgttttttgttttttaacaccttttttcagtaatggtacttgctagaagagatacaactctgaatcaggtgtttcgaaattgcttctttagaatacggaagtaaacaaaggcagtagcagtctttcttggaaaatcattattatctgtcatactttttcagaggcttcttctgactttatacagaaggcaggccccagtctctaccccaccctagccttttatgggaagaatggcacacagtgacacatgggtccaaggtgtcttcatcatacctaatggagaacctcatctggtttctaccattccctagatacattttctagaagtgattttgctgtcattgtggttagatgtacgatctgggagccccgtaaatctccctcctttagaagtctggctttgctgtgtcatatggggtgtctgagcagctgggtatacagatctaagactactactcaaactttgaaatgctttaaaagagtgattttcaaaaatgtatgtatattattatgaaaaatcttcaaaataaaggtttgaagcaatagtataatgaactccccctctctgccatctaaacttagtaactgtcaacattttgccatatttgcttatctatttgtctgtctgtctgtctatctatctatctgatctatctgttctgttttgctggacaatgtgaaagtgcagatttcatggcaaggcacctccaaatgcttctttgttaagaacccttctatatgagcaaaatacattgtcacatctaagaatattaataacatttccattatatattttctgatctatatttaaatatcctctattgtcttaagaattattttttaaatatgtttatgttttccaactgaatccccagaaagctgggagactgagacagatttcagaggacagggtcccatttgtaaaaatggggctggggttcttccagggttgtggttctaaatggctatgaggcctgaggaaaggctcatttagccattctgaacttgttggcaaaatgaaggggttgggtaagataatccctaagggctgctcagattccctctttaaaaatatggtcataaatagctaatataaaaacattatgcgaatgatcccgttttttgagaaagtgtctttttcctcttcattcttgattagggattgtctagtcatgaatgctaaaggttacttaatcttctatggtgtcatttgctcccatgaagtaatcatctattaaccaccgcactccttgttccactggagcagaacagctttacacttagctttcttccttatagcatttattcagaccatctcttgtttttctatcatatttttgttagttattgaaaagatagtttcatactctgccagaaagtttcccaagcgtgggccattcatatccccagctaaccagtatgttgttcttaatgaaatattgttcgagtaatcagaatgagagtgcacagcaaaatgtctgtacttgtcctagaacataaaaatactggaaaaagcaaggtggtcttcactgatttcactgcattctggttactttcccactggatcataattgctcgtaggaataataaatttgggatatgtgtctggctctggcaattcaccatagcctcacggagtcagctgcttctctctcctaatctttttctttccattttcctctcttgtccctttctctttctcccattctcccttctttctcattcacttattcattaattcatttattccgtatatgcatgtagtgcatgcctccttggtgtcagcccagggcaaggctgctgtggaggggcacccttagacccccgggtttgttcttattttggccatagttcacttcaaaatgaagggctgcaagaaggtcattgcctggctgagaatgatttcttcttaaccgtggtaacccatgctgtgtggggtggaaaaatgtcttttcttgtataaatgtgtttcctgtttgtactgattttgtaacttctaaatgtaaaattattagtatctttaaagtgccagaggctctcaaagaagttgtccccaaaaagaaagtgcatcctccccaaacggctgaagttgtacctgccaaagatacattcttaactgtgccttaactctaaccccatgctaggttaccatgattaagaagaaaaggggctgtgggatgtgtgtgtgtctgggggtggtggtagggcacattagtgagtggcacaaggcaatttccaagcaagcttctgatttgggaaacctggggttgattaggagtgagagaggagggggagaactctgagcacacagttgtgagtggcctgggctgtgaggaagaggaaagctgggttctgggacttgctgactcaaacatggagacgtattgtgatgccctggtggtggcctggaatgattcagctttataatgaatgcattttattcctttctaaaacatttgatccagtaagttgaaactcaaaaagccttttccaggttcagtggtcaggaatggattgctttcatcagtatcatgtcatggcccctctttttccctcatgatctctgcccccaccccattagcatctacctccatatatctgccatgatgtgtttgaattcactctccatatcttttgtagatatgcaactgtgaacgcattttatgtgtgctttatttttattatttgaaatggagtctcacattgtcgcccagactgtagtgcaatggagggatcttggctcactgcaacctccgcctcctgagttcaagcgattctcccatctcagcctcctgagtagctgggactacaggcacccaccatcatgcccggctaatttttgtatttttgtagagatggggtttcaccatgttggccaagctgattttgaactcctgacctcaggtgatctgcccacctcggcctcccaaactgttgagattacaggcatgagccactgtgcccggccttatgtgtgctttcaaataaatgttgaagcaaatggtattatgagactcattaggcaacctatattcaggtatttattttttcactcagcactgctttctaagatccatctatgctgttatgctatagattcagtacactccttttcattgctgtaaaatatttcctccaacaaatacacattttgttcaggcatttgggcaacacccagttattcacggttactaatggtgcagtggacatcgtcgtgcatgttaccttgtggaaatgaggccatgccacttttttctccaactctttagttttgacattttttaaacctgcaggaaagttgaaagaacacaacaatcatctgcttgccttttacctaaattatccaagaatgtaatcttaccatatatgctttttctctagatagacacacactcaggcatatatgtggggatgtttttctttttttgtgattgggtctcactctgtcacccaggttggagtgcagtggtgcagtctcggttcattgcaacttaggcctcccaggctcaagcgttactcccaccttagcctcatgagtagctgggaatggcccatgccaccacgcccagctaattttttgtacttttggtagagaccgagtttcgccatgttggtcaggctggttttgaactcctgagctcaaatgatccacccgcctcagcctcccaaagtgctgggattacaggcatgagtcactgtacccagccatgtgtgtttattttttactgaaacttttaaagtgttagactttactccctaagtattccttcactgatttgctgataatcattctcttatgtaaccacaataaaattatcatatctaataaaaccacagtaattccatagtatcatctaataaccaatctaaaatgtgcatattttcattttaaaaaaaaatactgccaaattctcttcaaagcatctgcactaacttattgttccaacggcaatgcatggaactttctgtttcctcacacatccaccaacgttttgttatctgactttagtttttgctagtcagatggaggaaaagtatcatttttacatttgcatttaaaaaaagaaaactcagccacaaaaacatgcaattctagcacaggattttgtctttaattgtcacagtagaaatgagatccccatttggcttccagcacagggtaataaactccatgtctgtgagcaatttggagcagacaggagatgtttttctgaagatttagaaaggaattacagtgcagctcagttcttcatttttataaacatagacctttgtcagagaatgttttgacacagttatcttggggatccaaaattgtttggatgaagtattaatagtatttttaaatttatataaagtggatgactttagtatcaaaatagccaacagaatatgaatccctcgcattgaaaatgagaggaaacagaacagacagcatccctgttcttgctaacagtcaaactgatactaaaactttaaaaaaacttttaacaaaaattcttaggtttgaactttgacaactaataggcatgacatgctcataaccaagaggggatagaattgtgtttactttcttgtgcataaataatgaaacactgttcgcctaccacccagtgattaccaccattaagttttggtgactataattccaacttacagatgtgtgtatatgtgtgtgcaagcttaaaaataatccaaatcatcttcacctgaaagtaacagagacacttttaaaggcttgctgtgggctgagcactggctgagtgcttgcagtgttaccattcccgtttcccagatgaggccaattgagagcctgttcatggtgaggcagcaggtaagtggcagacttggaatttgagcacaggtacccctcttaacctttactgtactccctcctggcctagtaggttttattcattactttctcatttactgtactgtagacggcatttcatgtcagtaaatattcatctgcattgattttctcagccatatatttccattgtggagagtcaacataactaattggtctcctatcactacgcatttattttttttctcatttttgttattgtggatcacactgtgattactttcccattacataggtatttggccacttgtccaatgatttctttagattatatatcctagaattggaatttttgggtgacataacatcccactttgaatgatggtgatgcaagctgtcatataattcttcatcttgctgtgcacacaaataagtgggaatgggtgtctgttttctcatatgcccattaacactggattttttttgtcaatttgcccctcttgcaaacaaaatatggtatggcatgattttcatttgcactccatgataatgaggccaaatagttttcatatgcctacttgtattctcttcttgtgaattgcctttatgtactttccctgctttttttttctattggtgctgttttaaaaaaaactgatcattgaagttttttgcatataaatcattgactcacctgggattgattttgatgtgccatataggtctgatcttgtttccatgtggttaagatctagtcccagcactactctgagatgccatttatgaagatggtaggtgtagtgtagtgcctgccacacatggtttctccataaacattccttcccttactctctccctgtctcttgcatagtcttagggagaggtactaaggaaggagcccgggtatatccaagaactgggctgggggagtagaaaagaacaaggctaattattgagatttcacccttccatgaatgatcaatatttatgaagctcctctgagagacatatgagaataattagcttccataaggctagtttgggactttgatgtgccttttttcctgggatgtgtttttccagcaggtcatgtcaccattaggtaaatggagtgatcctcattcatattgtcatgatgatgcagtagatgcagttttcagaaaaccctcattgagttatgttcacttttctcctggcagcctgcagtacagtgttctgttggttggcacagtttctgctgcttaacgctggatggaaaataagttagaatctgatagttatgggcatttcaattaagatgcttaatagcactaattgtatttggctataagaacccaaaaatgcttgggcattaaaaagaaactaaggtgaaataataatgatattaaaatttatccttgtttctctgatgttgtgaaggctacaacggtaggtccttctggaagaggttgcccttgctcccttgctgagtgaattgggtctttggtaacatttgtttcctttattatgtcagagtaatcattcttggtgaggtgatcttgaaattcttaaaagagcagaatgcaattgttataaataatatatcataacaaaaatgagaatcaaattcaccagttggtgtaacttgggacatatcacagaatgtaggaccaagaaaagtttcagttttcaattctgttaggaaagctcatcagcaaatccattctttccagaaaccaaagctataaaaacccaagaaatgctcggagcatgttatctctcattattttcatttccagattattttctcagatttgttcatctctcagcctctcaaagcctccactgtccttcacttttcaccaccaactccccaccaaaagaaaaaccaaacaaataatcccccagaatctggatattatagattcaattttattttagaacttttgggaataattgattgtttgtgttgaatttctttctttctttttcttttttttttttttttttttgagatggagtttctctcctgctgcaaaggcttgatcttggctcactgcaacctctgcctcccgggttcaagtgattctcctgcctcagcctcccaaatagctgggattaccagtgcccaccaccacacctggctaattttggtatttttaatagagacaggatttcaccacgttggccaggctggtctcgaactcctgacctcaggtgatccgcctgactcggcctcccaaagtactgggattacaggcatgagctaccgcgcctggccaaatttctttatattaaggctgtatttgcaaatactggccttctaaaatcactgaagatgatttctaccaaatgagccatgaagaatgaaaaggatttttttttaaaaaaagcaaagaacatggccctaactctttttcttattgtttcttgttgcccaaagatgctgctcagatctagtaggagaataatccttcctatttttcactatatttcttcctaggggctggaattgaccagactttaggagcagggaagggtcccatgaaagagggcttcagcttcagtctggaggcagcttcagaacttgatgacctagtgatttggggtcacttgaagggggggtgggtgagtgtctgcgcatgtatatgatgaggtcctgctttttctagtcccttgactagttttgtgcctgctgcaagatgtacttcatggtggccaaggggcaggctggcgtggatggggatgagtttatgccagtggttgaccacataaaggaagtctaaagaccctgcttatctgcaggacagagtttgagttgtcagcattagtagatgagtagaaattgaagattcaaaatttgaaaaaggatgaggagggagaggaggaaaagaacagctaaagaatgtataatatatcaaactgtgtcaaagcatgctagccaaagatgcttgatttgcattgcttgttgatttgcaggcacatacattctgtataaagtataatgaaaattttcagctaatctgccaaaaaggttgaaaattttccctttcaacctatgatggaaaacaattcagcaatgtatgttttgagggcaggggtaggggaagaccaagcagactgcctgaagatattcctcatcaggaaaatcagagttgtattttcaattccatactgaatttaaaacaggaactgggcccacaatagcataacagtaaggaaaaatctgatgtctgattttgagacctagcgtagctaaatttccagtgtgtgagagtgaatacgaaggtgaccatcttaatttgcacactttaccctgtgaataattttgttgcccctgtggacaacctgaccttaacaaagccttgtcaagcccatctcatttccacctcccatttgattctctttgaacttccatgtgtaaacaatggttggattatagaatagataaagtgagatttaacagctgctttgaagatagtttaaatgtacttttaattagtattgttgaattgatttcatgctgtagctcctaacttgactgtattttatgataatgagtgtgttttgaacctagatgtgcactgcgatggtatttcagggtggatattgatatgtatgtgaccacatgacattactcccaattgtcctgggtattatatctgctccagaaactggctaactcagaggaatcttagcacctttagctaataatatgtaccaattgtacatgcttgcaaagtttctttcacttcttaaaaactctgggtgaaggtgaaggctttctctgtatttagtctaccattcttttagcaaacaaatcgaagtgagatctttctttactgagtagatctataccaaaatataccgaggctgaaagagcatatcctggataaaagttggaaatgagaaaatattgccattgatagttactgcttcaacccctgagtgcatgttgagccagggaggcaccgtacatttgcagggcacagacagggttaccaatggaaacccctggctggtgttcccttctctctaccccctcccacccacagtgcaaaagactttatgtgcaccctggctagaacatccaggctttgtcaacacccccttgcaaacatctgtcccctggctaccttcagatttagtgacatgtacaccagtgacatgttcacccccaagacgatggactggggagggcccatgcaagccctagaagtgggtttgggatcatttgggtggagaaaattatagagtcccaagcgcttgcaacgaggatgtgaagctggggagaggacatgggctacaaataggcacggtcccttgggcctgtgtcctcattgctcccttgggtggggagaagatgaaagagggccgaaatgaggtcctccaaagttggggctcttttccccaactcttagggtggcgccaagagccccagaataggagagccattgtaggacattgtcccactgggcctttcattttctgccagcaagcatttgaatgtctgttctgtgcagattgtcaggctaggtgttgtgggaggatacaaaatacaaagctatttttaatctagttgtgggggagaccaaagctggactgagaaacatttcaaaacaactgaataataagggaaaatggctggcccttcagtgacaagtgcgggaattttgggtgacatggagtcaagtgatagttctagcttgaaaaggagggctggtttcagggccacagggtgttagaattcatggagttcatgggtggcaaacttaagctttcagagctccaacaggtaccgtaaatgtgcgaatggatctggtatcagaccacaaggatgagggagagcacttgggagggcttgtgttgaactagagactacatgtcctatcgaaagactttcttggctgggcacggtggctcacgcctgtaatcccggcactttgggaggccgaggtgggcgggatcataaggtcaggagatcaagaccatcctggccaacatggtgaaaccctgtctctgctaaaaatccaaaaattagctgggtgtggtggcacgtgcctgtaatcccagctactcgggaggctgaggcaatcgcttgaacccaggagacggaggttgcagtgggcctagattgtgccattgcactccagcctggcaatagagcaagactctgtcttagaaaaaaaaagaaaaaaaaaaagaaaggctttctcattaaatagtaaagagttgaaccacgtacttaccatattaaatgggaagggatctctgggtccacacttctggggtggttgaggaagaagttaaagtgatgctgccacatgggtgcagaagcttaataatatgatcgtttatgcacatttactcctaatcaaacaacttggttaaagaagttgctgcatgtagaaaataatgtgaggggaaaagttgtaaagaagaagctctttaacatactgcttaacactggatggcgggtaagacaaatgagaacaatgaagagaccctttcatgttagaggctaaaaaaatttgctatatgtggaaaatgtgcatgaatccctattattcttttcatttctgtaaaagtcctcctagaggaactttattatgtccaatttaagagtgttgaccctgtgatcactgctcccaaacaggccctgtgctgggttgaatcgtgcgcccccactccaattcgtgatgaatttggaacctgtgaatgtgaccttatttggaaatagggtctctgtagatgtaatcaagtcaagctgtgctcatagtggatttgagtgggccccaaattaattgtggctggtgtctttaagaagactgaaaatgggacacagacacaccagagtaaagaggaccatgtgaaggcaaaggcacaggttggagttacactgccacaagcaaagaacatcaagcattgcccacaaccaccaggagctgggagaggagcatggagcagagtccctctcagcagctccgtgagaggatgtgtttcctgggttttaagccagccagtatgaggtactttgttacagcagcctaagaaactgattcaggcaccttttccaactttctccttattaatagaaatgccactaagttcaccaatgtctcaaagattatgattcccatctccgaccttgtcttccaaatgcattgagttttccaaaccattgcatttgcttcttcctctccatttccgcaggtatcacccttatcacttatcataataatgaatgtttgaatactgctttctacaattaatgtgattttcattctcacaacaaatgatgatgtgttatactcatttatattatactcatttacttgatgtattatacttatttatttattaattatactcatttacttgatgaggaagctgagggtcaaagggtttaagtaatttgtttaaggtcatccagttaactagcatgctagaaatctgggattccagcaaggataggctctttagtgccaagaaaaaaaataataaatccaaaagggactgccttgttgtaagtattgtgccatcctgccttttccatcattttaatgaaaaaaccacaggacacatctgtatcactggggtaaaatgaaaggaagctgcagattgttctcttttgcttccttacgccttggaggcataactttcgttattacgacagcaaaggcatcccactaattgatagaacaaaaatagagctaattttacctctttttttcttgtaacaacggaattcctttttatatatttaattacagcctttgaagatacatcaaataggattttggtggaaagatatttttcccctaagtaggtcactggagatataattaacacagataatagctatctcatctacagattgcattttagttgaaatgacctttttcactgtgtttccccactgtctgaaacaaagcagacagttgggttatgttgttcgctggttttatagcaagggcaaaaagtacatcctcccaatgtaagaaacacatctaactcccacaattttcttactgaaaatctgagttattttttaagatagaggttgtatgaaaaggaaaagctggttgcttatggattttcttataaagcctcccccacacccaataagacagagttatatgtaggatgaccatatacattattgtctggaccaggatactctggagaatgcaaaggatgctatcgataattacctcaggacagtggttataaaccgaggctgccctgggcaaccagaagatatggtcatcctggctattttaacccatcctggagagaggaatccagcctgtttttgaatacatctccccacaaatagagagacatcttgatgagtggggctggaggtgattactcgtcatgaatcattaggttgccccttggaaattaaatgtagatatttaaggaactttttttggctaccagtaagagatacattgaaaaattctcacccaaatgttttggtcttagtcatggagagtttggggctcaaagggcttttggcctagaggcaagaaatctgggggattgacctttcccacaggagtgtaaactcaagcctagatagtgcccagctaggcgatcaatggatgcttactaaagaatgattggaatgactctaagcacatcctgattcacagctgtgcgccagaaaagaaatttttctctttcagagagagatgtcataatgaagacctcttgatgagaactcaaaaagttgagtaggcacaaacttatttgttgatttggacaccgagaggagatttacaaggggagggtatatttcatttatattgggagaggccgctctgaattaaatgctaagaaaaagcccaaggctatatggtgattagataaggagtgcggattagataattcttttttttttttttttttttttttgagatggagctcgctctgtcacccaggctggagtgcagtggcatgatctcggctcactgcaacctctgcctccctggttcaagtgattctcctgcctcagcctcccatgtaactgggattacaggcacccgccaccacgcccggctattttttgtatatttagttagagacggggtttcgctgtgttggccaggctggtctcgaactcctgacctcaggtgatccacctgcctcggcctcctgaagtgtgtgttagataattcttaaattattcagacatttcttgagcatttactcttacagctggtgttgtcaggtgctggggttcaaaagggagaagatagttgctgattgcagggaactcatagactaatgagaagacatataaagatcatggcaaatgcaacgataatggtatgtaaagatatagtagtaacagggagaagagaatgagaccttcttcttggaaccttaggagaatttatgggaaaagtaatgcggaacagtgtgaggatgagttggacactctgaccagggaatcagcaggtctacagggatagataaaagaaggtgaaaatggtaaggcctgttttaagtggttgatgttatgtttccaatatcctgctgttactgagttttaagtagttgatgttatgtttccaatatcctgctgttactttgaccacgcattcataaactggacctttcaagagcaaatttgcatattttctttcacagtggtgggctaaaaaataatgtatacctatttgcatatatatttccatctgaatttcatattctgacagaattctgagaaggacttcaagagaatgacttcttagctttccaaggtgaacggtagtgcattatatttttaaagacctacagtattggaattcccatgttttcatttttaacttgattctgtatttaattgcactggtagctcctcttatttaactagcatttgttttaaatttatctttagaagtggaggaggaaaggataggaaggtggtttaggtactgtagttactggtgtttcagcaaaatgttgtagtgcttcaagatggttccttcatctttgtgcctgccttattgaggcttaaggattttaagtctattgtctctttttagagcttcttttttttcctttaagtaatttttgtctttaccctttctttttcaacataagcaaaaccaaacttttggacaatcataattgtgcaaggagaaattctgacttcaggctcattcttgtgttaactgctgtagtgttagattacttctcatactctttttaaaggctgagagtccaaagtcttatcacggccctggtgttgtgatttcttggtgaatgtttctgcaagaatgaggaaaatgttaattttcagaagcagcagtgagttttagagattctaaaaccattaatgaatatgcttacaatttgcctttttaagaaagtaaaacaattatgagtcattctcttagagatgacagtgagctcatgaacccatgaaccttcttttttttttttttttttttgagatgcagtgacgtgatcttggctcactacaacctctgcctccaggttcaagtgattctcgtgctttagcctccttagtagctgggtctacaggcacatgctaccatgcctggctaatttttgtatttttagtagatacagggtttctccatgttggccaggctggtcttgaactcctgacctcaagtgatctgcctgccttggcctcccaaagtgctgggattacaggcgtgagacaccatgcccaacctactgacccttcttacaaatgaaatgagttgtacttctaagagaatcactaatattttatctacaagccacagagtttatttgaagagattttttttcctttatactttgtgtggtttgtttttagggaaaagtaattgatgtcgagagggttttccaaaacagaattttgtccctaataagcatttgattcttaagattctctgtattttgttacatttctggaatcttatacatatgagctattgacataaaatgagcacaattgtgtaactctttatgggagcaacagttataatgttttggcacatctcaaagatgtctagattatgtgactacatacagaagattaaatcaatgccaatcatttcctaaagtaaggcatttaacagtaagagaaatatttgtattgatttttttaggaataccatatttataataagttatacaaatttgattgtatgaatagctcaaattagagtaaaaattagccttgtagcctcactgcatttgaacttttaaatgcacttatgggaaggaggcaagatgaccaactagatgcagctagtacacacctcttccatggagaggaaccaaaatagcaagtagatattcacactttaaatacatcgtggaagagagaacactggcattcaacagagaagtgacgggaagcaccaaaagcaaagaaggagagggaagcaaggtagcctgcttggccaggattggctgggagctggaagaagctcccaaacatggggaaaaggtaaatgagtgatcccctcagggctccacattcctgcaagggatttctaccagcgagaggcgcttaacccttgcaggccttgagactctcatagagagctacctagagattgtgcagtgacattgctccaaagggagctcatgcttagtcccacgggctcctgagacctgagcagctacaatatggcaccattctgagagctcaactggcaaaggactgcattccctggagctgatgccactgcagctgtggtagaccaaagaggaacagaggaggtcaggccctttcacacatcttgaggacaaatcccactgcagctgcagctgttgtgggactaagacgtgagaaacccataagccccacagctgcctgcctatgccgttcccattgagaatgaccctgccctccctggtggcatgcccacagtgggcaccagcctgaaagcacaatcctcaaaggactatgtcctgcccttaggccaacaccacttctgctgctgccaggccaagaaggaagaggagaggccaggcactatcacatgccccaaagacaaatagcattgctgctgctgcaggcttctgtgggaccaaggtgccagcaaactgtgagtttcacagttccctaagcagctcccactgagtggcctcatcctctttggaggcaggcctgaagtgcactgctgcccccacctgaacattgtgccagtggcctgtggactggttggcctctgcctgtcagcaccatcacctgaactcactaccagaggccctgaggacacgtccaccaacctagttcccttcccccattacttcagcctgccatcaggggcctgggatcagcgaacacagtccaacaccattgacatttgagcactcctcccagggtctgaggttgggctcacccaacctgctgataccaccacagctggcacccacctgcacaagccacctgaaggccaggggactggcactcctagacttttgcagacaccaggaacaacagcatggaccatttgggtcccactgggctgccccatcactgctactgccattgcccacatcatacctgctgcccagtggtctgagaacctgcccacatgcctggcccactgctgccaccaccagcatgtgagcaagccaactggaagccctagaattggcaaacctagacccactaacaccagagccaacatatactgtgggtttaagtacaggcatgttcagctcactgctcccaccactaaggcctgcagactggccatctggcatcttagtccccagtaaaacttcaccacagacttactaataactgcaccctaagccactgaggaaatcacagacaccattgacactgtttacagctgaagaaatcatataaggactaactgcatgcacccaaaatcaaagccatagtgccatatatatatatctcgtcacaaaaaagtagatgtacatatcttatatcttcaggaaaaagtcctcccctatgaaaacaaattcaaaaacttggactgttacaccagatatcaacgtaaaaacacaggaaacaggaaaaagcaaggtaataggacacctccaaaggaacacaataattctccagaaacagatcccaatcaaagagaaattcacaaaatctcaaagatttcaaaatactgattttaaagaagctcagtgagatacaagagaattctgaaaaacagaggaggagaaaaacaattcaggatatgaatgagaaatttcccaaaaagagatacttttaaaaagaataaaacagagattctggaattagagagtttattaaatgaaatatgaaatacgtttgaaagctttaacagtagacttgctcaagtagaagaaagaatctcaacttgaatacagatcttttaatgtaatcaaatcagacaaaaataaagaaaaaaagaaaaaagaaagtgcaaagcctttgtgacatttgggacaacatacataaagcaaccaaaatttaaattatcagtgtcctcaaggatagagagagaatgaaaatgttagaaaacatatttaatgaaataatagatgaaaactttccatgtttagaaaagacttagacatccagatacagggggctcaaagatgctcaaacagatacaatgcaaaaaggtcttctccacagcatattatagtcaaactgtctaaagttaatgacaatgagaggattctaacaacagcacaagaaaagtttatagtcacctataaaggaacccctatctgactaacagcagacttctcattagaaaccttacaggccagaaaagaatgggatggcatgtgaaaagtactgaatgaaaaaaggttgcacccaaggatactatatccagcaaaattactcttcataaataaagaaaaaataaagtatttctcagacaagcaaatgctgagagaatttatgaccactagaccggctggccctacaagaaaggcacaaagaagtcctaaacctggaagtgaagtgaaaggacaacatttaccaccatgaaaacacacgagaatataaaacccattggttaaccaaacacacaaatgaggaagagaaaggactcaagtgatactactacataaaattaccaaaccacaatgacaaacaagagaaaaagaaatgaacaaaggaaccagaaaacaactaactttatgacaaaaacaaaacttcacatatcaataataaccttgaatataaacggattaaatcatccacttaaaagatgtagattggatgaatgaataaaggaacatgatctaactatatgctgcctacaagaaacccactttacttgcaaagatacacataaactcacaataaagggatagaaaaagatattacatgcaagcagaaaccaaaagcaagcaggagtaactatacttatgtcaggtaaaacagacttcaaaagacaaaaaatgtcagtgtgtaataataagaggatcaatccagcaagaggaaataacaactttaaatatatatgctcccaaaactggagcactcagattcataagcaaatattactgtatctaaagagagagatagactccagtacaataatagtaggggacttcaacactccactctcgtcgttagacagaccatgaagacagaaaatcaacaaagaaacattggattcaatctggactttagaccaaattgaccaaacagacatttagaaaacattttatccagcaactatagaatatacattcttcttatcagcacatggaacattctttataatagaccatgttttaggccacaaaacaagcctcaacacattttaaaaaatcaaaattatactgttattttctcagaccacaatggaataaaactagggatcaataccaagaggaactttggaaactataaaaaatacatggaaattaaacaacatactactgaatcattatttggtcaatgaagaaattaagatggaaatttaaaacatttttgaaacaaatgaaaatggaaacacaatctaccaaaacctgtgggatacagagaagggagtgttcagagggaagtttatagcaataaatgtctacatcaacaacaaatagcctaatgatgcatcccaaggaactaaaatacaagaacaaaccaaacccaacattagtaaaaggaaagaaataataaagatcagagcaaaactaaatgaagcagagactaaaaaaagtacaaaagatcaatgaaatgaaaagttggttatttgaaaagataaacaaaattgataaaccactagctagactaaccaagaagagagaaaacccaaataaacataatcagaaatcaaaaaggagacagaagtacaaaagatcatcagagattattatgaacaactatacactgataagctgaaaacctagaggaaatggataaattcctgtaaatatacaaccaaccaaccaagcttgaatcaggaagaaatagaaaacctaaaccaatcaattacaactactgggattgaatcagtaataaaaatgtctcccaacaaagaaaaagcaggaccaaatggattcacagccaaactctaccaaatgtataatgaagaactaataccaatcttcctgaaactattccaaaagattgaagaggagggaactctccctaactcattctacaaggtcagcattaccctgataccaaaaccaggcaaggacacaacagaaaaagaaaacaacaggcgaatatccctgatgaacataggtgcaaaaagtcttcgactaaatactagcaaaccaaatccaacagcacatcatgaacataatgcaccatgaccaactagaatttataccagggatacaagaatggtccaacatatgcaaatcaataaacgtgatatatcacatcaatagaatgaagaacaaaaactatgttattacctccataaatggagaaagagcatttgacaaaattcaacataccttcatgataaaaactcaacaaactagaaatagaaggaacatacataccttgaaataataaagctatgaaaacctcacagctgacatcatactgaactgggacaaggtgaagctctttcttctaaggtatggaacaagacaaggatgcccactttcaccactcctattcaacatagtactggaagtcctagccagagcagtcaggcaaaagagagaaatcaaaggcatccaaattggaaaagaggaagtcaaattgtacctctttgtgggtgatataagcttattttttcctgagtgtgcctgaaggagacacattttattagacatttgaaatgttataatctataaacaagatatgatttcatacctaggaaaacctaaagaccaccaaaataaactcctagatttgataaatacattccctaaagttataggacacaaaatcaacatacaaaaattagtaccatatctatacaccaattgtgaaccagctgaaaaagaaatcaagaaagcaatgctatttacaatagctataaagaaataaaatacctaggaataaatttaatcagtgaggtgaaagatctctgcaaggaaaactacaaaatgctactgaaataaattgaaaaggaaacaaatggaattagacatccatgctcatggattggaagaattaacataattaaaatgaccatatttccaaaagtaatccacaggtttaatgcaatccttatcagaataccaacatcatatttcacggcatgagaaaaaaaaatcccaagtttcatgtggaagcaaaaaagagcctgaatagccaaagcaaagcaatcctgagcaaaaagaacaggtcagaagcgatgcctcacacctgtaatcccaacatgtttggaggccaaggcaggaggatcacttgaggtcaggatttcaagaccaccctggacaacacagtgaaatgctgtctctataaaaaaattttaaaaaattagctgggtgtggtggcacacacctgtagtcccagctacttgggagactgagacaggaggatcacttgagcccaggaatttgtggctgcagtaagctaagattgtacctctgcactctgggctgggcaacagaatgaaaccttgtctctttaagggaaaaaaaaaaaaaagaagcttctgtacagcaaaggaaatagtcaacagagtgaataaaacaacttgttgaatgggagaaaatatttgcaaactattgatcaacaagggattaatatccagaatatacaaggaactcaaataactcaacaacttaaataatgccattaaaaagtgggctaagaatatgaatatgaatgtttttaaaagaaggcatacaaatggccaacaggtatgtgaaaaaatgttcaacatcactgattgtcaggaaatgcaaatcaaaaccatagtgagatactaccattccctagttagaatagctactactaaaagacaaaaaatgacatgctggcaaggatgcagagaaaagggaactcatacactgttggtgggaatgtaaactaatataaccactatggaaaacagtatggagaattctccaacaactcaaaatagattaccatacaatccagcaatctactactaggtattaatccaaagaaaaaagaaatctgtatatcacaggaatacctgcgcttgcatgtttatcacagccctattcacaatagcaaagataaggaatcaacctaagtgtccattgatggacagatggataaagaaagtgtggtatatatacatagtgggatactattcagccatagaaaaagaacgaaatcatgtcatttgcagcaacatggatgtaaatggaggtcattatgttaagtgggataagccaggcaaaacaaggcaggtactgcatgttctcactcataggtgggagataaaacacttggtcttgtggagccgagaatagaataataaataccaaaggccaggaagggggtgtggttgggaggggaggatgaagggaggttgattagtgggtacaagcatacagttagatagaagaaataagctcaatatttgatagcaaagtagagtgaccataattagcaacagtgtattgtatactcaaagtagctagaagagaggacttgaaatgttactgacacagagacatgataaatactcaaggtgatggataccccaaataccctggcttgattttatgcatgtaacagatattcataggtaccccataaatatgtaaaatactttgtatccataaaaaagatgcatgcagatgtaaaaaaaaatgcacatatggcaaataggagaaatatattatttttgatatctcaaattagaaaaataattattcaaaaattctctgtgattaaaacttgttagcatgacccattgactttgtctgatataagaggtactctcacaaatcaagttaggacttgaaaattctttatcaaaatgagacccaaagatgatagaaagtagcaggaaatatttggaattgctgctcttcttggttaggcaataaagatggttttgcagattaacgaatcaagagactaataaggcagggcacggtgtcttacacctgtaatccagcactttgggaggtcaaggtgggcagatagcttgagaccagaagttcgagaccagcctggccaacgtggtgaaaccccgtctctactaaaaatacaaaaattagccaggtgtggtggcgcatgcttgtaatcccagctgcttgggaggctgaggcagaagaattgcttgaacctgggaagcggaggttgcagtaaaccaagatcgtgtgactgcactccagcctgcgcgacagagcgagactcttgtctctctcacacacacacaaaaaaaacctaacaaaaataatacaacatattttgaattctgctccgttgttctgctgttgttttttaatcttaaactgtgtattgagcctcgtcacttagtttctttcaactctccttttttattttgaaagccttgtattaatctcttttgttgagacagcagccatgaaccctgtctccaattgtttccagttctctgttgcctagaattattgctacttctccttttatggtgaaaaatagcacctcctctatttgcgagaacagaagctgggagagtgacctggctgtgatggtgatgtaggggctggacagaaactagcaggagtaacttgaagaagtgaatcttatcggcactttaaaaatgttttcccccggaaattgaaaaacagagctccagaggggtattttattcatgcagaaataaaattggaacttgcttggaaaaaaaaaaaaaacaaaacaactaaactgaatgtaatgcaatagcttgagcattccagtcccaggcatattctattagcacaggttcccctttgaagggccccagagaagtgtttcccaaccagcctgtggaccgggtgcatccaaacccctggaatactggtgaaaaatgtatattttcaaatctgtcaaaattattagacctgacaaggggcccaagaatctgcatttttaatgagcatcgtctccctcattggatgctgtcctgcacttaggtagggagtcatttggaatttctctcagcattagctgattctctcataaatcagtatcttttttgttttttgtttttgttttcctagacagagtctcgcatgtcgcccaggctggagtgcaatggcgcgatctcggctcagctcagtgcaacctctgcctcccgggttcatgccattctcctgcctcagcctcacgagtagctgggactacaggcgcccgccaccacacccggctaattttttgtatttttagtagagacggggtttcaccgtgttagccaggatggtcttgatctcctgacttcgtgatcctcccgcctccgcctccgcctcccaaagtgctgggattacaggcgtgagccaccgcacccagcccataaatcagtattttaaacaagccccagggttgcagtacacacaggtgcagaaactcctgctgcatgggtagctactgcccaaggtcagccatgagttctctggggccaagcagagtgcccccaagggcctggcaccgtcctctgggcaggcctctttgctgctgagaaacgctccttcctaaagattacaaaaggaattttcttaagtcctttatccccccattaaaaagccctgaaatggaacctgagcctcccagtgtgctggcacctggcctcaagtgtcttcatcagagcgcctgctcactggtgaggttgctttgcatacacaacagactcatccactctgagcgggaaatccacctccttgttgcttttcaaaacagaagccatcctgactgtctacagccaataaacacccattcatgaatattttattaggctcttactctgctcttttaggctccaaagatatcaggaaacgagaaaaaaaaagatccctgtccttagagagccaacctgctggtcacatccgttatgcgcatgtctgtcttccgcctgttgggcacatagatgatttagacagcatgagcaacatccagaactgtgtgctcattcttgttctgacttcttttgttctatttacattgtctcatgcaaaactgagctacaaacagtggcttctcacgatggtttcagaacacatcacaattgggagatggtgcttcctatctgggaagctttatcagcctgctttggctctctgggaggcagtctttctgaattttatgtaaacattagaacaattggctttctgttttgatgtccttggactatcacttgggaaagatttatgttgctttggcctctgtttcctcctggctcctaaaggccttttgtacttatatgagtttcaatccttggttattttgtattgggatgaggttcatgggtagaatttcggaagactcgagagagaagagtggaggaatctcctttaaagatgaaaagtaaacgggtaaatttcacataagaaatgataattcatgtgtattattttccaaaatgtggttcccagatcactggtgatagacaggatgtttttatttgaaatattgctgaagtcatttgttatatttagtttgatcgtggcaaataatactggtctttcacttgtgacaggttttttcattacaagtttattgaaataataaagctaaatattaaataatcacacaggtgacatatgcgtatgagaaaaatcacaaggttggtacacagataattgaggtttgggaaatgctagttgagtggaaggccaggagcaagcgtcttgtaggaaaactcccaacctgcaaggtcaaaggctcacagctgtcactcacagtaaacaggaagcttgtggaggtgagctttatagaaaagaaattatctgtatgtgccaactagcaaggtctctatgttcaagttaaccagtaattgagtgtccgccctggaaaaggaaatatctcaagtttagggggagaggggaggcagaggatccaaggcaaagctgtatagcaggagatttgggagattatgggagtcttagaccaggagcagttttatcccctgctgagaggtcagagaggatccacgcagagaaagggacgttaagtcttctagtgaatgtattactggccagggtgccttccccagaagcttgccgctgattttatgacaaaggacagttgcagttggatgatggtgagcaactatctcaaatatatcaggcgccaggccagccatggtggctcacgcctgtaatccttgcattttgagaggctgaggcaggaggatggcctgagctcagaagtttgagaccagcctgggcaacatggcgaaaccctgtctctactaaaaatacaaaaattagccaggtgtggtggcacacgcctctaatcccagctactggggaggctgaggcacgagaattgcttgaacccagaggcggaggttacatgcagtgagctgagatcatgtcactgcactccagtctgagcaacagagcaagactctgtctccaaaatatatatatatggtgctgaaagtttaaaagtacttattaccattgttggattttattttcaaatatgaaaacagaaaaactaaatggagaagagccgtttcccctaattatatttgaaacagagtctagagacggaattgtaattttattctctcttttactctgtgactttttggattgggtccaggattgcaagccctctggactgtgacccctccacccctagcctcattacatctaagtgaatccctttggaaccagacaccaaaattcacctttcagttaaaagacctcccactccttgtaaaccaaaaagctgctgccagggtgagggttcctgttgtcttcactgtgtgtagccgttcaggctgcagaggaccctccaccagcacatgcattttgtgggggtgcgggtgagaaattcctcacaaagagataaaaaaacaaggcagagcggacgcatgctactgaaacaaaccacatattctaataggtagttaggtaggatgtaggatctaagtcaccgagtcctccagtcaccaataattttcactctaaaaatcataccctttggatttttcttttgctttttgtgaataaatgaacagtcatatacttgatgtctgagtgttgagtttctgtttagaacaagtgaggaaactcaactgagatccttagcttgagttaaactggtccctgtggtcctggtcactgctgtcattataagacagattgatgccatcatctaccttcccctgcattcacctgctgctgggaccatcttatttatagcagatctctgcaggctgaaagctaaagttccagggattgaaatctctgtaccaggtgaagactgcacgtaagctgatgggagcgatggatgagaccatgtacttgggggaaataagcagtgtaaaaaccagctcataactaggggtgctatcctgggacgtgcatacaccaacataaacctgcatttggacccaggccacgacacttccaaactgagtgaccttggacaaccaatttaatctttctgattttccatttcccttctggaaaaaaaaaatacactagctgggtgatgctgaggcttaaatgagagtggaggatctccgcaaggtgagtctctttgctctctcagccctcggtgctgtgtgtctttcagtctctcttctttgcctttactctgccctcttttgctccgcatttggttttttaattctttgaacaaccacaatttaaaactaaagaatattttaaaatatgggtatttattgaatacatctatatcttctcttgtatgaacccttaaaatcacttctaacgttttctttttgaaatactccatgtctgaaataaaaaatgggtggcttttaaaaaatgtttgtgtgtttggggctggtggtggggttagctttaactattaataacattgtaagtgaatggctcttattagcaaaaagattctcttagtgtagatttttgggtgtgtcttgagtgatttttctggcttcaggaccaaaaccacagcctgtcttgaggtgattacataatctctgcattcacatcagcttcacaatgtgtaaatgtagccatattaatgttcgcttggggtaatctagcactggattgtagctcaactctgccgggtggaataagagaccgacgtggcagtatcatagtcacatgcagggactccaagatgctgcaggagtagagagctaatctgacttgggactttgaatcaagcttggacagtataaggtctttctacaggtcctcacttctcatatagggtttgtgcagccaagagtcattatgaaatggtggctcccaggggcacgtggtctcatcacagtttatccttgttcaattcatgtctcgtttttctgaggttgtccatgatataagacctatgggggaaagctgctgacttctcatgtttgttccattcaatccttcattgaccatttctttgggtgctttctataaagcaggcacattgttcgtggtgcccaaatgtgtgaatctcgggccctgcctttactggatgaaaggtatggtgagagatatatttgcaagcaagcatttaggcgatgtgctgcttctgggtatccaaggcactttgagggcctaaagcaggcagggctaactgttggtggcatgcaggggaaggaaatcctttctaggatatgtgatgtctgtggtgaacattgaaggccaaggcattgacacctgacttccagccccaattctgcatctgcacccaaccttggcttgtcccctgactaattaccagttttctggtctctgagatgggaggacagtgtctacctatcctgtctctggaggctgaaacaaggccagtgagactgtgtgtgaggacactcccccatctgggggttctcccatgtgccccagcagcctgagcctgcaagacagtgggttggctgaggtttgaggttcagtgtgtgactgtgaactttgtgtttgtcccctttagatcagaccaagacatttttctctaataattgagttggtcattgtagttcaattctgagtaaatcccagttctttctcttgccgactgggagcttgcagagattatttaaccaattagaatcttaggtttcttatctgtaaaatgaagatgataattgtattcgtctgttttcacattgctatgaagaaatccctgagactgggtaatttataaagaaaagaggttgaattggctcacgtttccacaagctgtacaggaagcatgatgctgacatctgctcggcttctggggaggcctcaggaaacttacaatcatggtggaaggtaaagggggagcaggaacttcatgtggccagagcaggagcaagagagagtgaggagggaggggtgccatacacttttaaacaaccagatcttgcaagaactctcatgagaacagcaccaaggtgagggtgctaaaccattcatgagaaaccacccccatgatcgagtcatctcccaccaggccccacctccaacactggggattacaattcaatgtgagatttgggtagggacacaggtctgacctgtatcagcaatagcatatatttcatcaagtgtgtgtggttgtgaggagccatgaataggacacatcatgttccaaacatggtaaaggggtgccatatgataaattatctttatcaaagaaaatattagcaaatattttaattgttgtctaaattgctatcacttatactgcaacttttactaccttttcaaataaactctcaatctaatatgaatgtagagttttgatgtcatttttcacatatgttgtatctggacctctaatgcacatttaagaacaatagggatggcttcatactgtaacacgttccttggccgccatgtgcaagtgttgtgagttttgaggacctcctgaactgcgtgttgagacatgaaaagaagcaagcacatagacatttggcacctctgggaaatggtgctttcttgtgcagggatgaagaatatttgtgtatctgaaaggaaggagttgactgattcatgagcctttttctctcctccaagtgttcctatggctcaaaccctccctgcaccctgacgcagccctatcactgccactgccatcttcgcagtgacaaagctttcaaatgcttaggtctttcagacatggttgcctgtttttcaaggacttagggcaaggatgtggggaagcatttccctggactgaggatggcacttgcgtgaggcttgggctggcactgctctgtaaccgaaaactgcataaccatttggcagtcccttccaaatccaacccatcagcctattaattgggatgtggattaatactgccaggaggtcctctgtttcttcgtgtgttcctttggaagtctgctgacagcgttttccacttgttttgtcttataggaactggtgaaagtgggaaaagcacctttatcaagcagatgagaattatccatgggtctggttacagcgacgaagacagaaaggggttcacgaagctggtttaccaaaacatattcaccgccatgcaagccatgatcagagcgatggacacgctaaggatacagtatgtgtgtgaacagaataaggtaacgtgcttagggagtgcttgccctatttgtgaatgtatgcctgcccactctggttagcacaaagattccctcagtgctttggtcagatgccagaagaagctcttgttccctggggtgtggggatcactgagaggagtttaaggaatttagttagcccccggtcttctttctgcaggacttctctcatggtggtagcgtgaggctacccagtgtgcagggattccaaagtttgggctgttatttaggttccttatttccggcgctgagaaaaggaagtcatacattttctctttccgctaagagacccagttaatttcttcattggagcaatggggacattgggtttacagtggccagcgtttcaagaattcccagtctcaggaaatgttttcactaattgctgcagactactcagagaattcagtgggttttgtttgtttgttctgggagttcacccttcttgggaactaagtgatggctcgtgagcacaatgctaatggcccagccagcaatgtgctcccataaagtgctggtgtcaagctgccatttgctttcccctcaccaccagttacttaaaatacaaatctgctgaaaaccagaggaaaataatgaggcgggaaagagagaggaagaggaagtaaaattttatatggtatattggaatgcaaatccagaggagaataatactatgtctgagttcattaagcaactagattagaaataagagtttatttaaaataattgataccaaattacaacatgacatgatgataaagagaaaaattctgtgtcagatgggtctctcgtggatctgtgaagaaggaatttagctagtaaaatgccagaattgcatgggctttagtatggacccctaaggacaactttattatgaacttgtggcacctatactcatatatatatgattaaaaaaagttttaaagcaatcagtttaaatttctatgggattacataggaaaacacagtaggcaccaaatttcagacttgcctttacctcatctctacaatctatgtctttactatcatttccttgcagtcctgaagaaatgaaggaacacatcttgcctacaatttcaccctgtaacagagtcatgctaaaacttgcgtggggtgggctgggcacggtggcttatgcctgtaatcccagcactttgggaggccaaggcagggggatcacctgaggtcaggagttcgagaccagcctggccaacatagtgaaaccccgtctctactaaaattgcaaaacattagctgggtgtggtggcaggcacctgtaataccacctactagggaagctgaggcaggagaatcacttgaacctgggaggtggaggttgcagtaagccaagattgtaccattgcactccagcctgggcaacaagagcgaaactccgtctcaaaaaacaaaacaaaacaaaaaaattgtgtggggtgaattagcctacagcaagggtatccaatcttttggctttcctgggccacattggaagaattgttttgagccacacattaaacacactaacgctaacaatagctgatgagcttaaaaaaaattgcaaaaaatctcattctgttttaagaaagcttatgaatttgcattgggctgcatttaaaactgtcctgggctgcactgtggcccacgggccatgggttggacaagcttggcctatggtatatctggtgtgaagtaaggtgagaggcacacactgagccactaggagattctagaagtgactgagatgattcctttatacattgctgtatctttttgaaaaggtacagttctttttttacttaccctttctaatgtactctaaaaattaggctttctgtggagatttaagatgacttcagtgaagaggcaggaatgttcttggggggtgatttcagttcatctgtttttcccctgttgtaaaatacattttgtttaccagtcatggtgaggtgactgggcaaagcttggaattcaaggatgggtttgtaaacagacccactgaggagaaaaggctcctgtgtaagccacttctgcttacgttggcagcagcgtttgtaaaacctaatcagcttagttatcaaagcttctaggtttttgcttttgttttgtttttcctcatgagcttctagagtactcagtttatattttaaacaaagtggttttatgtggtttgacatctaccactgtctccttttctcttgaccttaattattttgtctaggccatctccgtttgccccctaatctgtgttagtttcctagggctgttataacaaagtacttaagattggatggcctaagacagaatttattgtttttacagtttgtcatgctaaagggccaaaaccaaggttgattggttctaactggaggctctgagagaatctgttgtcggcttcttccccagcttctggtggtggctggaaatccttgccgtccgttggcttgtagatgcttgcctccagcctctgcctctgccttcgcctggcttcttccctgtgtctgcgtgtccacagcactgtcctctctggttctgtgtccaaatttcccttttcttacaaggacaccagtcgctggattagggtcgaccctaatccggtatgaccttatcttgcttgcatctacagagactctctttccaaataaggtttcactctgaagttttgggtcagcatgagctttgggggaacacaattcaacccctctggctccccaagattcatgtccatcccatgtacaacatacatctactccatcccgacatccctaaaagtcaacccattccagcatcaactctaagacccaattctaatccaaatatcaactcaaaaagtcccaaatcaggccaggcacagtgggttgtgcctgtaacccagtactttgggaggccgaggcaggcagccatctcttgagcccagggttttgagatcagcctgggtaacatggtgaaaccccatctccaaaaaaaaaaaaaaaaatacaaaaattagccgggtgtgatggtgcacacttgtaatcccagctacttgggaggctgaggtgggaggatccattgagtctgtgaggtggaggttgcagtgagctcagatggtgcctctgcactccagccaggggacaaagtgaaactccgtttttttttttttttaaaaaaagtcccaaatctcattgtctaaattaggtatgggtgagattctgggtacaaaccatcctggggcacggccgggtgcggtggctcacgcctgtaatcccagtactttgggaggccgaggcaggcatattacaaggtcaggagatcgagatcatcctggctaacgcggtgaaaccccgtctctactaaaaataaaaaaaattagccgggcgtgttggcgggtacctgtagtcccagctactcgggaggctgaggtaggagaatggcgtgaacctgggaggcagagcttgcagtgagcggagatcatgccactgcactccagcctgggcaacagagcgagactccatctcaaaaaaaaaaaaaaaagaacaaaccatccctgggcaggattcttctccatccatgactgtgaaactaggatacaagtccattgtacctcccgtctcctcctctcttgccatgtctggctcaagtatctcaattcctgttgcataaactttctcaaactgacacctgggatgaactgaatgctaaaatggcttaaggagaggcagaaggtcgaatggaaagaaccctggattggctctaaaaaatctgggctttgctcatggttctactgtgggtctagggctggagtctgcaaacttttctgtaaagggccagggagtcaatatttgtgggctatatggtctctgttggaactacccagttctgctgttgtagtgcagaaagcagacataggcaatatctaataagtaaacgaataagtgtggctcaattataaactctacgtacagaatgtataataagaatagtaagttaagaatacagttgagaatagtaagaactatttttgactcatgggccatgtaaaaaatccacagtccatgagtggatttaatcagttggtgtactttgctgaccctggtcctggggaagccgtaccatctctgtttttccattttcttacctgttaaatgagacatgctctgtctacttcataagccactatgagcaaaaggaagtgatttacaaattaaatgaccctcgagaaacacaaggttattattggggcaggttcaaaaatcagaaataagctcattttttttattacttgtttaggtcattttcatcaatttcttctctatcattttcctgtggctgttatttctaataattttttctcagagctagtcttgattccaaacatgaaactgtgacaaagtaccatgcttaggtcataaaatgataaactgattagtgattcagtcgtattcagtgatggtttaggaggcatgctatatgttatcttctttacaaagtatcgtatgacttgaaacaattggttagttatgtcagggaagaataaaacttcagcttttattttcacagtggtgcagtcttctcattacttattgctgagtatttatttctctattatctgctgttttttctgtttgtttctgtttctttcagagctgggaacattttcttatgtatgtagaagagaatttaaagtggttttagagggttttattttaaatgttagtgagattattgctcagctaggctgttgaaagtctttgcctattacttgacaggccacttattaaaggaaatttatcggaaatttagttccgcatttgttttttaactaacatgttttttcaattaagatacagccttgaagattttttcttataccttgcctgcttattttattaaaaagaaatgattcatatgtatttgctcactctgttgataaaccttaatttttatgaatgtctctcaagagtgttttatgggagcaatttgaatttatgacttcttgaataaatattacaaaggcatttgctcagtggcagggttcctaagtctgagttagcttataactcatgtttacttgtgatgatttcacagaagccagaaaagcatcataatttttgctgtttgcagtctcttgaacttgggaagttctcattctaggcctgtcctacagtgaaggaaaaaaatatgaaccccttaaaggttctgcagaatctgcttgcatgatgtagatacagaatttcccaagggcaaaggtcagccctacctgacatctcaaaaacacgttagttccatgttcagtcatcttgagaaaaaaagaaggcctacaggctcttcacagctgaccctagctccttcgctgcccctctgctctgcttagaggagcgccaaactacactggggtcatgttgtatttgcacgggacttaaatttaattgtaagggcaatcatgacaagaaccaaaacagattttttaaagaagatttaatagttgatatggtttggatgtgtgcctgtgcccaaatctcatgttgaattgtaatccccagtgttggaggtggggcctgttgggaggtgattggatcctgagggtggtttctcatgaatggtttagcaccatccggttggtgctgtcctcatgacagtgagtgagttctcgtgaattctggttgtttgaaagcgtgtggcacctcctccctccccagccttgttcctgctctggccatgtgatgtgcctgctcccccttcaccttcggccatgattgtaagtttcctgaggcctccccagaagccgagcagatgccagcaccctgcttcctgtacagcctccagaaccatgagccaattaaacgtattttctttataaattgcccagtgtcaggtatttctgtttagcaatgcaagaatggacaaatacaataattaaacggtaaggggattattttgcctgccattccactccaagtatctaatttagaaggcaatgtttctagaagtgtgaggactggatttgtcttcagaaagcattttactcttccattagaagcttttgctgcattcaaaatccagttgagtctatgcacttgagctgtccagtcaaccaccactcttaaaaggttgaatgtttttatttgaatcgactcacaaggcctctgcgaattttgtttgaagtttttgcaggtcctacacttgggtaagtggatgcctttatcactcagtcccttggagttcctcctcttcctactgctgggtttatcaggcactagaacatcccaaacaatgattctcagtcttggttgcacattggaatcacctgtggggctgctacgccaatgccaagagtatcacccccacaggctcagagttaatgctctggaaggcagccagagcatgtggattgagttttaggtccctcccaggtgattctgattgggcagccagggtcgagaaccactgataaatatgtgtcttaacataatttgaaggggttcaatttggattctgcttttctgtcaacctttccatagcaggaagggagatttctggtaatcttttccatggagtgacctaattaatctccacccaaaggtaaatggtgcgggcagcattgacagtgtctgttgtgttcagccgaactgggctgccttggttagattagccttgacagaatctccaggtgacaaacacagcaaatgctgtttgtttcctttgagtctttcaggaacagagcacagcctcatgcccagagttccagctctgagatgcggatgggggcagaggaagaagctgcagcgcattctctcaaggtctcatcaatggcgccttcttgcctgccttctcctactgttgctacatagaaagcgtaatttccttctgatggataagacaatcagagatgcagattgtattaataacaggttgaaagcgtaggctttgtttataataaaaatagcatatgggccatgcctgtaatcccagcactttggggggccgaggcaggaagatcgcctgaggtcaggaattcgagaccagcctggccaacatggtgaagccctgtctctattaaaaatatatataaaaattagccgggcgtggtggcgcatgcctgtagtcccagctactctggaggctgaggcaggagaatcgcttgaatctgggagacagaggttgcagtgagccaagatcgcgccattgcaccccagcctgggtgacagagtgagactccatctcaaaaaaaatatgtaccatatgattttgcttgtgagtaaataaagacattatattaggaaattagtttgtatttttactaatcattaatacatattttgatttactgagataattcatcaagtataaaacataagcatcaaacatctaacttcatatttaagcaatcaagtgtagtattttgggggcgggatcataggagagtatatttctaacaccagaaagcccttcgataaggtctcacatttatgcataaataactcctccagctccactttccattctcagaaagtggaaggctgaatttccaggagaatttcttaaggatgcctgtgaagaaatcagtcagagttcagtgaaaatggttaatttctgtcacttttttattggagagtttttcggggctgggagtattttaagagcctcttatgttctactttttaaaacatctgtttaaataaatttttctgtcccacttcctcatccaatttgaaaaattcagattctgcacgaacctttgggaacacagaggccaatgttccaactttggccgtagcccaaggttgctggttctctggtgaatgttaaactcaggccctgcttcccatgtcctggtgggtgttaaaaatcacatggtccatttttctccttaccaagtactctgttgagctctacctgttgtcacaacaacaacaacaaacaacaaattctccaccaaaattctaggcaggagcttttccatttatcccaacagttttctgattaatcagtgtttactttagtgtgaaaactgctgtaatcagagcttgaaatataagagtttggaaaatgggaaagaataagatgggaaagaaactgaactttcttcttgattgccgtcacaattaaaacacccactaccctttaagcctgaactgggatatgaggaagtttgggagccaatgatgagtaataacattgatttgaccattccttcccctacctcagaactgagtatgcacctacaaaatccaaagaaatgcttttaaaacctaatgaaaaagggagatcctgtaaagttacaaacaatccagaaactagtgaggccatcattctatttgaacacttatgcatccgtccaacacatgtgaaatatttttctgagtcttttaaattgcaagcacaggagtctgaggcaggagaatctcttgaaccccggaggcggaggttgcagtaagccaagatgttgccattgcactccagcctgggcaacagagcaagactccatctcaaataaataaataaataaataagtattcaactttatattgctatcctaaaatataaaggggaacatttgaaacactctcataattcacgtcttttgtgaatgttagaatcattatcagtgatgctaggaacatgctcgttagatccgaagtccttcagaatttgctttcccatagcagagctgtgccccagttctctggcgataaaaaggcgacagaggtgtgtctgtgctgttcttctttcagaattgcattttctgaacatccagttacttcactgatcaatgaatgcctcaaacatgtaccaagagataaattccccttttggggttgttttggagtcctgccaagggattcaggtgttcatctggtattagtgaattcaggggccgatttgcttattaactgattaataagctctgcaatagtatcctaggcaaactattctagaaagcatcccctctgtattaaaagttttaaaaaaaataaatttaaggggtgaaaatgcagttttattgcatggctatgttgcatagtggtgaagtctgggcttttctttttttatttttactttcttgagatggagtctcactctgttgcccaggctggagcatagtggcgccatctcagctcactagaacctccgcctccaggttcaagtgattctcctgcctcagtcccccgagtagctgggattacaggcatataccaccatgcctggctaatttttgtatttttagtagagatacggtttcgccatgttggccaggctggtctcgaactcctgatctcaggtgtgcacccacctcagcctcccaaagtgctgggactacaggtgtgagttaccatgtctggtctgggctttcagtgtaaccatcaccaagtagtgtacattgtacccattaagtaatctctcctccctcaccacctcccaccctacgtagtctccagtgtctcttatttcatactctgtgtccatgtgtatacattgtttagctcccacttataagtgagaacatgaattatttaactttgtttaaaagctttttttaaaaaaaattggtggtagggaaggggacatgtgttttaaacggaatacattaactaatccgatataaacaaattgttaaaaggtttttggctttggttttgttttaatttttttttcttcttttgaggcagagtctcgccgtgtcacccaggctggagtgtagtggcgcaatctcggctcactgcaacctccacctcccaggttcaagtgattctactgcctcagcctcccgaatagctgggaatacaggcacccgccaccacgcccagctaatttttgtatttttagtagagatgaggtttcaccatgttggccaggctgctcttgaacttctgacctcaggtgacccacccgcctcggcctcccataatgttgagattacaggtatgagccaccttgtccggcctctgtttttgttttatcagtaaacctgcctttagagtgaaaagcatattcattagaagctaagacagtttgcttttataactgatgcttctttttgacagccacaatgttttcagggagctttgtgacattgtatcttgtgtacttgaccttgatttctgacaccaaaaccctgtcaggtttaatttaagatgatctaaaactgatgtaaaatatcttttatgtttaactgcgtattttatctaaatcaaattttaaaataatggcactttctctttttaaaaaaatggcatctgtaattagaagtaaagatatgggctggtttgtgtaacttggccctttatatgacctggttaggaagttatttgcttctgtgtgtgggtacacaattcattaaagataagaagatgactgatttttctaaattttcttttaagaaaacaccactagtgttctaatcatttgcatagttaagttgtggttgattgtaaaaaggttgatgataacaggaataactctgcatgtattttgagtgcctctaagttagctgccttccttttatcctgaaggcagtagaagtggttgaaagatggcatgtgggagaccattatgacagaccagtggcagcccctagttctccccaaggctctgaactcccgatcccacccactgtatctctgctttgtgttgatctagaatgtcttcccaggtaagttgtgtagagacttgcctttgctttggggttttatcatcatgatggtcattatttggattcactgatgtgtggagccctccacaatgttagtaattactccaaatgagaaagtttttcttccaaaggtcaagttagctcttggtatactagaaagggacaacagctggcttgaagtgaaattcctgccctgtcatttttatcctcaacagttttgggtggctccccaaaactctcagtgtttttattcccttcctccattgagggctatgttggctcctggtgatattacaaaatttaaacgtgtgagtaacctaccttcagaagtgaaaaatcacattctgctgtgtcctgaacaggctacctttttcaccaaagcttcttttattgggcttcctagttaataagacactgcattaagtacaatgttatacataatatgtcaatataagctgttttacttcatataatacaagagttcttttcagacatattaaaaaagtatgaggatatggccaggcatggtggctcacacttgtaatcctaatgctttgggaggctgaggcaggtggattgcttcagcccaggagttcaagaccagcctgggcagcatggcaatatcctgtttctacaaaaaatataaaaattatctgagtgtggtgtgcatctgtagtcccagctactcaagtggctgagatgggagaatcacctgagcctggggatgtcgaggctgcagtgagccatgattacaccactgcactccagcctgggtgacagagtgatactctgtctcaaaaaaaaaaaaaaaaaaaaaaaaaaaaaaaaaagaaaagtaccaggataagcaccagaaatacacatacatacacatacacagacttgcagtgaagaacctgtgtcctccaatgtgtgtggcttccaggtgcgtcctcaccctcttcctgctgatgatacctcttttttggcactttatacctatttttgaaacaatgaattaatgggtggcccctcgctccctatttttgaaacaatgaattaatgggtggcccctcgctccctatttttgaaacaatgaattaatgggtggccccttgctccctatttttgaatgaatgaatgaatgaatgagcggcccctccctgaaacgtgggcatccgcatctcctgcactcctacacatctccacaccataagaacaagcatctatgggcaggaaagtcctcacagagagctcaggtcggaagggcaggaagatgaggaagaattcccatgatatttttcaggttgcttgatttctgttaaatttggcgatgagagggttaaatgattggaggacgattttccctaaccaacgtgccatttctgtgattcctccactctctcactagcagagaaaggtccaaactgcaccaggcacttggctggctctggctgttcacacgtctgagtccagccaacagtgggctctgtgttaagggaaatcaagagcctgttcttttcaaccacgatcctcactttcccatctttaagagacaggttgtcattattgttgtaagagatgttttgattttatatatttggccagagattactcttgtcactgtccacaaaggtgtaacttgatgtccttcctaacccccatgccaggtcaagacctgtgttacattcccctgccccctaccgccccccacccccaatggggtctcactcttttgcccaggctggagtgcagtggtgccatctcagcttactgcaacctccgcctcctagattcaagtgattctcccaccttagcttcccgagtagccaggactacaggtgcacaccaccacacccatctaatttttgtatttttagtggagatgtggtttcaccatgttggccaggctggtctcgaactcctggcctcaagtgatcagctgccttggcctcccaaagtgctgggattacaggtgtgagccaccatgcccggctgacctgtgttactttgattatgaacacccatctatgacagttttgcttccctgcctccaagtgagtggtatctctgccactagaggttgatatgaatgactgataatgccaaataataattttcacctaggaaacttagacaaggagacctaacccatagcaatagtagacatttgataaatatttgttatacgaatgaaatgaatagcacaagctaagagtgctttctaaagattgggcccaagagaagacaaaatgggcaactagtctgatattacaaagcttcgaggatttaatggtccattgccttgtgaaggagatccttgagtaaaggtttcctggagacctctaagtcttcagtgactctctgcttgcgggtcatgtaccacctgcccctgttagttcccatctctccccatagtgtgaaactctgttacatggctgtctcttcctgctctgggtttttttttttttttttttttttgtgagacagggtcttgctgcgttgcctgggttgagtgcagtggcatgatcatggctcactgcaacctcgacctcccaggcttaagcaatcctcccacttcagcctcctaactgggactacaggtgcacacccccaggcctggctaattttttatttttttgtaaagatggggtctccctatgttgcccaggctggtcttgaactcctagacacaagtgatcctcctaccttggccttccaaagtgttgggattactgacgtgagccacagaaactggcaccagctcactcttgaattcctcaagagcaatgctgtattcctgtctgtttcctccagctctcagacaaaggcaatgcataaacaaacaaacaaataccttttgaattccagatgaacaccattagaaatctcaagttattataacatagttttggcattttaagggcggggaacccaatagcagatcaacagcctctcttttactatttttgcaagccttgtggtttttggcagcagtggctgcccggctctgccgcatgctcattcagcttcaaccacagtgacctcctttcttttggtccctgtattcacaatgctccttcaagcccaggacttttccacatgctcctctctctgcttccctttcctctttgcctgcccacgtctttcttgtcctccactagaatggaagatctatgaaggccaaggtctatgcctacttttccccacctttgtagctgcagtgcctgacatagatgcaggccagtttgccaaaagcctatccactgaagaactcattcctggggcaaaggaatgtgatttttttatgagcccatgcagttgaccttaaggccacattctggcctttcttgaacgtgtctctcgcagtgtccagcctcatttcctctccctattggattgtggtttcctgcttctcccaggcctcactgtcatctcacatcctccatctgcctgaacgtcctgaaactgatttcctttgtactcataaatagctaacttcatttatttgtcttaaataagaaatctgggctgggcgcagtggctcatgcctgtaatcccagcactttgggaggccgaggtgggcggatcacaaggacaggagatcgagactatcctggctaacacggtgaaaccccgtctccactaaaaatacaaaaaattagccgggcgtggtggcagacgcctgtagtcccagctacttgggaggctgaggcaggagaatggcgtgaacccgggaggcggagcttgcagtgagccgagatcgcaccactgcactctagcctgggggacagagtgagactctgtctcaaaaaaaaaaaaaaaaaaaaaaatctgatattatagaagactttctttgacaccttctttttccacccacccacccttgggttagatactctttccagtgtacctgtaatgcccagtatccttcgtattacattataattcttaatttatgcatctctcccacttcagaccaagagttctttgatggggaatcatgtcgggtttacctctgcatcccttcgggctcaataaacgtgaagtcaatgatattaagacgctgtgtgaagacaatattatgaacccaaaggtatctgagagattcatctaggtggtagtatccacaacctcagaggacgtgctcagctgttctcccatgggatagaattttgcctccttgactatgggactgtgatatcgggcaaaaagcaacaggggtccacatggccatgtttgtctttttccaaagaaatatttggccattggaaatattgcttctgagttgcaagataaccaaaaagcctggcatggggccctaaacttagtttgggaagcttgggattggccatgcttagctcttgggatgtgtttgttgagctgcaaatgtacccttccaggaaaagttaagtctgtgacaatgacttctcaagcagagacaccagacagctgttttagaatccctgagggccaaaaaaaaaaagtgctgaagggaacaatggcttgcttatgaactaggagagatattcaatagataatacccttttcatcaaccaagttttaaagaaattgaggataagaccaaacagcaaacaataaggtgaccaaaatgtattgtggttaatgctgaagtatagagagcatggctcataactggagtgaggacttgtcctaaacccagaatgtggtggacttagctataaggtcatcatgtgttcgggaagactcaggcctcacccagcagggcagtcctgtaatgacctggaagagtggtgcgaaagagaggaaggggcagaggccaggagtgtcatgcaattgctgtgcctcctcacggaattattgagtgtgtcccctgtgtcatagacccatcacagttgtctcttccagtacttcgtgagctccctaagggcagggactgtgtatacttctgggcgctaaaatgagtgtgaatccatgtcaggcactctgtgccagtctttattggaaatatatgattttatcttaaatagttcttcaatgtaggtactatcacttgccctgactttagagatacaggcactaaggtttgtggaggtaaataactttcccaagatcacacaagtagcagatgtcagagtgggaaactgagcccaggaggcctgacgtcccaggcagagctgctaactattgttctgtatgcttcttgatgggtgattcaaggccttgtgtagtgttagggtatcatttaatgatctgattatgaaagtgctaaatgaggtgattgggggattctctgtcttggattctctattcctggccttttataaattcctttgtccctggctgggatccagctggcttacacaactgtcagtgtaatctctatcaatatttacacaaggggtcatgccatcaaagaaactagagaaatatcaggattagtgctttcactggataaagtttgaggattgaagaaccttctgttgagtggatttgaaatagttgcatggaaaatatttttttattttccttgaagagaagtaaacaagccagagattatttcaaatttattttgctaattgaaacaaagcatgacagtgaccttcgaaccagtgccagtaaaaatcaaataaaatctggatagtatattctgagagtggtctaaatgggatgccttttagcgggggtttgttcaaatgcttaaatttttaaaaagaacgaggtaaagctatgtttattgatataaaaagattatcaatctataacaggcatgagagaagtgaggtatagaaagaagttgatgtgtttatgaatatccctttgtgtgtgtatgagatacctttgataaagaatacataaatagttacagatatgttattttctcaagaaataagaaactgtaaaaatgattacctttgaatggagtgggaaaagataatttccctgttaatttttctgttcaatttactttttaaaatgtggatagagattatttctgcagaataagattatctctgcagaggtaagtcatcttaattttcttctttttacttctgtttattaaaacattaaacataaaaaacccaaatgctacattttaattaaaaataaatattagcagtttaaaattaagatatgagtagtaactttgagaagagtgactaaaactcctctagtccctttaacactgacttcaaatccacatgaagttatcctgggggtgtggagtgtataatttatgttattacagatttttgttaaataaatcgtatgtttgtgttctggaaatatttttgtgtacatgcctgtgcttctgggtctggatttgtatggttggaaggaaacactgggcaaagtgagggggacagtgggggacagtgggggccaagcaggcagtgggggctctgtcacctcgagccatttccttcttagaaagcttgagggaggctccaaggtagggccgggaggcagccaatacggagcccatggcggcacaggcatgaggttattcattcatcaaacagttatcgagggtctaccttctgcctttggggagtatctgtaacattttgtgccaaattagaggccttctggttgactggacccttaaaacacaagttccaagttcattttgattgcttctccaggcctccatgtaaattacattagtcacatcagcagctcactgaggctgcaggaataggccattttgttgacagaggcagacatggaggtggggatagatgtggaggaggagagagtggggccagaagacaggcctctggtgagtgagggctgtgagggcgtgtggtctgtgcccacttgggattctgcctggattatgttacagatttcaactcctttcgcctgcaagctgttcagactcccagatttgctcatgagtttggtttcattcagatgcgaaaaacacaagaggaaaaagggggatgcgtacattgtctctcctatctttgcaggacacacacatgtgttacgcttcccattctccaactcagtgaggaataggcctcatccctagagcctttaattgcaggaagctgaagaatgggacccatagggagcagagctgtcctctgttttctatgcaggtttaggaaccctttgactgacactcttggagtctaagagcaaggtgtatcccagggagcaaagtgggaattgaaattgtacctttatggctaattagctgtgtaacccagaagaacttgaccagatgatctttagcttctgaactatagggggaatggaggagctgtcttagaattggagaataataaaatgaggacattctgggatttcataagatgatggtcactttgggaaggttctcttaacctctactcccctctgtattaaaaaaaaataaaaacttttttttttttttggaatgggaaaatgcatggtgccctataatccaggggcttgagatccaactctaactgggcaactctaatatggagagaaactggtgcctccctcacttagctagttctgagagcatctctcctcccccaccaagggctgggctgcttcatcacttatcaaatcatcttagactcataaatgtctccaggcaaccagcgtcttccctcttttcccctttctctgcatggaaactttccaacctaactccctacacatctgttctgggagctgcctcctaattatatcctaggggcctgatacgaaaagggccaaagggaacattccatcacttctcccaggggcatcttgggtcgggggtggaggcttgctccttggtgagatggccagaggccattaactgggaaccaaacctaactgccacagtacccatctgagggcaggaaggactgtggggtactcccatcatgttcaggctcatctgtttaatgcttcttccttaatattgaaatagagtcctcactgcaactcatctctactaaaaaatacaaaaattagccgggcatggtggcgggtgcctttaattccagctactcaggagctgaggtgggagaatcgcttgaacccaggaggtggaggttgcagtgagccgagattgcaccactgcagtccagcctgggtgacagagcaagactgtctcaaaaataataaaataaagtgtgcaacgtccatatactggaatattattcaataataagcgctgacacaagctacaacatgcatgaaccttggaaacctgtgttaaatgaaagaagccagtcacataagaccagatattgtatagtcccattgatctgaaatttccagaacaggcaaatcaatagagagaaaaagaagactggtgagtgtctagagctgggggagttggaaggcaatgagggttgactgctaatggatatatggtttcttctgaggatgattgaaaatgctctaaaaattattttgatggttgcacagccctgtgaatatactaaaaataattgaattgtagactttaaattgtaaatacgaaaagtgaattctatcacaagaaaactgttattaaaaaacaaagactactacgtagtgatgtgtcgttcccactagacactttaagaggcattttatgccagtttgccccactgttgttgacgctaagttttgatcactgggataatttggtttccactggatcttgtcattgcattaggttggtgcaaaagtaattgccgtttttgtcattactttcaatgacaaaaaccgcgattactttctcaccaacctatacaagaatctttgtcttgtgattaataagtaatatgaagggtgacattcaccactctctgcacatcctgttctccacccattagcatccactggtgatccttgccagtaagatctattacataaatgggtacaatatagtaattttaaaaatgatcagattttttacatttatctagtaattttctggagggaacgtattccttctccctctttttagaaaactcactgggtctcaaaaaattaaacatagcattatcacttttgggtgtaaacccaaaataatttggaaacagggtctcaaagagctttttacatacccatgttcatagcaacattattcacaatagccaaatggtgtaaacaacccacatgcccgtcagtggatgaatgggtaaacaaaatgtggtatatacatgcaatggaatatgattcggcctcaaaaagaaatgaaattctgacacataccacagcatggatgaactttgaaagtatgctcagtgatgtaagccagacagaaaaaggcaaatattatatgattccccttatatgaggtacctagtgtagttaaattcatagagacagaaagtagaatggtggatggcagggactgagcgtggggaggggccaatggggagttcttaccaaatgagtacagagtttcagtttgcagtgatgaaaaagttctggagagggatggtggtgatggttgcatgacaacgtgaatgtattaatgccctaaactgtacacttaaaaatagttaaactttatgttaggtattttttactgcaaaaaaaataccctcactaagttcttatttcttccttttcattttagtatgttaccagaaattatactccttgatgctggaaattggccaataggagccccttcaagctacttctgcatccctccttatcctcccagtatattcttgttttctggcacaagatgtttaaggtcaacttttattttccctgacccagtcttggacacagccatttctccaaggaggcctggttcttctacaggggaactgtagtcagaaacaagatctggttgcttggggagcttgttgccatgtatttggttgttacatgcttctcaccctatcaatgaacagagctggggaaacataaacatacactcacgcacacatatatacacgtactgtggtagtgactagccccatgtggctgttcagaaataagatttccagcaagacatatacacaaacatgcatgcatacaaatgcatgcagacattttaatcagtcgtctccaattttaatccaacaccacctttgtccaccccacctcatcacagtccatatttctcttcttccatcgtgacagctctggttctcaagcatctcaacatatttgctcatttgttctgtccttcactaaataaaacaactcgtgtgatatatcataccaatgccacaaatcatttttttaaatgaaaggaacaaaatttactttttccgacacttagcaggtctaaatgcattttctagatgtattttctttcttagtgggtagaaagggtgggattgaggcaatggtggaagtagtgactgcagtagagaattaagaaatacagaggggatgatagagaatgagagagagcagggaagcggacagagtagtggagagtttcttcaacattgaaaactttcacatgactaaacccactaataagagtgagctgaggccaggcacagtggctcacgcctgtaatcccagcactttgggaggccgaggcgggtggatcacctgaggtcaggagtttgagaccagcctggccaatatgataacactttctctactgaaaatataaaaagttagctgggcatggtggtgggcgcagtgatgagtgcctgtaatcccagctactcgggaggctgaggtaagagaattgcttaggaggtggagattgcagtgagccaagattgcaccactggactccagtggactctgtcagttgggtgacagagcaagactacatcttgaaaaaaagagtgagctggacaagaggtagaaattaggaaaagaggagccgttaaaaacaaacggctgtttttctgattattggagtaatgctttgtgtgtttatttaagaaatagcatacaaggttagactcaatgaaaacagagggaaatacagctgtttttttatgaattccaataagatttgtgatgctcgggggttcagttgctgttcttggctttgacggtgacattttctcagccatggcattggatccagcatccatgctctacatgtttgttcttaaaaatgaggattgattgatttatttttaaaaggttttcctgcctttggaagggaaccaagtatctttcaagttggggaaataacttccttttgagacctgacctcttcctcaccccaacgagccatttggacttttatgtaggaattgggtaagcatattgaagcaagagattctttctcttcattatttaactcccaaacaagctgagtattttcctgctctgaagtgttctgacttttaaaagagatggtgagatggaggcaaaggcatgttgaaattagtgtcctaaaacctaggctgtagttgtggcctgaagacttactagctgtgtgactagagatatcttgtggctctgaacttactttcaactgggaaatgtggataaaatctgctatgttctttatccctttagaatttttatcctgtacacttccaaataagatttccagtgacttataagaggcaagatatctcaaaccattctgataatgtgaggataagtgattaagagtcctgggataggtggaggaaattaatggtatcagaaacccaaatgaaaggtagttgctgcaaatgagcactaatttgttttctaactctttgctgtccaatatggtagtgactagccccatgtggctgttcagtctttgaaatgtggatggtttgaatcaagatgtgctgtgagtgtgaaatacacactggatttcaaagacttagtataaataacataaaatatctcatgaaatttttttttttcgagatggagtctcgctctgttgacagggtggagtgtagtggcctgatctcggctcactgcaacctccgcctcctgggttcaagcagttctcctgcttcagcctcccaagtagctgggactacagacatgtgccaccaagcccagctaatttttgtatttttagtagagatgtggtttcaccacactggccagaatgacctcgatctcttgacctcatgatctgcccacctcggtctcccaaagtgctgggattacaggcatgagccactgcgcccggcctctcatgaataattttttacattgattgcatgttgaaatgatgatgttttggatctattgacttaaaatattttattaaaattagtttctcatttctttttttttttttttttaagagacagggtctcactctgttggttaagctggagtgcggtggtgtgatcataacccactgcaacctcaacctcctgagctcaagcaatcctcccacctcagcctcccaagtaggtagtactacaggcatgcaccaccatgcctggctaattttatttgttgatttaattattttttttttgtagaggatggggtctctctgtgtggtccagactaatcttgaactcctggcctcaagtgatcctcccacctcggccttccaaagtgctgagcttacttacaggcatgagccaccatacccagcctctttttacatttttaatggctactaaaaagttttaaatttcataagtggctctcatatttctatcagatagtgctggtctaacctattttcacccaaggccccctgccaaccaaaaaaaggaaaatatatttatcatgcacctgttacctgattaaaagaagggtgctgtcccatgcatttatatagagtcacatacttcaaagctttatataaaaataaggcagaaatgatggtgccttgctacagctgtagtccttcctctctgctggaaaaccacatcttggtttatgtccttctttgtcacatcggaaaatttctgaaatttctgactagcaaacagcatgcgactcaaaatctgctaattaattcctccttagttcgttcattcattcacccatgcatttattcatttcctgagttttgttcagacactgctgtgtcctcaagaacaaaaatgaattacgactcatcctgccatgaaggacttccagtctgcagggaaatggaggagagagtcagccacatagactggtaatttacaatacagcaccatgaataccagtctggagcactgtgcaaagtgtaaccgggaagggagaaaggcaactaattctggcttgactttgtggtaattcataatttgattattcatgccgttattcaaagagcctttgccaagtttatttaaagagattgaaagataacaaatgcagacattaaaaatagtttcttattcagcctatgctttcaaaagtgctgtattataaatatatattatttattcaccaggctgtttctacttaggctctcaaatttagtctgtccactaaactgtatccttggccagacttactctctgtaaaagcagatatgggttatttattcatcagttctccagttgaaattcatatctctaattctacattctcccaggcaagggggagtacaaatgattagggactttcaactttggaagatgcagtgaattacaatttaaagtcaactagaggccgggcacggtggctcatatgcctgtaatcccagcactttgggaggccgaggcgggtggatcatgaggtcaggagattgagaccatcctgcccaacgtgatgaaaccccgtctctactaaaaatacaaaaattatccaggtgtggtggtgcacacctgtagtcccagctactcaggaggctgaggcaggagaatcgcttgaacccaggaggcagaggttgcagtgaactgagatcatgccactgcactccagcctgggcaacagagcaagactctgtctccaaaaaaaaaaaaaaaaaaaaaaaagtcggccagacttctagaaccatggctcaacagagtccatggcttccccaacggaggatgcagccagttggaatgaatgtggacttgtttctctctctctctctctctctctttttttttttttaaagaaagggagatcatattttttcaggccatttcttttggtgaggaacaggctgataactgggttatggtaatgagtcttctaggagcttttccttcttcaaacatttctggcttttggccttcagaagagtgtcctgggtggtgttatgagcttgccctgcaggctaaatccctgtagacagcagattccctatgagagcaggtcttgtgaaatgaagatctggtttgtatagtctcaagcaagagatcaaatatttaaggcttagaaaaaaagatcgcgtttataagggcccttgaaaagaatttctgatggaagttggtgaaaaagatttgtttccattactcatagcttaagttggctatgatggcagttatttaaattctcactgctgagatggaaacttaacaaaagtaggcgataaagcctgttggaataggtaatttggggacagtataagtagagaggtgatagggtctcactggaggccactttgcttccctgtttttaaacacattccatctgttgcattcttccttagaatcctgaaatttggggtcaggcaccgtggctcacacctgcaatcctagcactttggaggctgaggcaggtggatcacttgaggtcaggagttcaaaaccagcctggccaacatggtgaaaccccatctctactacaaatatattacggtgaaaccccgtttctagtgaaaatacaaaaaaattagctgggtgtggtggcaggcacctgtaatcctagctattcaggagggtgaggcttgaactcggtgggtggaggctgcagtgagccgagatcacaccactgcactccagcctgggccacagagcaagagcaagactctgtctcaaaaaaaaaaaaaaaatcctgaaatttgatgtaaatttctttgtgtacttaggtattagttgtatttccatagagcatttgagcatttttagaaatcagtgcaagcacagggctcacattcatgcaaaggaatgggaagtttggggagggagagaaatgaacatcacgtagtttctgaagtcatttttcatttagcaagttcctccatacttctatgggaagctcagttgaagtttttgaaatcactggcatttgtacatcattggttcattatgaaagcatttattgggtgcctctctcatctaggatctttaccttttacatctttatctcttcctcaaataccttgaggatcagcccataaagactgatgtgcattacaactgccctgcagtgggcaccgttgatcacccatgaggactggtgttcagaacaggtcatgtcctatttgagaattaaaaagatatgggaacccccatttctggaaacatagagtaggcatacttttccagattccttctgctaagtacaactaaaaatccttgacattatatttaaaacacacataagaagactctgaagggtggaaagaataaggaagatgagcagggacctcagggcccaaggaaggacacggtgttgagttgcctgggtttccttattgcctcatatattccagactctgagctaaagatgccagtgactggaaacagcaaggggcacagacaaaaaagctccaacaaaggcctgctccctgagaccgaagcaccaagaaaggacaagctagaagacagacaaagtttaagcaatagccaccctgctttagccaaacaccaagaaaaacactgtggccccacccacacccatgccagcaaagactcagcaaagactcagagggaagtctagcctcccactctcacccaaccccccttcttgggcagtgtcagagaaagctgagactcacattcccacgaagaggtaccaagagatctctccctctcctgctgggttgctgtcacaggaggcctagtggagaggcaggactttcagcactggacaacattaacaaggccaccccaaccgtggcacagggaaagatcacatggggagcagcaatgaggctctcctacctctcccagcagggaggtctcagtggaggccagggggaaccagatctcccaaccgtcacccagcaggatcgaggagcccctgtagtatagcaaggtggctcccctccccgacttcccctgccagagcagggtcagagtaagaccactaaaacagaataagattcagtctcataatattcaaaatgtctgagtcaatggaaagtgactataccaagtatcaggaagatctcaaactgaatgacaaggacaatcgagatatgccagtcacaaggtggcagggatgttagtattgtctgacaaagattttaaagctgccatgataatgtttcaatgagcaattataaacaggttagaaacaggaaaaaatagtctcaacaaagaaataagacatatagagaggaacaaaatggaaattttagaattaaaaaatataaccaaaacaatatactcaatggattggctgagcaacagaacatagagagacagagaaagaatcagtgagctggaagacagattagaaattatccaatctgggctgggcacggtggctcacgcctgtaatcccagcactttgggaggctgaggcaggtggatcacgaagtcaagagatcgaccatcctggccaacatggtgaaaccccatctctactaaaaatacataaactagctgggtgtggtggtgtgtgcttgtagtcccaaatactcgggaggctgaggcaggagaatggggtgaacccgggaggcggagcttgcagtgagccgagatcatgccactgcactccaacccgggtgacagagcaagactccatctcaaaaaaaaaaaaaaagaaattatccaatctgaacaacaaagaaaaagtcaactttaagattatatcaaaaggacggaaagacaagctacaaacttggagaaaatatttccaagccatatatccaacaaagagctagatctatatttttaaaatttcaaaaaaatcagttataaaaaactgatccaattagaaaatggccaaaagacatgaagaggcatttcggtgaagaagatatacagatggcaaatccatgaaatgatcctcaatatcattcattagctattaggaaaatgaaaattaaaatcacaatgaggtattactctatacctatcagaatgattaaaagaaaaaacaatgacaacaccaaatgctgggggtaatgtggaggaactaaaccattcatgttgctggcaggaatgtaaaatggtacagccactctgggagacagttggcagtttcttatattaagagtgcagctgggcgtggtggctcacacctgtaatcccagcactttgggaggctgaggcaggtggatcacttgagatcaggagtttgaaaccagcctggccaacatggtgaaaccccatctctactaaaaatataaaaattagctgagtgtggtggcgcatgcctgtagtcccagttatttgggaggctgaggcaggagaattacttcaacccgggaggcggaggttgcagtgagccaagattgtgccactgcactccagcctggtgacagagcgagattctgtctcaaaaaaaaaaaaagagttcaactaccatacaacccagctactcctggccatttgtcccagagaagtaaaaactatattcacacaaaaacctgtacacaaatgtttatagccactttatttgtaatagccaaaaactgggaacaccttgagtatcttatgcctttgttaccactcagcaataaatgagaataaactatttacacatgcaacaacctggatgaatcttcagagacttatgctaagtgaataaagccaatcccacaaggttacatactatatgatttcatttgtatatatttggaacagcaaaattacagaaagggagaatagattagtggttgccaggagttaaggactcagtggggatggggatgggagggaagtggttatggctgtagagcaacatgaaggattctgtggtggcagaaatgttctatatcttgactgtactcatgtcaatgtcctggttttgatgttgtaatgtagcttggtagtatgttaccattggaggaaattgggtaaatgttatacaagatctctctgtactatttttttacaacctcatgtgaatcttcaattatatcaaagagttaaaatttaaaaatagttatatattctttgcctaggtaagttcattcccaaaatttcaccttattggccgggcacagtggctcacgcctgtaatcccagcactctgggaggctgaggcaggtggatcccctgaggtcagaagttcaagaccagcctgatcactatggtcaaaccccgtctctactgaaaaaaagtagccaggagtggtggtgcatgcctgtaatcccagctacttgggaggctgaggcacgagaattgcttgaacccaggaggtggaggttgcagtgagctgagatcgtgccattgcactccagcctgagcaacaagagtgaaactccgtttcaaaaaaaaaaaaagaaaagaaattatcagaaatttgcaccaagatcccaaatcctaaatatttaacaggggaaggttaaattatgaaactcccatgtgtttaaatgctatatagtcctcagaaagaatcatatttcagggtattcattttactgtttttatccttatttatttatttatttatttattttttgagacagtcttgccctgtcacctaggctggagtgcagtggcatgatctcggcccactgcaacctctgccttccaggttctagcgattctcctgcctcagcctcctgagtagctgggactacaggagcgcgccaccatgcccggctaatttttgtatttttagtagagacggggtttcccatgttggccaggctagtcttgaactcctggcctcagctgatccacccccctcagcctcccaaaatgctgggattacaggcatgagccactgtgcccggccattcttttaaatgtttatatatgctatgtggcctttttgtatgtatacctaactttacagtagataaagaagccaaaattttgaagtctttttataatatgctaagatgtacacaatgtagatggaaaaggtaccatattcaattctttgcaatatggtcatcagttttttttttttttgaagcaatttgtaaactatgaagtactaaagatttaccaacagtgatgaatctggtggcagtaaagttcccatatttcttaatcattctgctgttattttccagaattctacagtgaactttcataatcaggaaaaatgaaatgagcttttgagatcaagaagaattacaaatgttagttaaataaacagtggtttgaagggggtgcttaaaggtggcaaggctaaagggttatgaggaaccacatggctaaattacttagcctttccttaataccatcttacgtttctaatgtttgtggaattctccacatagtagcatttttcccattgttctcccaaatctggaacatgcttgacattggctccccaccccacatatcaggccaagtgtcagaaaattccactcatgtaattcctcacagctgttagcatttcttaaccagtgtgtggatttagctggatacttttatgcccaggaacctttatagaatggaaaggtgaaggagtacagaggcagacacccactgcctggggtgtaggttttttcatcacattacccaaacacccacaccccgcaaagccaggagggctggagaagcccatcggtggctccgaaaatggtcatcacacagtgggtaaagccaaactcatggcatcctcagcggggggagatctgggggctagaagatcaaaatcaagaccgactgattggatggcgttctctcaagagccatgaactactaatgaaaatcttgtctaagtgcgtcctgtgcccactgtgtgccaggcatcatgttgagcactagaatgcacattaaatcacacaatccctactataaccctaggagatggctcttaggagccatccatccattcactatgtagtatattgagtagctcctacgggcttggccctattcaaagcatgttattaaattagtgaataaaacagacccaaattcttgccctggtgcagcttgttttctttttcttttttttctttttttttttttttgagacagacttttgctcttgttgcccagactggagtgcaatggtgcgatctcggctcactgcaacttctgcctcctgggttcaagtgattctcccacctcagcctcccaagtagctgggattacaggcctgcaccatcacccccgactaattttgtatttttagcagaggcggagtttctccattttggtcaggctagtcttgaactcctgacctcaggtgatccacccaccttggcttcccaaagtgctgggattacaggcgtgagccactgagcccgacacagcttgttttcatttgggttaatttacagatgagaaactaagaaacaaagaggtcagttaatttgcagtgacaagcaaatggcagtgcctggatttgaccctagatagctcaattttagaggctgaggactcagtcactatcataggagtatttccagatgcagcaatataagcattaatgctaagatggggtagtactggctactaatgtcatttatgctaattcgtgttgccaaatgagaattacacctggtagctgtttgtatgtcataaagtcataaagtttttaggtcataaagtcatatggtcataaagtacatatgtatataaatatgtatatgcatatgtatataaatatgtatatgcatatgtatataaatatgttagctcataaatatatttatgtttggtcagcttaattcattcagtatttattgaacacctgttacatgtcaggaacgtggtctccacgctcaggaagttcacagataagtggaaaaggcatcagtcagtaattattacatagttgtaaaatgcgccaatagtggtcagctcaaggtgccaaggaggaacagggaaggcacacagactcagccctgctaggtctgaagctcagggatgtggtgtcttcattttataggtaaatcaaaggtgtccatgagactcagtgtcctgagtggtcacattgctaggatctagaggaattatggctggaaacaggatatctgactgttggtctagtgtggtcaccatctccccagagatgcaatgtctggagtgtccatttccggcccagatcagcttctacacaaatggaagagccagaaggcagatcacatctagctctttgttttcttcaccttttgggttctagctggagttggggacaaggccagtaggctttgtgactcataccacctgcactccagtggagtcctgggtggagaattcttctaaggtatggaaaggacaaatggtctccgagcacctctgccgtggaggggagtgagaagtagaggatacagattccaaatcagaaaaacaagtgcccttctcaagacagtgattacattacctctggagggaaagaggaatacgagatggagggtggtggaggaaacttctatgtgatctacagacctaaagcaaatactgttcaatgttgttatctgacaaagcaggataatgggtacaaaagcatttgttatattcttctgtatacctttgtgtttgttcgaaatattccattaaaaacacaaagcataccatgagtgaagcataaaatttgattgatcccaacctccagtaagcactttactgattttcaataaccttgacctttcctgaagaggtacattgttaatctaaggtcgagttcaaatgtcacttcctccatgcagacatctctgattctccctcttggctgaaagaatgtacctaggaattcctgccatacagattagtgcttctttcttggcagatccagatcacagctctcctgtttcattgtcttgtttaactgtgcgcacctggcaacccacagccctggaccttgcagttagatgggagagccctctcccttccctcagccactcctatatctgggctacagaaggtgcttgtgccatctgaggagtttatgctgtccttaaaactttgtggatcttgagtctgaataaacagggcattgtagggcaaagctcttcttgaaggtacttagtaacaaggagttaaagaattcctattttatgtcctgtgaaaacttggctcttgtacttgaggcttgagatgaatcagtcaaggtggaagtaacctgggtagtgttaatacttcccccacatgggcagattacattaaaatttcctaaaagacaattgtttcagaaacagtacttttccactatcattatctgaaatgtcattatttgccaaaggaaggaaaaacagtaaattccttccctatttactcatcttcagagaatacagtaaaagtttccaaggacaatgtagacagactacctcccccggtgcatctcccagtgtggaacttgtcacggacatcactcctgcttctcttgggatccattccttacaagcaagtctagggcctccctgggatcatacacactctccattcctctcatgaaacattatcctctctgggaagaaagccgaccaattaaggaacatgattttacttgtttaatagagcaagtagcctttctttagtgtttggctaggttagctcagaacaacttgtttttaaagaaacagagcattaaaaaacaatggaagcccttagtatacactttttccttctcatttgcttccttctgtaaactatgtgtgtagtgaatttctcagggttcctgaaggcgtggagcattctggtttcttacttattataaaatgttttaagcatacagtaaactttagagaatgtaatcaataacctttgtacctatcactcaattttgtcaaaaccatttatccatatttgctatatagtcaaggtaatattaattgctgtcacaaaagtccatacatctcagcgctgcaacacaagagaagttcatttcttattcgtagaatgtccatgtacctggtctggcagctttccaccaaatggtcactcagggatccaggcgacattcttttttgtgcgtctgcccatattcaacatgttatctccaacttaccatggctaagagggctaattagccaagaagaaactcccagcaccaactctatactaaggtagatgagaaaaattcatcattagctagttagctactaactagctacatttcagggcttttttttttggaaaaagaggttttttcccccacaactcctctaaggcagcccattcgctgtgtagcagcctggcatcttacagagttcttcctttggtctaatctaagttagagatctatttcttcgtgtttgctcttgaaatgatgcaagagtttccaatattcataaaactcttggccaggcatggtggctcatgcctgtaatctcagcactttgggaggctgaggtgggtggatcacctgaggtcaggagttcaagaccagtctggccaacatggcaaaaccctgtcttcactaaaaatacaaaaattagctgagtgtggtggtgcacaccagtaatctcagttactcgggaggctgaggcaggagaatcacttgaaccctggagacagaggttgcagtgagccaggatcacactactgcactccagcctgggcagcaaagcgagactccatctcaaaaaacaaaacaaaacaaaacaaaacaaaacaaaacaaaacaaaaaccccacaactctttgcatatttgaaggccctttcttctctcattggttttcacctttaaaattaaatacttacagctcaatatttccttgtagatatgaatttccaactcttttaaaacaatttcccaagatgtattcctcatgtgggatttaactaaatgttaaatataaaatggccaaatatgtataagaaatacagtgttaaacaaagtcaaactggtcttttttctcaggacacttcagtacccttaatacactaacatgctttgtgagtttctggaagtcatttctgcagtgtttcccaattttttttttcaatcacaatacattttctttacttactttaaaagacagcaatgttccacatttcaataatatttgagaaagtttcaaaaccctctaataaccattaagtgaaaataaatttattgaagattaataatgaccacaaaatactatgaaatcattactgatgccttttgcattaataatatttggagcatagatggagaaaatatggaacagaatatggacatttgaaactatattttggccgggcacggtggctcacacctgtaatagcactttgggaggctggggtgggcagattgcctgagcttaggagttcgagaccagcatgggcaacgtggtgaaaccccgtctctactaaagattaaaaaaaattagccgggcatggtggtgtgtgcctgtaatccaagctacttgggaggctgagtcacgagaatcacttcaacccgggaggcggaggttgctgtgagccaagattgtgccactgcacttcagcctgggtgacagagtgagactctgtcaaaaacaaaaaacaaaaacaatgatattttatccagactttatctttttgttaaatcttgtgcactctagaagatatattcaagatggttgtaaagataattcagctaaagtcatacttcaaagatgttaaaaagccctccaccaatgatagggcattgcaaatccttccatcccatccgtttacaaaattaaaacaaataataacccaaagagcttttctcagaaaaagattcagttaaaaaaagagaacattgtcacagaattaatagtaaccagaataagaaatcagtataatcaagaaagatacataattattcaacataatttgatatggatagatcaatataactcactcaataagtggacactattgtgaggggagtgggtaacatgatccacagtcctgttcataaactcatatataatttatttcaatcaaactgtaaagtaaaagcactattaacgttataacattttacagtaatgtaaaaagcaaatcactgttggtactttatgatcagagtacacagtacagacaaaataggcaccttcattgtaattttttaaaatacataaaagcacattaacaaaaaaggaagataagcagcacctaaagcctttgacatttgtaactaaatgcccgtatccaaatggtctagctggagaagtttcactaaggaggcacaaaaaaggagccgtttttgacctaacattttcattctagtagagataagactttgtgtgggcttacagtccttcacctgatggtgagtagcataccaatccttcaaatgtcctatgccccacggtgcccccatacccacaccaccactgttagtgagtgccaggactgctggctccactgctgccatgttcctctgagcatctcccaaatatatatatatatatatattttttttttttttttttttttttcctgagacggagtcttgctctgtcacccaggctggagtgcagtggcatgatctcagctcactgcaacctccgcctcccaggttcaagcaattctcctgcctcagcctcccgagtagctgggattacaggtgtctgccaccatgcccggctaatttttgtatttttagctgagatggggttcattatgttggccaggctggtttccaactcctgacctcaagtgatctgcctgccttggcctcccaaagtgctgggattacaggcgtgagccacagtgcctggccccaagtatttttggtaatagatttttcctgtaaagaaggattggtagagggttctgggaaatgcatgttaagatgctatacattgcgttagggttttctatttcttcgtatttcattcttggtaggttggatgtgtccaggaatgtatcctttttttctaggttttccaatttgttggagtgtagctgtttgtaatagtctctaatgattctttgcatttccgggatgtcagttgttacgtctccttttttgtttcagattttatttatttgcatcttctctctctctttttttcttaatcttgctaaaggtttgccaattttatctttcaaacaaatcaacttttcattatgctgacctgtattttttataaataaattgtatttatttttataaataaaatttatttatttatattctgatctccattatttctttctttctactaattttgggtttggcttttctgttgctttgaggtgcatcactaggttgtttatgcgaagtctttctagttttttaatatagtcatttattgctatagatgtgcttcttagtactgcttttgctgtatcacatagattttggtatgttgtatttccattttcatttgttttaagaaatttttaaatttccttcttaatttcttcattgacccattggtcattcaggagcgtattgtttaatatccaaatatttgtggattttgtgaggttcttcctgttatcagttcctagttttattccatcatggtcagaaaagatgctttatatgatttttactcttttgttgagagttgttttatagcctaagacatggtttattctggaaaatgttccatttgctgatgaaaagaatgtgtattctacagcagttgggtgaaatgttctgtaaatgtcagttaggcctatttggtctaatgtgtagtttaactcccatgtttctttgttgattttctgtctgcatgatctgtccattactgagagtgggatgttgaagtacgctaccagtattgtattgcaatctgtctctccctttagattgattaatgtttgctttaaatgcttgggagttccaatgttggatggatagatatttatataattgttatatcctcttgccaaattgacccctttatcattatgtaattaattatttgtctctttttacagtctttgatttgtagtctattttatctgatacaagtatagctactcctgctctttttcagttttcatttgcatagaatttctttacccattcctttactttccatctctgtgtgtctttataagtaaagcaggtttttgtaggcagcatatagttgggttttgtttctttatccattaagccactctgtgccttttaattggagaacttagtcaatttacaccacaactacagtattattctgcatttgtccatgtacttaattttatcagtggattttataccttcaaatgtttcctttttgcatgttagcattttaaaatttctgactgaagaacttcttttagcatttcttatgagtctggtgaattctctcagcttttgtttgaaagactttatctttctttcatatttaaaagatagctttgatagatacagtattcttggatggcagagttttatttttccaacaatttgaaaatgtcattcgacttcctcctggactgtatggtttccattgagaagtctgttgccagaaaaaatgtggctcctttatattttatttgcttcttttctcttgctgcttttaggattctctccttgtgagacgtgacagcgtgctggcagtcctcacagcccttgctcgctctcggcgcctcctctgcctgggctaccacttcagcggcacttgaggagcccttcagcccaccactgcactgtgggagcccctttctgggctggccaaggccagagctggctccctcagcttgcagggaggtgtggagggagaggcgtgagcaggaaccggggctgtgtgaggcgcttgcaggccagctggggttccgggtgggcgtgggcttggcaggccccgcactcggagcggccggccggccctgctggcctgggcagtgaggggcttagcacccaggccagtggctgcggagggtgtactgggtcccccagcagtgccagcccacccgcgctgtgttcaatttctcaccaggccttagctgccttcccgcgaggcaggcctcgggactgcagcccgccatgcctgagccttcccttgcctccatgggttcctgtgcagcctgagcctccccgacgaatgctgccccctgctccatggtgcccagtcccatccaccgcccaagggctgaggagtgcgagcgcatggcacgggacaggcaggcagctccacctgcaaccccagtgtgggatccactaggtgaagccagctgggctcctgagtctggtagggacgtggagagtctttatatctagctcagggattgtaaacacagcaatcagcaccctgtgtttagctcaaggtttatgaatgcaccatttgacactctgtatctagctgctctggtggggacgtggagaacctttatgtctagctcagggattgtaaatacaccaatcagcaccctgtgtttagctcaaggtttgtgagtgcaccaatcgacactctgtatctagctgctctggtggggacgtggagaacctttgtatctagctcagggattgtaaacgcaccaatcagcgccctgagaaaacaggctgctcggctctaccaatcagcaggatgtgggcggggccagataagaataaaaacaggctgccagtggcaacctgctccggtccccttccacattgtggaagctttgttctttcagtctttgcaataaatcttgctactgctcactctttgggtccacgctgcttttatgagctgtaacactcaccacgaagatctgcagcttcagtcctgagcccagcgagaccacgagcccaccgggagaaatgaacaactccagacgcgctgccttaagagctgtaacactcaccgcgaaggtctgcagcttcactcctgagccagcgagaccacaaacccaccagaaggaagaaactccgaacacatctgaacatcagaagggacagactccaggtgcaccaccttaagagctgtaacactcaccacgagggtccgcggcttcattcttgaagtcagtggaaccaagaacccaccaattccggacacacttgtcctttgcttttgaaagtttgattattttatgccttggggtcgtcttacttgggttgaatctgtttggtgttcactgatcttcctgttctgatatttatctctttctcaagttttggagttttctgttatttttttaaataagctttgtaccccttcctcttgcacaacttcctcttgaacaccaataattcttagattctgtcttttgtggtaattttgtatcttgtaggtgacctttatttcttttcattattttcttttttttccctctaactgtgtattttcacaccgcctgtctttgggctcattcattctttcctctgcttgattcattctgttgttgagagcttttaatgagtctttcagttctgcagatgtattgctcagttccatgatttgattgattctttattattttaatctctgtgttcaatttatctgataaacttctgaattgcttctctattatcttagagatcactgagtgtctttaaaactgccattttgaattcttggtcagacggtttgtatattgccatctcattagggtcagttgcagactccttgctttgtcaatttcaggaggccatggtttcctgtttgctgttgtttcatgtgatgtatgtctgtttctttgcactgaaggattagttattaattccagtcttctctgtctggcttgttctgtttttttttttttttttttttttttaattaggtgtgtttgcttaaagagtctttgtaacttactatttattttatttttcctcacactaaaacactgcctcctttttggcactagagggtgccttgagcccaagcttttctcaattctagtaaaaaccagagtgctgcccatctgaatgggtgaggtcccaaatgggattcttagtagtatgggaaggctcactaggtgtttgtgcccagaggacctgtggaatgtacctcctacagagtgatgctgctgaacactctgatttaacatcagctttggctgagttacagagcagagtttccatggtggtggatggaagtcttgcctccctgctttgtttctggctgtcctcagtgatatttatcttttcaggcgctcatgatgcttcccatggattgagggaaggacaggtctcctgccagggaacccaagaaggtggggaggctagttatccaccttgattttactctttccagtgtagaaaccctgagtcaggcagaaattttccatgcacttggtgccgggtagattggagacagcagaatcaaggatatggaagttcagttatcttaccacctcctcacagttttttaaatttctctgtgcccctaggaaatatatcctcctcatatgtgagttctaagatattgctggctttgtattttttgttctctcaggtggagtgaaggcagcttgcttctacactgctattttggcctgtacattgctttaagtgtttttttttctccctgaatcttccacattatcaatgacctttttagatgatggtcctggtatcaaatgtgatgtcaactgggtttttcagctgtgtataaactggctccagtgcccaacgtggtatgtttggcacattgttgttcctaataacaactctgtgagacagtgagatctgagcgagatggtgagacctggatgtgtctactgaaactctaaaaagagactagatcatgctcaggatggcttcagtggtaggtacttctaattccttcaaaatctgtaattcataaatggttaatattcttactgctatttacccacaattcttaatgaaccaaaacatcctagttttcagctgtgaatgtggtgtgtgtatgtgtgtgttacatatgacttgtgttgggttaggactcagtagtgcctatctgtgttttcagtataactaaaacagcaacatggttctcctgtttacatttttatgtctcttggatttagctttatcatttataaagtgcttttacatactggcttatttggcaattacaaaaataccataagatagcattcctattttatagataaggaagaggagatggcaaaatgtcaattgactagttaaagctccctcaactgcttacttttttatttttaatcaaagtaacactggtacataatatttttaaaaattctgtacagcaattccccttctccatggtctcactttcttggtttcagttacccatagtcaactgcagtccaaaaataatggaaaattccagaaagaaacgactttaaattgcacaccattctgagtagcatgatgtaatctcatactgtccagctccatcctacctgggccatgaatcatcccttcatccagtgtattcatgctgtatatgctctctgcctactagtcacttagtagctgtttcagtcatcagatgaaaaaacataatacaagcatacctcattctatgctgcttcactttattgcaatttatatatattgccttttttttttttttaacaaattgaaggtttgtggtaacactacattgagcaagtctattgggttcatttttccaacagcatatgctcacttcatgtctctggaaagttttgataattctcccaatatttcaaaccttttcactattattatatccattatgatgatctgtggtcagagatctattatcttcctaatgtaattatttgggggcaccacaaacatgcccatgtaagaagacagtcaataaacattgtgtatatatgttctgactgctccatccactggccaatcctcatctatctccctctccttaaagcctccctattacctgaaacacagtagtattgaaattaggccaattaataatcctacaatggtctcaaaatgttcaagtgaaaagaggagtcacacatctctcactttaaatcaaaagctagaaatgattaagcttagtgaggaaggcatgtaaaaagctgagacagccaaaagctaggcctcttgcaccaaatagccaagttgtaaatgcaaaagaaaagttcttcaaagaaattggaagtgctactctagtgaatacacaaatgataagaaagtgaaatagacttattgctgatatggagaaagttttagtggtctggatagaagatcaaacagctgtaacattgccttggccaaaattgaatccagagccaggccctaactctcttcgattctatgaaagctgagaggtaaggaagctgcacaataaaagctggaagtgagaagaggttggttcatgaggattatggaaagaagccatctctgtaacataacagtgcaaggtgaaacagcaggtgctgatggagaagctgcagcaagttatccaaaatatctagctaagatgattgatgaaagtggctacaccaaaccacagattttcaatatagatgaaacagccttctattggaagaagacaacatccaggactttcatagcaagagagaagtcaatgcctgggttcagtgcttcaaaggacaggctgactctcttgttaggggttaatgcagctggagacattaagttggaactaatgccaatttaccattctaaaaccctagggcccttaagaattgcacaaaatctactctacctgtgctctataaatggaacaacaaagcctggatgacagcccatctgtagacagaatgatttactgaatattttaagcctactgtggagacctactgcttagcaaaaaagattcctttcaaaatattactactcattgacaatgcacctggtcacctaagcgctctgatggagatgtacaaggagattaatgtgtttttttttaaatggttgctaacaaaacattgttctgaagcccatggatcaaggagtaattttgacttccaagtcttattatttacaaaatgcattttttaaggctatagctgtcatagatagtgacttctctgattgatctgggcaaagtaaattgaaagccttctgggaaggattcaccattctagataccatgaagaacatttgtaattcctgagaggaagtcaaattattaacaggtgttaggcataagttgattccaactctcatggatgactttgaaggttcaggactttggtggaggaagtaattacagatgtggtaggagtataagagaactggaattagaagtggagcctgaagatgtaactgaattgctgcaatctcattataaaacttgaaaaaatgaggagttccttcttatggatgagcaaagaaagtgatttcttgagatggaaactactcctgtggagatgctgtgaacatttttgaaatgacaacaaaagatttagagtattatataagtttagttgataaaatagtggcaggatttgagaggattaactcaaattctactgtaggtaaaatgctatcaaacagcatcacatgacacgaagtcttttatgaaaggaagagtcaatcaatgcggcaaacttcattgctgccttaagaaattgctcacaatcacctcaacctttagcaaccaccatcctgagcagccatcaacataaggaaagatcctctgtgagcaaaaagattataacttgctgtatgctcagatgatcattagcatttttaaaaaataaaatatttttcaagtaaggtacgtacagtgtttttttagatataatgctattgcacacttaatagactacaatagagtataaacctaacttttgtatgtactaggaaaccaaaatttgtgtgactcattttattgaaatttttacttcattacagtggcctggaaccaaattcataatgtctctgaggtatgccagtatatatagggcttggtactatccatggttttgggtgtccactgaaggtcttggaatataccctccatggataaaggggacaactgtactacaagatataaaatgaaaaagagcagtcccctgcctcatccctgattcatactaccacaaagtgtagtactcttactttctaatggaaacaattttatatccctgcctacagcacccacacccacccacccacacttgtattccttacattgttatataacaatttgtgatgaaatcgtttatcacttatgattatataaatattgttcacagttgagccatttctaaccatgatcacaattctctttttgaacacgttttaattttttccaagaaggttgttttatgtgcccattagtagtttattcctaaactttgaggcagaattataaaactcctcttaagacaaactgtatttataaattccattttttctcttggatatgtttcactttaagctcttcatcctcctactctgagctagattgattgttcttttaattgactgcaagttctgattatgacacttccctttacctctttactgtgttccagttgttatttcttcttctttctgattctgtgtttacctggagcacatcctttcatgttctccaaagaaaaggggcatgggagagaaattgttttgtattcttgaatgtcttaaatgtcttattctgcccttagacttgatcaatatttgtctgggtattgaattctagtttgaaagtcattctcactctgattttgaaagcattactatcttttattttgtgtttgttttttgaaaaatctaatgtcattctaattctacattccttatatattctctttttctcaaagaatgtcataccttcattttatccctacggttattgaggtgggttatttcccattcattatgctgggtcctccagagctctttcagtccaaagatttatgtgctttagttctgggaattttcatataagactcctttaaaggaggccagcctgcctctgtaggctccacctctgggggcagggcacagacaaacaaaaagacagcagtaacctctgcagacttaaatgtccctgtgtgacagctttgaagagagtagtggttctcccagcatgcagctggagatctgagaacgggcagactgcctcctcaagtggatccctgacccctgagcagcctaactgggaggcaccccctattacgggcagactgacacctcacacggccgggtactcctctgacacaaaacttccagaggaacgatcaggcagcagcatttgcaggtcacccatatccgctgttctacagccaccgctgttcggcagccactgctcctgatgcccaggcaaacagggtctggagtggacctctaacaaactccaacagacctgcagctgagcgtcctgtctgttagaaggaaaactaacaaacagaaaggacatccacaccaaaaacccatctgtacgtcaccatcatcaaagaccaaaagtagataaaaccacaaagatggggaaaaaacagagcagaaaaactggaaactctaaaaagcagagcacctctcctcctccaaaggaacgcagctcctcccagcaatggaacaaagctgcacggagaatgactttgatgagttgagagaagaaggcttcagacgatcaaactactctgagctacagaaggaaattcaaaccaatggcaaagaagttaaaaactttgaaaaaaaattagacgaatggataactagaataaccaatgcagagaagtccttaaaggacctgatggagctgaaagccaaggctcaagaacgacgtgaaggatgcagaagcctcaggagctgatgcaatcaattggaaaaaagggtatcagtgatggaagacgaaatgaatgaaatgaagcaagaagagaagtttagagaaaaaagaataaaaagaaatgaacaaagcctccaagaaatatgggactatgtgaaaagaccaaatctaggtctgattggtgtacctgaaagtgacagggagaatggaaccaagttggaaaacactctgcaggatattatccaggagaacttccccaatctagcaaggcaggccaacattcagattcaggaaatacagagaactccacaaagatactcttcaagacgagcaactccaagacacttaattgtcagattcaccaaagttgaaaggaaggaaaaaatgttaagggcagccagagagaaaggtcgggttacccacaaagggaagcccatcagactaagagagatctctcgacagaaactctacaagccagaagagagtggggaccaatattcaacattcttaaagaaaagaattttcaacccagaattcttttcttttatccagccaaactaagcttcataagtgaaggagaaataaaatcctttacagacaagcaaatgctgagagattttgtcaccaccaggcctgccctaaaagagctcctgaaggaagcactaaacatggaaaggaacaactggtaccagccactgcaaaaacatgccaaaatgtaaagacgatcaaggctaggaagaaactgcatcaactaatgagcaaaataaccaactaacatcataatgacaggaccaaattcacacataacagtattaactttaaatgtaaatgggctaaatgctccaattaaaagacacagactggcaaattggataaagagtcaagacccatcagtgtgctgtattcaggaaacccatctcacatgcagggacatacataggctcaaaaaaaaaggatggaggaagatctaccaagcaaatggaaaacagaaaaaggcaggagttgcaatcctagtctctgataaaacagactttaaaccaacaaagatgaaaagagacaaagaaggccattacataatggtaaagggatcaattcaacaagaagagctaactatcctaaatatatatgcacccaatacaggagcacccagattcataaagcaagtcctgagtgacctacaaagagacttagacttccacacaataataatgggagactttaacaccccactgtcaacattagacagatcaatgagacagaaagttaacaaggatacccaggaattgaactcacctctgcaccaagcagacctaatagacatctacagaactctccaccccaaatcaacagaatatacatttttttcagcaccacaccacaattattccaaaattgaccacagagttggaagtaaagcactcctcagcaaatgtaaaagaacagaaattataacaaactgtctctcagaccatagtgcaatcaaactagaactcaggattaagaaactcacttaaaaccgctcaactacaaggaaactgaacaacctgctcctgagtgactactggatacataacaaaatgaaggcagaaataaagatgttctttgaaaccaatgagaacaaagacacaacacaccagaatctctgggacacattcaaagcagtgagtagagggaaatttatagcactaaatgcccacaagagaaagcaggaaagatccaaaattgacaccctaacatcacaattaaaagaactagaaaagcaagaacaaacacattcaaaagctagcagaaggcaagaaataactaaaatcagagcagaactgaaggaaatagagacacaaaaaacccttcaaaaaattaatgaatccaggagctgattttttgaaaagatcaacaaaattgatagaccactagcaagactaataaagaagaaaagagagaagaatcaaatagacgcaataaaaaaatgataaagggaatatcaccactgatcccacagaaatacaaactaccatcagagaatactacaaacacctctatgcaaataaactagaaaatctagaagaaatggataaattcctcaacacatacaccctcccaagactaaaccaggaggaagttgaatctctgaatagaccaataacagactctgaaattgtggcaataatcaatagcttaccaaccaaaaaaagccaggaccagatggattcacagccgaattctaccagatgtacaaggaggagctggtaccattccttctgaaactattcccatcaatagaaaaagagggaaccctccctaactcattttatgaggccagcatcatcctgataccaaagcctggcagagacacaaccaaaaagaattttagatgaatatccttgatgaacattgatgcaaaaatcctcaataaaatactggcaaaccgaatccagcagcacatcaaaaagcttatccaccatgatcaagtgggcttcatccctgggatgcaaggctggttcagcatatgcaaatcaataaacataatccagcatataaacagaaccaaagacaaaaaccacatgattatctcaatagatgcagaaaaggccttagacaaaattcaacaacccttcatgctaaaaactctcaataaactaggttgtgatcggacatatctcaaaataataagagctatctatgacaaacccacagccaatatcatactgaatgggcaaaaactggaagcattccctttgaaaactggcacaagacagggatgccctctctcaccactcctattcaatatagtgttggaagttctggccagggcaatcaggcaggagaaggaaataaagggtatgcaatttggaaaagaggaagtcaaattgtccctgtttgcagatgacatgattgtatacctagaaaaccccatcatttcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacatcttcaaggagaaccacaaaccactgctcaatgaaataaaagagaatacaaacaaatggaagaacattccatgttcatgagtaggaagaatcagtgtcgtgaaaatggccatactgcccaaggtcgtgaaaatggccatactgcccaaggtaatttatagattcaatgccatccccatcaagctaccaatgactttcttcaaagaattggataaaactactttaaagttcatatggaaccaaaaaagagcccgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaaccatctgatctttgacaaacctgacaaaaacaagcaatggggaaaggatttcctgtttaacaaatggtgctgggaaaactggctcgccatatgtagaaagctgaaactggatcccttccttacaccttatacaaaaattaattcaacatggattaaagacttaaatgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaagagcttctgcacagcaaaagaaactaccatcagagtgaacaggcaacctacagaatgggagaaaattttctcaacctactcatctgacaaagggctaatatccagaatctacaatgaactccaacaaatttacaagaaaaaaacaaacaaccccatcaaaaatgggcaaaggatatgaacagacacttctcaaaaaaagacattaatgcagccaaaagacacataaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttatactgttggtgggactctaaactagttcaaccattgtggaagtcagtgtggcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaacgatagactggattaagaaaatgtggcacatatactccatggaatactatgcagccataaaaaatgttgagttcatgtcctttgtagggacatggatgaaattggaaatcatcattctcagtaaactatcacaaggacaaaaaaccaaacaccgcatgttctcactcataggtgggaattgaacaatgcgaacacatggacacaggaaggggaacatcacactccggggactgttgtggggtggggggaggagggagggatagcattaggagatatacctaatgctaaatgacgagttaatgggtgcagcacaccaacatggcacatatataaatatgtaaaaaccctgcacattatgcatatgtaccctaaaacttaaagtttaaaaaaaaaaaagacacctttaaaaaggtctctcattctgttttctgtgttcttgctttctaaactcccatcagatcgctattacactgcctggatagttctttaattttcttattattttatttcaatttctgcatttttctctttttattctgttgaaggaatttcttcaattttcctcacctgtcttttgaacttttaaaatgttctctttgttctccaattcttccttttttatgggactctgttcttgtttccaagatttttctctgattcttggagataataattataagttttataacattcttcttctgttttctacagtgtcactgcttccctcaaatagcttcattttcttcgtatcttcctttctgttttattttggagaatgtctttaactgcctgctaactttgactgttccttctttcttagaagcaaggcactataaaagaggataggaagttctgtgctatgggtgggtgattagatggtggcctattatgagacttcaaatgcctgtaattattagttaggctttttctcctgagcaggtctgtttttgaggaatgttctgatttcaactctggctgccatattctcagcaggggaatggggctggagggctcaggattcagtacatggacttttacttaacatatctgttttctttctttttttccttttctttttctgagacatgatcttgctgtgtcacccaggctggaatgcagttgcaggatctcagttcactgcaacctctgccttctgggctcaagcaatcctcccaccacagcctcctgagtactggtgcacgccagcacacccggctaatttttgtatttttagtagagacagggtttcgccatgttgcctcggctcgtctcgagctcctggcctcaagcaatccacctgcctcagcctccgaaagtgctgggattacacgtgagagctaccgtgcctggcccatacctggtttcaaaatgcaccttcctccttaaactatacttggtgcctgtatgtcttctggctgagggagcaaattacagaatcctgacaaggtggaatgattgtgaagggtggaaactcagctgttactcatgcagtctttccctgagccaaccccactgccttgaggaacaccaccacctttctaaatggtgggcctttaacccagaaggagccttgaaatgttcccaggtatgaacccactgacttcttttgggtttctccccaagagatacaaggtttcagctttctctcctgttaagtgctatgtactcactcatctgcatctcttttccattttctcaaattttcttgttactcctccacaatagttccaattcattttatccttttcagtttataggacttgcctttaaacaaacaaactactatcctatcattttattaagccttcaggagagagcatatgtgttgaagtcaccagttgtaagaggcagtatggcccttattcttttcacactgcctccctgacacagataatcttcaattatacagcaaatgtttctatatgtggaccctctacactcctgtgtgggagctttacgattctgtgtgtgaactggtattctgattttgttcattcagaagacaacaatgagccagctgctctgctgtgctctgtggcctccccagagatgaagatgtcatttcctgctctcagggcgcctccccctcattacctagagatggcgatgctgggttttcagtactctgatattctgtgctattttaacgtaccaagagaggcaatcttgttggtgtgattttgtcatttcagtattttagaaaatctaaaatctgaatcatttccccaggaagttgggtgctactttaaggactagattctttcatttctaaagcattctgaccacatccctcccctgtttaaacccatctaagctaagttattgttgttgtttgaattccaatttcccaaattacttataatgcagagcatctctttttgcatttcttagtcacatgtatttctgccaagccaatttagtcatcagaagtctaagctcaagggcacacttaggcctgctcctgctgtgtcctacctactgaggtgacaattttagggggctaaggggatatgcccaccatgcctgcatccctctatctttgggtaccccagaaccccaacaccccaacccacagcatcgagcagcttctagagcccacgtaggtctcctttccagatatgtctgttgaacaagggcagcatatgctctcctaggtgcacggggtttgtgcagagacccaagaatgcatgtccggtccccttaaattttgtgccctagatgattgcttatctcaacctgatctttccctgggaggatgctctagaaagaacgaagaggagtggtgagatttagaggagaggggagcaaggagggaaggaagggtccatgctcagttctcagaccctcctctggagccagaccacttactgccttcacagccagattcccccagctctctctactgttttaccgaaggaccagagccattctcctagggcctaagccccacattcatccccaggatacattttaggtaatgtacaataactactcaaggacaggtgttgtcattttgctttaatgtcacaagccctgtcatccaactaagccttttcaagttctgatcctagtgaccatgttttcttaaccatagcaactatttctgcttgtcattatatacccacagcctgactgtgggcgtaggtgattaccagttgaacaaattcccttgtatagccacactggagaagagggtttatatcaatagtttgtcttccatgtcagacctgttctcattgtggcattccattattatgtgaatttccatcactgagtgacggaagcaatatagatgagttgtctcttcattgcctctgggcttgtttcaacacaaacagctgccagccaacttgggtgtggatcacaaaattttatgtcccccataaaagaaacactggacccattaagccatcatgctcctatttccatgacctcccagtcctaggtgacaactaatccggtttatgtctctatgaatttgaccattctggacatttcatataaatggaatcatgtaatatgtggccattcgtgactggattttttcacttagcataatgttcttaaggcttatctactttgtaacctgtatcagtaattcatttacttttaattgccaaatcatatttcaatgtgatccaacagtcatgttttgtttatccatacatcagtatgggtattgtgttgtttccactttttggctattatgaataatgctgcagtgaaaattcatgaacaggtttttgtgtagacatttgtcttcagttctcttgggtatatgcctaggagtggaactgctgggccatttagtaattatgcttaactaggtgaggaaatgtcaaactatttttcaaagtggccacatgattttatagtctcacccatgtatgagggttacagtttctccacatcctcaccagtgcttgttattgtctatctttttggtgacagtaatcccattgtgtgttgctggtatcgctttgtggttttgatttgtgtttcctggatggataatgaggcttgtcatggataacaagtgcttgtcagccatttgtgtatcttctttgtagaaatgcctaatcaaatttttttcattttaaaattgcattcttattcttttcttactgagttgtaagcgttcttcattctgaatagaagtcccttattaaatacatgatttacaaacattttctcccattctatgtgttgtctttttacttttttgacaagtgttccttaaagtataaaagtttttaattttgatgtagtccaacttatcggttttttcttttgttgcttcccttttggtgtcatatctcataatccactgcctaaccaaaggtcaaaaagatttatgcctatgttacttctaagagttttatagttttagctcttcagtttagataaatgatctattttgagttaatttttgtatattttatgaggtagggatccagtttcattcttttgcatgtgaatatccagttgccccagtacaattcaatggaacaatcttttcccattgaattagcttggcacctttgtaataaaatcagttgactataaatttgagggcttatttctggactctcaattccattatcctaaatgtctatccttatgccagtaccacactgttttgattacaatagctttgtagtaagttttaaaatcagggagcgtgagtctcccaactttgtccttctttttcaaggttttgaaaaaaccttgttttggctattctggttttcttacattcccatatggattttaacattagcttgtcaatttctgccaaaaaaaaaaaaaaaaaaatccaggtgaaattttaatagagattgtattgaatatgtagatcaggttggggagtgttaccatcttaacaatattaagtctccagattcatgaatgtgggatgtttttccattcatttatatcttctttaatttcctttgtttttgtatttgttttgagacagggtcaggctctgtcactcaggcttgagtgcagtggcatgatcttgattcactgcaaccttcacctcctggattaaaccatcctcccactttagcctcccaagtagctgggactacaggggcacaccaccacacccagctaatttttgtattttttgtagagatgggttttttccatgttgcccaggctggtcttgaagttctgagctcaagccatctgcctgccttagcctcccaaagtattgggattacaggcatgagcaattgtgctcatgcacagtcttctttaatttcttccaacaattgtttgtagttttcattgtacaagttttgtacttcttttgtgttaagtttattcccaagtattttattcctctttgatgctgttctaaatggaattgttttcttaatttcatttttggaatgttgattactagttgttttagtcagttcaggctgctatagcaaaatgccattaactgggtgacttatacaacagacatttatttttcacagttctggaggctgggaagtccaagatcaagttaccagaagattctgttcttagtgagggccctcttcctggcttgcagatggttcacatgacctcttctttgtgtgtgggcttggaggagagagagagagagagagagagagagagatcatgtcatgtctcttcctcttataaggaaactaatcccatcgtgacggcaccactctcatgacttcatctaaacctaactgcctctcgaaggcttacctccaaaagcatcacattagggcttagggcttcaacattttaattttagggtgacacaataacagtagtgtataaaactacaattgattcttacattgatcttgtatcctgtgtctttgctgagcttatttattagctctaatatttcaaaaatgtatttcttaggattttctatatgctggaccacaaattctgcagatagagatcattttaattcttccctttttctctggatgccttttatttctttttattgcctaattgtcctggctagaacctccaggacatttctttttggaagatgagggctcagaaatgcagttttccatcatatcattgagtccatgccatgaaagattcagggaacagagaggagttttttgaaagtgatagcatcatggttccgcttaatacaccttcccctgatgacatgttaaaacatcttagcaaagaaagtgctgatatgctgtcgtccattttccaaagtatgacactttatcagaagtcgtagtgcacagatttccaagggtattttatctctaaatcattttgggggcttagtgacagagctggtgcaaagctgtatggagttggttttacttggacaagcactgccagattcagcactttgtcaaatttcagaaaaagacaaatataactccaagagaattagcctgtagtaatattgttattaatgtggtgattccatggggaaacagactccaaacaaccccaataggctgcttcttacttactgatgcagttaatacatattttatcttttgtatatttgtttatacctgctcataataatgttctgggtgtgtaccttctgctccccttatatttgaggacaaacaaacagctttttatgacctttataagtccttaaacaccaggtgtggtattatgcatagactgtgtggatagttcatcctgactcctgcatgactgtagtgagtgactttgatgattgctttccagtctcaggcctagcactaacttttctcctgcgttctcaactacccttctgaatatctcccgtaaaacgtatcacaggcaccccaaacacatgtagcaagctcctcacccactgtccctgctcagattgctcttcctctgtgattttcaccttctcataatgatgctgttatctttcttatcagtctttcaagtttatttaatgttggtaccttcctctcccatgcttcctttatccagtctttaatgggtcatgttgcccctctcaaatttgctcacacttcccagcccctgcattcttgggctgtccacccacataaagtgcccagattttagggaggcccctattcatcagtttcttcaatgttaatttgttgcaagaccaaccttcaagcactgtcctgatctcatcactcccctgcccatacaacctcagtagctccacattacttttaaaattgagcccagattccatagcatgcaaagttctccttaattggccccagcgtttcttttccatgtaatttcctggtagggctgaacctaataccttccagtattgtcccttcacattcttactcccagatctttgcttatccatccctccagttttgaacgcccaacccatctcagcattcatcctattgctctcttaactcatctcaaaggtgattgatatggtttgactctgtgtccccacccaaatctcatattgaattgtaactcccaatgttggggagggacctggtgggaggtgactggatcatgggggcagatttcccccttgctgttcttgtgaaagtgagtgaattctcctgagatctgatggtttaaaagtgtgtggcacttctcccttggctctctctttctctcctgctgccatggtaaaacgtgcttgcttccccttctctttctgccatgattgtaagtctcctgaagcctcccagccatgcttcttgtacagcctgtggaattatgagtcaattcaacctcttttctttacaaattacccagtctcatgtagttcttcatagttatgtgagaacagtgaccttctctttgaaacctttcctgatctctccaattatagtattctaatgtactttctaatcctctgtagcactttagctatagctttcataggcattcaccactttctgtgttataaattagttgtgtttgtggatatgttaataccccaatctgctataagctctttgaaaggaaacagatgttgactgaatccatgacagagtattctaccgtcaccatggttcacattgctactggattggatcagagcctgatcatttctcacctgtgctgttatagtcacctttatttatcttccagcctcctattcttctcttcctattgttttctaattggagatactctccaaagcacctgatgggtgctgcttttcctggtatgacctggtgtcagcccatgtcctgaggactccatccagatttcttagccccacaggccactgtctctccaccccagtcctccccacccagaggttcagtgaacatcctgaacatgccatgactattctgtacccgtgagcattctccgcctccagaggatggggaggttactggatgccctgataactccttgctgtccaaaacagaagtatttcatctttaagcatattctgtactcctccttttccctgatgtcactatgagtccaagcagatctgcttcctcagcatcactcatacggccttccaaacataccaaggtacagttttgcttttttacaaaattatgtatgcacgtgtccatcattcccaaaggagcagaggctttctttttatctttacaacatcagcatctagtcacctgataggtattcaatacaggtttgaatgagtgaaaacaaaacccaggaatgctgaaaactgatgagtgaaccagaaccaaccatgccaagactgtctctttatagccttctgtgaaagaaaaattgtccaaacctggtctgcagcagagctttctgtatgatgtaatgcacagtctctttctgggaagtaattcacattcctgattaaatgcttgggcgattttttgatactcctatatgattaagaacttctgggaagttagggttgtccacccaactgactgattaatcataatctttaaccagactttttttttttttggttgtcagtcttttcttgcagagagtataaaactttgatatgtgcttgtaagcaatttgtcttaattaattttagggtgacacaaacaataacagtagtgtataaaactacaattgattcttacattaatttgtctggaaagttctttttttttttttttttttttttaacacagtttatcctaggactaattctgggccctccctcttgcaaaacaatttatatatgaatgcaatacttcatttattctctctcttcaccccaccctcctctcccagctttccttgtccctaagatagggcacatgctaagtctggatggatgaatgataggtctcataagaaggaagagagggaactgatagtacttatgggggtgagagcctcatgcagctctatattataaaagaggaaatgaggaggtaaagcatcctacagggacctgagactaacaggttggcagggtacaaatcatgcagcaccttgtggacgtgctaaggaatgtagatcttatacacacatcaaaagatgaaactgactttagctaagggctgctgaaattcacaaaaatgtgctgcatgtgttgagagttttaagaacagcattcttaatggttgagatgggctaggatatgctggagaagcaagcaatactcaagtctcagtgacctagaacaactaagatttatttcttgctcacgcaacatgtccagccagaggggtgagggctgtgcttcacacagttaccgtgcaggacctgggataacaaagatgttcccattttatgatcgtcacaaggctccaggatttgttgcaacagagaagagaagatagagaagcacgcagcagcaattaaatgatgctgcttggaagtgacagacttctcacattatgtcgaccaaatcagatcacagtcacaccaacttcaagaagcacaggggaagataatagtcccacattcctggaaagagagaaagtcttgaaatattaataaatattagaaatgtctactctatatagcaaacacaacacaagggacaggatggccacttcagatcttgaaggatgttttagacagtgaccaaaaagagaattaaatcgacctgtgtatgtctgattaaaaggaaagatttcagaccttcagaatggcagtgtgagggttttggtagaccctctctccagtgaaacagccatttaactggtaaaaattataaacaactattcgaagcctctagaaattgtcctaaaagcatacagcaaatggaaaaacatttattcaagaaaatctactatatgccagtaagagcattaagagttggtagcatttgagccatgactcattctcatgcccctgcccccatgtccatgtgatagaagctctatccaggaagatgtggccaagaagatgggggctgcttctctccactccccagctcctagtctaggacccctctgagaggggcacgctgccagtgtatctcataccctctagccctgagttgtggaagtgctattttaggcaagtgtggctgagaagatcttttccccacttagagcttacttgtgggtcaagggctttgattcagacatagataggtcaagacaaatctggggcccctgagtgtgctttaatggatgaaaattttatgccaagagggggcaagaaaagaaaaccaagtactattaactttttccctcccccaccctaacacacagtacccacttgtagagcataagtttcactgcagaagtgggccactgtccctgctcccagctctggtgtagtggcatgggtgttctatctaaagggagatgcaggttgtcagaagaatgggaatggagagctccattgcacttgactagtcttaaaaaaaaaaaaaaaaaaggagagctccgcagttctgccagaggagtaactttattggaaagcagcatgaagcatttcttgcctaagttcattcacagtagacatgttggtggtgagcaattaaggggtgggggctggtagctccatgaatctagtagccacatgcaacatggcagattggaaagagacagcccagaatacccttcctgagatgatgttcaccccaagggctccagaagcgtggtgtacacaaggctgtattcactcaggaacaatcagagagggtcatgggttagactggaaagcattctccaagccacatagatctatcagtaacatgtagatttattggaagactttgggagaagactcaaagggcataagcatgacctcagagcaaaaccccagctcagcaagctactctgacccagaggtgactcctaggaatccggactttaaaaaattacactcatcctggtgatctgaacagctgggcacctgccccactctgcaccccctcaggagtgcccagaaagagacgctctttaactagtaactctgagctactagtccctggctgaacatggagcaaaactgtaaactccctgaaatgtgaaagcagtctccaagacacacacacacacacacacacacacacacacacacaccgagtggtaaaaggcaaaaaaaccctaactggctgagagggcttaagcacaacctttgaccaaaaagtggtttatgctgactcaggggccagcctctaggaagtgaaggggagaaacacccaagcagagacttcagaggctccatgtggtcgggaaaatagacatcacagagttagtcacacagagtccctaaacgaacaaacaaatgaccaaacaacaaactcagacgggagggagaagagggagggaaggatcagtacacagagttgctaccatgtattatctaaagtgtccagctctcaaaagaaagctctaagtcatgcaaacaaataacaaagtgtgacctatgcacaggaaagggaaacaaacaaacaaacaaacaaaaaacaggcttggaaggccccagaggttgaactttgcaaacaaaaacttcaaagcagctattatgaatatattcaaagaactaaagaaaaccatgtttaaagaattaagcaacagaatgacaacaatgactgaatacatagaaatagaaattataaaaatgaaccaaatggaaattttgaagttgaagtgtacaaccctgaacttaaaaacttgctagaaaggctccgtagtagatttgagctaacagaggaaaaaatcggtgtgaacttaaagagagataacgagagattatgcattctaaagaacagaaagaagaaagaaaaggaagcatggtctcagatcaacatggggcaccatttagcaccccaatatttgcatatggaatgcaggacaagaccagagaaaggaatagaaaaaaatattctgtcataatggctgaaaacctgccagatttgatgaaaaacactaatcgaagcatccaaggacctccatgaaatctaagtgggatcaatgcaaagaaagccatatgcattcacccagacacattatagtcgaactgttgaaagtcaaagtgaaagagaaatcttgaaagaggcaagagataaactactcattatgcacaagggaaccctgatcaaattaatagcagaattcccactggaaaaatagaagccagaggcaatgaaaaaagtcaatcaacaatcttatattacccagcctggtggcacatgcctgtaatctcagcattttgggaggccaaggtgggaggactgcttgagcccaggaggtcaagaccagcctgggcaacacggcaagaccccgtctgtataaaacattttaacaattggcctggtgtggtggcatgcacccgtgttcccacctacttgggaggctgaggtgggaggattgcttgagcttagaaggctgaggcctcaaaaaaaaaaatcctatatcaagcaaaggtagaaagctatgttttgaaaatgaaggcaactctcatacattggtgatggtgggaataaaaaatggggcaactgctttagaatagtttgtcagtcctttcaaaaacttcaacatagaattacgcagcaattctactcctaggcgtatacccaaaagaaatgaaaacacacagccgcacaaaaacttgtatatgaatgctcatagccaaaaagtgtaaaaaagtccaaatggcctcaacgaaggaggagataaataaatgtggtattttcctacaatggaatattatttggcaataaaaagagatgaagtacatgccctacagcagggaggaacctggaaaacattaagctaagggaaagaagccaatcccaatggattccatattgtgtggtgtccgacatagaaaacatccagaataggcaaattcatagagacagaggttgtcttattggctgcccagggctaggaaaagggggagtaaatggggagtatctggctgctatcacacagtaccacaaattaggtggcttaaaacaacagaaatgtattctttcatagttctggaagctagaagtccaaaatcaaggtgttggcagagccatcctccctccaaagcctataggagaggcttcttccctccctctttcaacttctggcatcccaggagtttcctggcttgtggccatgtaacccccaatctctgcctccatcttccctctgtgtctgtgtctggcttcacacggcattctcctctctgtgtgtccatgtccaagtttccctcttcttaaaaaaacactgcttgtattagaataaggcctacccaagtgacctcatcttaacttgattacatctgaaaagatcctatttccaaataaggtcacattcaccagtactggggattcagatttcaacatatcttttagcagggatgtaattcaacccatagaatcctaataggtacggcggttttctggaggggtgattaaaatgttctaacattgatcataatgatggtggcatgactcgttggatattctaaaaaccattgacttgtgtgttttgaatggatgaattgtgtggtatgggaattgtatctcaaaaaaaatgtttttaaaaatgaaatagaaataagaatatccctagattaagaaagaaaaaaatggactttgtggctagaagcccatcttaaaaagaaatacttaaagatggtcttcacgttaaaagttagtgacgctaaaaggtaattcaaatccacatttaaacacacacacacacacacacacacacacacacacacacacatatacacacacacacacacatatatatacacacactctcacatacacacatggccgggcatggtggctcatgcctgtaatcccaggactttgggagcctgaggtgggtggattgcctgaggccaggagttcaagaccagcttggacaacatggcaagaccccatctctacaaaacatataaaaattagccggacttggtggcaaggacctatagtcccagctgttctggaggctgaggtagggcaatgacttgagcccaggaggctgaggttgcagtgacctgagattacaccactccactccaacctgggcaacaaagcgagaccctgtctcaaaaaaacaaaaacaacaacaacaaaccagttccagctaaggtaattatgtaagtaatgataaaaggcagtataactatatatttctctttcttttctttgctgatataaaaagcaattacataagagagaggaatccatacatgcacttttacccacataaagccagacagccccaggattctttctaaatttcagccatcagcctggttctgtccaacttccaagctgctctcctatcccaatatttcctgtccttggtgggggttcctggggtattgacctattgaacctggcatgattctgccaccagccactcctgaaatggaagccaaataattatttttgaggcatttctcattgctgctgatactggttgagaaactacatgtgttctttgctgaagaaacaaaaacacttatctgaaagttaatcacactttctaaatgacagaaatgtttggctgaagttaaaaactaaaggttaaggataaaggtccattttcttagatttaatccccttggccttggtcctaccccgggctgggagatttttaaaagcaaaggttagcatctgtctgagaactgactggtccacatataatacaacattggtttttttctttttttaagtgacatccactgattccaagctttttatgagcagctctggttcttggctgtcttgagtagagaattattattggcattgcctgaagtgtgtcagctgtttgagatgcactgttgccgcatctgattgtgatggcgactcctagtatctttcctcatccagagagcaaaggaggtctacttactggtgtgggagtttttacagtcccacattccactgtcacttttgctctgaaatccaatggggatgcagtaggactctgtatttggaaatggtgcccttcgcattcgcagcagaggatcaagatcagagcttagtgatctgacaccccctctcctaatctgtgctgccaacccaagttgtttattaccctcgagttgtttattacccttgggttggagacatcttagaagagagaactccagtgggttactcctctgctggagaggcacggagccccacagggaagactaagtgcagcagatctagtggaggaacttggtgactgggcatctggggaccctggggagaagtttaaagctgccagttctccctgaacccgaaaaggtgaggcagggatggtggtgagggagatgacagagtcagggatcgaggggcagaaaggataagctgagtcattccttttcccacccccccaccccccgccccgagatggagtcttgctctgtcacccaggctggagtgcagtggctctgtctcagctcactgcaacctccacctcccaggttgaagtgattctcctgcctcagcctcccgagtagccgggattacaggcacccaccaccatgcccagcatctaatttttgtatttttagtagagatagggtttcaccagtttggccaggctggtcttgaactcctgacctcgtgtccacccgcctcagcctcccaaagtgctgggattacaggcatgagccactgcgcccagcctgagctaagttatttctaaccaaagttgggagaatgcagaaaggaccaggaaagggggagcataccgtcagcctcccaggcaagagccactgggcctgtgaccacagcaggattcccccctcactggtattccagcaacctgccctgagccccggggagctcccagaggaaaagaactgcctgtctgagagtcacagctgcccgagtctggctgaacacatgcccagggacaaagagctgcggggcaaagactggtgaacatctgatgaaaatgtcgtgtttccggataaaatttacttctcggtagtcaagagaagccttaatcatgctgctgagctcacgttcgtacctagaagatcttgtctatgcaggctggacaagtggtctcagcctaaaagccctcagtagcaaccatgtgatttaacacacctacctcttgccttgacccctaatagcggtttctcaacaacaacaaaaaagcgtgtagaaagcaattatataaaagagaggaatccatacattcttaaagtgcacaataaggcatgtgcttattatatattgtgtgccaagaattaaaaagcacacaatatatatgttctttggcttttactcttgctcaggagaatatcagaaagcactgggccttttttagggaaagacggtttgctgggatactattattcaagaaattctaacagtaaacgcatgctgatttaagagaagcatgtttggggggtatatattgccaataccttaaaataaaagtgagtataaagctataaggactgtatccatgatgatttacttcctaattgatccttatgatataggatcatggtataggatccccgtgttgtcatttaccccttctgataaagatggtgagcgaggctaagaaaatgagtttggaataaaaaatggaatcccacccaattgcttacaagctgtgtgacatcaggcaagttgcccaagctttctgagccccgttttttactttttagaatataataattttgttctagagggatgttttaagaatcaccgttgaggcccaagcccatgttttattccagagcttctcaatgttaataatgcaaatgaactacccgggatcttgctaaggcgcagcttcagagtcattatctggggtgggagccgagattctgcattgttagcaaactctcttgctcccatgctggtgtgctgtggctggtctgaggagctcactttggacagccaagttttgcagcactcacagcgcggatgccaccccctgcagccctccgcgggggcctggtgagagcctgctggggacccacctgggactcatgaaggcccatcattcagtgactgatcagcatgagtgaaggctggatatctgccacttatcacagctaatggaactgtctcccttagataaattgagttagagaacagctttagggttaacaaactaactttatactttattttctgagcccttgacgtctgtgatcccactgggttgatttggtttggtttttcggtgagacctgtaagggagaggtgctataaataaatccaatttacaaaaaaacaaagtcaacgacactggacctggcccctgctcttccatccacgccccacagcctgtgatggtgataatgcacttcgttcttttcattcttgggcacaccctttccatcccccatagccgaggcgtagtcagggggcaggtctggctaaagatgcttttttggccccttcatttctttctctttgcttcctgcgtactcgtccccacagccctttctttcctaggagctcccgtgaggacctgcagggattctagtccatcacagttgcttgcagacgccctcccagccaaggctcagtcattggtccccgtctgtccagagttttgccagttggtttatgaattaatttcctggggctgtcttaacaaactgagtggcttagaacaacagaactttattctctcagaggtcaggaggccagcagtcagaaatcaaggtgtcggcagggctggttccccctggagcctccaagggagaatcttttccatgcctctctcccagctgctgctggtggccggcaacccttggtgttcctcggcttgcggacacaacactgcaatctcagcttccatcctcacgtcggcctctgccctgtgtctccctctgtcctcttctgtctcttacaggcactctcattggatttggggtccatcctaatccaacgtgacctcatctcaatccgtacttcaatgacatcagtgaagaccctctttccaagtaaggttaaattccgaggttccaggaggagataatttgatggagacacgattcagctcactagagtttggaagaatttttctgatgggaggtttggaggatgggagaaaaagaacagggagaccaaagcagagagggaaatgaacttgtccgtgagaaatgcagggagctataggggatccacgagacccattggtgcccgcacaaggacacaaaccagtctcctctgcccggccacagtggggtagcgggatgggcagggcacagaatgcctggcagagggtgggcgagagatgccaggaggatataaggcactttctaggccccgtgggctgtgagaaagccttgtacctggaagtcaggggagtctggggtcaaataaggacacattattaggcttggctgctgagaagctcatttgacatttggaaaataaaaaatgaaattgttgagggatcaggcattgctaatagcttataagtagcagaaattataggcccagcctcccctgcaagtgggactgacagtggagagctcaggaaagagcttgcgggtgggaccttggagatgaggacctgagagcagtggggtctcctgaggcaagaggcggtgcctggggccgtatgttggggaggaagttgcaaagagacatcctgggtctgcacactgcccaggaaagagcacatggaagcagacaggaggcgaggccaggcgtcattttgcttggattacccaggcaggagggcactggagaagactttgaggtgagggcaggctgggcttgggctgagctgcaggcaatcttacagtaagacaatccccctgctccttatgtttaattgtggtaaaatatacctaacataacatttgctattttagccttttttcttttttttcttttttttccctgagactgggtctcactctgtcgcccaggctggagggcagtgatgtgatctcagctcactgcaacctccacctcccgggttcaagtgactcttgtgcctcagcctcctgagtagctgggattacaggcgcgtgccaccacacccagccactttagccatttttaagtgtacaattcagtggcattaagtacattctcattgttgcgcatgtcccttacttttttatcatgagcaagggatggagggcgatgacttattgttggtgacagagtgccatgaggaggtggggctagagtcttgggcaagggggagaagaggacaacccccccccctccagcttgtgataaaaggagcttaggttctgcagagaggtggactttgtggaactctggaaagcacagtagagatactgttcaggaataaatgggccctgatttctgctgtgtcccctcgggatgtagccctgctaatgccaaatttgctttgaaagccagagaaaagccctcgatgttgataaacaatctgtgatacaaaagtgcacagatttctttagtatctttactctaggaaaacagtacagtaaattgagaagagacttcagtgcaagttctcttcaaatacgtggggcatccttatactaaaaaagcgtttgttgtttatccgaaatccaaatttaactgatgtcctgtatttttatttggcaaccatattctgatgagactttgatatctgggctaactaaatccggaactttcgctaactgtgccctactgtgatggggtcttctcaccagtcactaatccatcagaaacccactgcaggttcaggcgcgcgtggccagcgcattcctagtccgccacactgctacccagacagaacatccactgcttccacattctccccaggctgcaaagagttcccaggagactttcttttcccccctcaaagctgtgcacttgggcctggtttcacctgcagagaagtgggtaatggctgatagaggaagaagcgggtccctaagacagtcgcctctgctccacagtgccatctagaggaaagacaggacatacgctctgagaagcgcaaggctggggtgttaataagcaggcccttgggaaatctggagtgccctgttcccctcattatgatcccgatcccaggcagaaatgcctgtgggctatcactacaaaaggaaaacaaccaaaaatgcatccaggattaaaaccaccgtttcaaaagcacatcattaaagcaagctgtgacccagatgtttgttttggtgtgcttaagagtttttcaagcaattgaaaagagtggaaaaagtgaaacaccaagaaaaaagaaaaagaaaaaaaaaagcagagcaaggaatgttgttggatgattctctgtgagccaaggaggacctttttatttaaaaatctgtaagctttggtgttgagggagaactactacaaaactagacttgaattatcattggagcaggattttgaaaatttattaagagtagcaggctgggcggcgtgagggtgtctatagcccggatgaaggtgcttatgaagtaaaaggcatgtcaatgggaaatgtggtcgctggaaacatgtagttaaattcagtgcaaagagtaggacaacctcacatgtgtccttgtgtgcaagggaaatcagctgccctcttggctgctttctcacactccggtagggcattgccggtccatcacacagagctgtctataagacactgatggagtactatggaaagcttacgggcatacacaattgggcttagtccctttaccactcattcactttataattgcaggaagcaacttaagttctcttgtcaatttttatgtacttcaaagaactactaataaaattcgaatttatagaacatagacccccaaggggcattttgtgttggtgataatattctactaacttgaaaagttgcagcaaagatgcgccttccactaaactctaactcagtctctttctttttctctctccttgtctctctctttctctctcgctcccactttctcaaagggtcagaatgcctgggttcttaccttcatattagctctgaaacagacttcaagataaaacctagctacgtcgttctggctgaaactttgtaagtgttaggtataaagtaagcaccctgggtcttgcttctgttaatgggcttgcaattgtggaagctgccactacgtggcgtcgtgagtcacagtgaatcctagtgagtcacaggcatgaaacctaagtcctggctgtccctagtcaaggctatttatggtcctaggtaagtacgtaaactcgtcagctgtgtttattttttttcataaacatcacattgatattgatatggatgtaaacctctgacaataattattagctgatttattttttaaatattgtatttatttttactataatattttccaataactatattatatttattgtataaataatatcctttggagtagggttaaagaatgtgggctggcatcagcgatgtaccttcagaatgtgtcttatcaactctagtttttcatactctgttttagaaagaacatacgttactcctcagttccacggtgaatattagcaagtcttccatatggaaacagtcacatcgtgcttttgggtcttggtgtcagatattctcttacacctgtttataacttaccaaggaaaatgcttacttacttgtttccaagcccttcttctatttctggaacttcgttttctactttcaagcggggtttagctattaccaagttctgtacttcagagaagtttgttttacattgtagaagagcacttgccaggcaagatgtgcagaaaactattcctctgggctttacaacatgtgtaatggtctctttctagtctggagagttgcacaggcagccaactgtccccactctttccttcctttaaaatgtaaatgtatttaaatcaatagggtgtgatggttaacagcctaggctctgttggtcaggcacgcttggaattgaatggttgttctggtactacttcttatcttctctaggcctcatctgtttccttatctattaaataagggtattaaagtatcttatttcctggagtggttgtaaagatcatatatgatcatgcttatactaggtggtcacaataatggctcagtttagattagctattattattattttatttcatttttatgtataccctatttccttatacaacacattagaggctacttataagactgtctaccttaaaatagtaatcagtgccagaaaagtttttgaattaaaatgaaagagtgaggctgggcaggggcctgtgggggaatgaaacacaggtattgtaagatacaagtactcataaacttctactcagttacttagacttagccacatatttgtttctgagcttcccactagctaaagtgaaaagagaatcaggttcactcatgcgattcctatggaccacaaggcaaaacctaccagtctctcagcgaagcataaggggtcttggttcttaactccaagaatatatattccttatgtggggcatcatgtgaacagagacagtaaccctaacaataaccctatatgaggtatcgtagacactttaaaaatataagccgagggaaaagtaagaggtagttttgctccccagagaactgggaacaagaccatgtgctgggcagaattctgagattcacgccccctggtgtacacgtcctgcataatctcttcccctttgggtgtgggcaggacagtgttggctgtcactcccacgattagattatgggatatacaaagtgaagtcccgatgtaatgaagtccctaatcagtggctttaagtaatcaaaaggagataatcctgggtgttctgacctaatcagcccattaaagaagatctagagttcaaggagagtctctgctagccttgaagaaggatactgccatgctgtgagagagccacatggccaggaactgagggcagcctctaggagctgagagagaccttcaggtgacagctgatgagacaacagggacctcagtcctacagtcctgaggacctggatcctgccatcagcctgaatgagcttggatgagagcacagccagcaaacatcttgatttcagccttgtgagaccttgcacagagaacccagttataccattgcctggacttccgacctacagaaactttgagatcatcaaaaggtattgtttcaagctgctgagtttgtggcaatttgttacacagcaatagaaaactaatgcaaaccatatggctggaatccacagcctttgaatagattcagaaataaaatccagaacatctagggcatttcccaaactaaacattcatgggagatgctaatatatgtgtcacattaaaagcaaaacaacttttttcgttgaccctgactgttcgcattagaaaggcctttgctctactggtggggcagagagtcaggtttctgggttgtaagcaacagaaataaactgactcacatttgcagaagagagtttatggaaaggctatagtgaggtcatggaatcaaggagcaggctaaagaaacagtctcagaatggacaggaacctgaaaactccaggggtctcacttccaaaaaaaaaaaaaaaaaaaatcctgatggccagttgccaccaaaataaaagaatttcatctgttccttttccccgtccccactattatcagataactcccctcaaggttcaacagctcagcaaagtctgagtggcctggcacttagccacaggagagcaggagacctgaattaacaggtgtgccaagatgcacacagcgagcgaaaggttatcctcccaagctcagttgtaacccgaaggagagagaatggataatgggccacccaaaaacaaagggggttcacagaagtagatcagactgacaagtttaggggtagaatctgagacttcctcctttatgtcttagtgttagaggaaaggggaagtcacttttgtaagaaacggtgaagactttggaaccaccaaatccaaagcttcaggagaagtagaaagaggggagccgggggtgtggggtggaactacgcaggtagtggaaggctgggcaatgcggttcttccttgtgaaatccaagattttgaagagatcggatgctgcacggagcgggcgaggagcctgagctttgtgcctgtgcaaatgagaagagatactgaatcatgaagctttcacttctgagcattagcagaaactgcagcaagacttctgacttttacaagctatggaatcggctggagtctgagcagttttatcctgtgagaaaatggatccccagttgccattgaactatatgtatttggcaagtagtgtatcgtaaagctgctctttggaaactcataataaaactagcatatcaaaagctctgtgctgtgttcgggcctccccactccatgttgctgtatttgttgtggtggctgcaggcttatgattgctcaggtttgctcagttccataaattctcactaaatgctgcatttgttgaaggaatcctgttgtagcttcagggctgttcttgctgttgtttttaagccatacacatgtggattatctttctaagtgactgaatggttaagagtttggtgcgcatagttacacattttcatgaactgttgcattttgttaatgcatattgctccttgacttcattgtattttgtcagtatttattgaatgtaaagattttcaggtaagattcatttattcattcaaagaatattgatgtgcgaaccaccattctaggcacgtgggagtacattaatgaagaaaagagactaatatctgtcttagtctattcaggctgctataacagaataccttaggctgggtaatttataaagagtagcgtttactgctcacagttctggggattgggaagtctgcagaagtctaagatgaaggcactagcagatgtgctgtctggtgagagtctgctcctcagagatggcatcttcttggtgtcttcgcatggcggaagggacacacaagctccctcaggcctctttttatttttattttttattttttcaggaacagggtcttgctctgtcacccaggctagagtgcagtggtgcaatcatggctcactgtaacctcgaactcttgggctgacgccatcctcctgcctcagcctctcaagtagctgggactgcaggtacacacaccacccggctggttacttgtttgtttatttgtttttagggatgagggaatgtcgctatgttgtccaggctggtcttgaactcctggcgtcaagcagtcctcctgcctcagcctcctgtgtccttgggcttacaggcatgaaccaatgtgcccagctcagacctcttttaaaagggcacaaagtcattcatgaggactccaccttcatgacctagtccccactcagaagccccactccttaatacctccacgttggggatgagagttcaacgtatggattttggagagacacaaactttcagaccacagcagatccctgccctaaggggtacatgtaccacacagacacacacacaaacacaaacacacacaccgcacacatatacatacacacacatacacatacacaccacacacacacatacacatgcacatacacacacacacacacacacacttgtgtgcagttctgcagttaactagaaaacttgggtaactttttcagactttgtcctaaactaatttgatcaaggaacttttttttaaggatatgtaccacgttttgtagagtagtgttttgtttaatgtaccactctggaaaatgcttataaaggcatcgctggactgaatgtacttcaggaaaatcatccatagataccatttgtttcaaaatttggtaagagttaggcggcagagagactaaattctccaccaagatctggagtgcagatattctttgttgctacttaaaggcaaatctgtctgcctcacacgtcacatgagtaggggtgactttggtgaatcctaaggctgtactggagcttgtcacttggctacacgtctatctcagacctgctgacaggaccagtgtatttctacggggttctggatcaagcagtccagcctcttactggatcgtgtctctcaagtcagcctctgtggagttatatccgcttcccctgggatgcggtgtgagaccagcacatagtgagcatggacatcactagattgagtgaaatgttcctgggctgtggggacttcacgagaccacatctaatttttgcacaaatatctgtcactcaccacctacctgtgctcgtctggttgctcggttgggattttttgacaggaaataggagacttggttaaatgtctgtgtaactttgagatgcttgaggagagagacactttgcactgaccccaacaggtttccttatgcacctgattacaacaaagaatctcgggttcttgcttgggagagtggctgagcagctttgctgcacgttggcttgtccacccaagctggaaaaacctgtggtccagagtcccagggtgactaatgaacatgtgtgtgacaagggagaaaaaagtttggggcaatattatcttttggggataactgcctttgaggctgtcttcctggttattttgaggatgtgtgattcacagaagagagacggacctacacattggtcatcctcaagattttcagggccatcctagaatagcctcaccctggatcccaggaacagacctctttatcaatagtggcattcctttacatcctcagctaagtatagttacaatgattgctttagagcactctaaaaagagtgactacagtggctgtgtttgcctttatactttgaaaaaagaatgtccacaacaacaaatatttatgaagctttataattaaaaaatacgttctttagctagagactgctaatgttgaaaagaccacccccacctcccctcctcattttaccaatgaggaaactgagggcttagggtcagataaattcatcgaaagctccctactaggggatgagctgagattatatcttgagtcctcttgaaggaagctagtctgacacacgtatgttccccatagggccgtcacattcttatggtcacactatactcagatgccgtattagtctgttctcatgctgctataaggacaaacccaagactgggtaatttatagaggagagaggtttaatggactcacagttccatgtggctggggaggcctcacaatcatggtggaaggggaagaaggagcaaaggcatgtcttacatggcagcaggcaagacagtgtgtgcaggggaaatgccctttataaaaccgtcagatcttgtgagccttattcactatcaagagaacagcacgggaaaaacccacccccatgattcaattacttcccatcagttccctcccacgacacatggggattaagggagctacagttcaagatgtgattagggtgaggacacagccaaaccatatcaagtgctatcttagcaaaatcgccaccaaaaaaaggatgaaaattacacgggccactagatagaccataggaagaataattttaacagcaccagagcttgttcgatctcagatggaaacatttgcatcaggtgacttagattttttttgctgctctgtacacgttggagaatgactgtgaaagtgccgtcagtttgatttggaggtgacaagtagcttttagcaagtaggtgaattcacaaatatggaatcatgaatgatgagaatcggcaagatttcttcattcctttgatgcggcatgtaagcccccaggcacttaagaaggtcagagggagatggatgaagatgaggattacggtctctgccctttattaagagcctcctgtgcatgggtaaggctgagcacttgatgttttgctggggctgaccacaagccccagggaacagaagtgtgtagtcacaggcagagccagccccctcatcttgctttggtgtatcccattttgtaaatcaagagtcaagaccatgaccatgaagaattcagagtggagacagaaaagggcaatttatttagtcccaccagccggcaaccagaatgccaaagctccagaatcctgcagccctgggacaaatgccctgaggatgcataagcccacggaatcccagaattccaaatgtccttcggcccaggtccagcttccagtctgtccggtaccatgaactaccgccaattcctcatgttctctttgtttctaaggttcttgtctgagcagggaggcggtaggggtctgagtcactgtgaggcacacacagggaatgtctagaaggaggcctgggcctaaggaggggttctcaagagggagattatgctctggcgttttgccatcaaagaactttatttcctaatgtttattcttcagctcagcctcggctatacctgcctagctggtgttaaactaatgaatctaacattcccttccctttgcattggggtttgagtatgaaacctgtttgacagggaattgggggagaatttgtttggatttgccttgacgaggcctttttcaaagattggggaggccactggtttctcttaaaagtcagcagcgccccagggagaatgtagggactgtccttccacagttgtcttggatttcaggctctctagaaacgtctggccactggttgattgacatggcatagactttgtaaaaacaaacaatacgatattgaacctcaggggaactagcacttgataacatggcttgcttaaggaagttataaagaagaaaaaagaaatggggaaaattctgttaatgggaatcagaacaattctaagattttccactgggtggcattttatttaatgttactacatacagtcacgcatcacttaacaaagggataccctctgagaaatgtaaagttaggtgatttcatcattgtgtgaacatcatggagtgcacttacacaaacctatatggtttagcctactacacacctgggctaccaggtctaggtacctgggttacctattgctcctaaggtacaaacctgtgccacatgttgctgtactgaacactgtaggcagttgtaacacaatggtatttttgtatctaactgtatcttaacatagaaaagatacagtaaaaatgctgcattataatcttacatcctatcataccattatcgtatatgcagcctgctgttggctgaaatgtcattatgcagtggatggctatacatgcttccagttggggcaggtccacaatctaaattatttctgggaattgccgtttaagacttctgaagagtggggaaatttgcttaggtgggattctcttgctttttacactaattaaatacatttttaaaaagttccttttccacactctgcacacttcttaccatcattcttaaaaagactagaagtttgagcataaagacaatatttttttcatagttgcatacgtctacctcgaataatgcctggcaaagagtttatgggtgctgcatacacgcatgcctgatgaatgaatgaattaggaattacggctgcagcagtacgctacttgtatgcatttaattcgaattatcagactatatagatgctcctagacttatgatgggatcatgtcctgataaacccatcataaattaaatggaaaatatcaaaagtcaaaaatgcatctaatttacctaaactgccaaacagaatagcttagcctggcctgctaaatgcgctcagaacacattagcctacagctgggcaaaatcatctaacacaaaacctgttttataataaagaattgaatatctcatgtaatttatcgaacaccgacctgaaaatgaaaaccagaatgattcgatactcaaaatatggtttctactgaatggttactgctttcacaccatcgtaagtcagaaaatcgttcagtcaaaccatcatgagttggggactgtttgtagcagggtcagcaaacattttctgtaaatggctagatagtacgtgatttagccttggtggaccatactggttttgtctcaacagcttgatgctgctgttgcaggtttgaaagcaggcagatcatatcacaaggcatagctgtcttcccatagaactttattagcaaaaacaggcagtctgctggatgtggcccatcagctgcagtttaccctgatctacatgaaagcatacactggcatcatacaaatgttagaaaccaatgtagtaaaagataaagagatttcaagactctgtgagtggtagacagcatgctctccattcaccaaatcccattccaccttccacctgaacacatgggaaaaccacatttcccagcctcccttgcacttagcgggagccttgtgactaaatctggccaatgagctgtgtccagaggcaaagtccaccatgtccagacctggcccataagacttcctgaacactgctccatgctctcttccctcccctgcagactgggtgcaaataatctagtgaaggactccagggcccttcaagttggtgtactcacttgctggagtgagcctggatccctgaataactctgtggaggagagtcctccccacccctactatgacctcataatggactgtgaagggttgtaaaatacacctgtgctgttaaggcactgaaattcaggggtcattagcctgtcctctctaataataccatgtctgggctcagatctggataaaggaaagaaactgaaaaagaaatagaattctctccagggctaacagcctcctgtctggtgtacctgcactttttgattggggaagagaggaacgaggaggtcttagtgctcgcagtcttagaaagtttatgtataagaagcagtactgtagtttgggtctgagaaacgggaccttgaagagagagtcactgtgaggtagggtggcagaaagggatatataacagataagtagcttttacagaaattgtacattgaggctgggcatggtggctcacgcctgtaatcccagcactttgagaggacgaggtcagcgatcatttgaggtcaggagttggagaccagcctggctaacatggtgaaaccccatctctactcggcgtggtggtgtgtgcctgtaatcccagctactcgggaggctgaggcaggagaattgcttgaacccgggaggcagaggttgcagtgagccgagattgtgccattgcactccagcctgggcaacagaatgaaactccgtctcaaaaaaaaaaaaaaattgtacatgaactgcaccaaaacttgtagccaggatttatacttggtgtgatagttcatctctgtactggttaaaatggatttctttaagctagcctagaacctcccatgctaacatcatttatctctctctctttggctgtataaagtaaaatttactaaagttaaaacagtcaaccagtaccacaacctcagtggcttagcaaaatgaagttgattttgtagtcacatccgtgtcaatccagtataagttggtgggggtgtggcacttgggctctgctccacagtcattcaaaatccagatccccatcaccttgagcatctccccccaccccttctccttcactctccctcacctgagaaatgggaaaagaaagatggagggggattgcatgggaggttttggaggtcaggcccagtcatggcatgcattgcttcagcctgaattccctcactcagaactcagttacacgggtccacctcactgccaggaaggctgagagacacagcatgactcgcgagcccaggaagaaagcaaaataggatgtactggacccgcggccatcctggcttagtgggaaaatactttgagctcccaataaccaagtgtacaagtaagtttctgaaaccaacctgttcttaaattgaagccttgctggtgttttgttgaattactgcaagcctttggtaatgcttccttgtctggaagggccgtgaaaataacccaacaccagaaagagaatgagatttctcacagctgattgtgccactgcaggaagcccacaggtggggcaaagcatttgttacttctctgtggaggggtcttttggtctgagagctcccgtgagccctgccgctctggtcactcacgttttctgccctctgcctttccctgcagagtccccgccttttccccagcagggccctggtcactggaaaattgggagtaaaccctgtcgtcctcccagcagcaggctccgcagattctgaagataggcacagacaaaagagatattcctcttgctaagttggactgtcagtgataaaacaatttttatgtgctaaagaactaagagaactctgtcaactagaggaggaagggaaggaacaagacagtgaacaagatggtgacagggacagaaaactctatcttcccacataacatgaccacgtttaatggcccctgggcacgtacaattaactggcccaaacaaatatatattttttaaagatggggtctcgctgttgcccaggctggagtgcagtggtgtgatcatagctcactccagcctccgactcctaggttcaagtgatccttctgcctcagtcgccaagtagctgagactacaggcgcgtaccaccatgcctggcaaatatttttttcttttcctttctttttttttttttttttttttcttcttagagacaggtctcactttgcggcccagggtggtcttggacttctggcttcaaatgatccttcagccttgacctcctaacatgttgggattacaggcatgagccaccttgctgggccccaaaacccttctctgagaagcagctccactggccgaatacacgcattccttgtttggagggtgttgagggagttgggctaccagatgctgtttggaaaatttcacttgactgtgttctactgagggtttaggcactttccagagcatcttagggaaagacttgttatgtgaaatgcgatgtagcaaaggctggtctggtccctttctcgtacccccgctccatacacagagcaatctttggcaagcacaggcaggaagccatgttcgtggcagcgaaaagggaagatgtagccccttctccttccccgccatcaggccacctctagtgggaagtactagttggctcatcccttcactcctccccagttgaaatgtttcccttcctttgagctcagcattcgtgtggggctctgttgtcattcctactcaaaaggatagctgtaattctgaaatcctcaaggttagggcctatttctattcccagcaggcagccctggatctggcatggagcaggggcaggacgctgtgcactgagtggtgaacgagtctgcctgctggtgcccagctgagtgtgggacatttagggcaccccaactgaaccctaagctacctccccctggacctaaggtgatcagggattttgtctgtacataggattgagtggactgtaatggaagctcttgtgtgtcagggagtctgaggtgcacggagtgctggggaatgatgggcttatgatggggactgaaccgtgttggctgctggagctgtgaagaagacactggaaggctattgctgctgcatgtctgagggggcctgaggctgctacaggtcagcaggctggcagttaaggagaaaacggggatgcaaagcagggaagagcaagggcaggctggaacctgcaaagacaaagcagaacccacgaaaaccaagtggattctggggggatgaagtggaacctgcacaggtgtcaccatcctgacagtgcaggtaacttgtggaagaagctggcacccttggccacagatctgtacatgtgcctgccccaggatgtggagaagctgacccatgatgtggagaagctgaaggagaagatccaggcaggagttaaatgtgctgagggcacctgtgaggttgaccagaagatcagctgggctgtttttaagcagaagcaggcctctgaccttcagacccggaaagtggatgcgtccttctgccttgcaagtctctttccatttcttctgtggccagccctaacccagaaccaaacatggtggggcattctgggaaacgtcagtaggttcagctaagccagcacggtgcaaggccacacataccatctctcaactgcattattcacactcatgtagctacaggggtttaagtattttatcataggagcctttggaaagagcctttttagtgaaacacactgaagtttgtttttttcagagacaaggtcttgctctgttgctcaggctggagggcagtagcacaatcatagcttactctagcctccaacacctgggttcaaatgatcctcccgccacagcctccagagtagctggggctacaggcacgcatcaccatgctcagctaatttatttttattattttatttttagagatgtgggtcttgtttttttgcctacgctggtctcgaacttctggctttaagtgatcctctcactttggcctcccaaattgctgggattaattacagtgcccagccccgactgaagttttgactggtaagaaaagataaagtaacgaacttggcccctcatgccaacacttattgtggccagtaaattctgttatttatttttgttgttggagaaaagaggaagggaaagagaaggacgaagattgtagtagaaataaagatttctgttgaatcttgaattgggtttaaaaagcttccttctattctgagtgtgtgggagattgaagtctaggtggctttagcccagtgtttaatattgaaatgtctgcagagtgggtgcagtgagcttgcaggtgcaggaggtggggaagtgagtccctgctgagcttagagtttctagagaagatgaaaattgatcaaaagaagctggaaatccatttttttacgtgaagtcttagtaattaaatattctagatatgcttttaaaagtatttttataaatattctaggtgtgcttttaaaaagtatatattctacagttattttgaatgcatcaaaatgtatctgtaaattcaaatttgctgatcataatgtttgaattgtctatatttttcctgagttttttgtttacactatcagtgagagaggtatgttcaaatctctatatggtgaagatttgtccatttctccacttccatctgtgaaattttgctccatagattttgatcctatgttaatagctacataaaactttagagctgctatatttttccaaatctttatgtcatttgaaatatccctctcttctagctctagctatgcttttcaccttgaagtctgcttttgtcttagtagagagactccagtttcctctgggttagtgtttgcatggcagatcttttgccatctttttatttgtcatctgtctttgcagttgtcccatcttcttatgcttgattattttgggtggtgccctggacacatatttgaaaacataatttgaggatgaggaagatgttatctcccaaactccaaaagggagtttccttttcttctgccaggtgtctggaggtacttgatatctgagattgtcatgattccaagctgagttgcaaacccctcaaggctgccctatggaatcctaacacagagccaaagggtgtatgagggccttttgctcttgcagagtcttagacctcaatccttgtcactctggccctgtgatgttggaaaaagagctgcttaaccatcaactgtcccttccagagtcgacagaagccccaggagtaaaacatcccattgcagggctcatctgcttgggcactgtcttcccctatatggtggcttagcagttattaactattgcatcattgcattagctttctttctttttttgagacatagtctcactctgttgcccaggctggagtgcaattgtgtgatctcagctcactgcaacctccacctcccaggttcaagtgattctcctgcctcagcctcccgagtagctaggattataggcatgcatcacacgcccatctaattttttgtatttttagtagagacggggttttgcaatgttggtcagtcgggtctcgaactcctggcctcaagtgatccgtgtgccttagcttcgcagacttctgggattataggcatgagccactgcaccaggcctgcattagctttctactactttcaagcatatttgcaaaatattttgtctgctatttctagctgcccttagtgggagagttgattcaagtttcctagtcatcctcctttacctgaagcagaagttccttgtttattttctataggaaaaactcctttctctggcatagttaactagcattttctttatgatttcatgttttgcttcaaaagctgatggttatggaatattgaaattttacttcataatttttaatagaacacatagtgtaattctggacacattaaacacagtataattctgtagttgttaaagaggggtgattttacagaagttggaaatactatgctacaaagagttctcatatttaataatatattttatcttaatctcactgatttttacaaagcttatagatatcaaagcttatagaggggtgcttttacaaaagttggaaatactatgctacaaagagttctcatatttaataatatattttatcttaatctcacttatttttacaaagcttgcacatcacagtagacacttgaaatagtaagtttttattatctataataagtgtattagtccgttctcacattgctataaagacatactggagactgggtaatttataaaggaaagaggtttaattgactcacaggtccacatggctgaggaggcctcaggaaacttacaaccgtggcagaaggggaagcaggcaccttcttcacaggcagcagcagaaagtgtgcgcatgtgaagagggaactgtcaagcacttaggaaaccatcacatctcatgagaactcactcactatcacgagaacagcatgggagaaaccgcccccatcatccaatcacctcccaccaggtccctcccttgacatgtggggattacgggaattacaattcaggatgacatttgggtggggacacagagccaaaccatatcaatacgttagcaaatattaattttaacgaaaatattaagacaggagcaatttgctcaagagatctattgtatatcatgatgactaagttaataataatatatagtatatttgaaaattgcaggctgggcgcggtggctcacgcctgtagtcccagcactttgggaagctgaggtgggcggatcacttgaggtcaggagttcaggaccagcctggccaacatagtgaaaccccatctctactaaaaatacaaaaattagccgggcatggtggtgggcacctgtaatcccagctactcagggggacgaggcaggagaattgcttgaacccaggaagtggaggttgcagtgaaccgagattgcgccactgcactccagcctggggacagagcaagactgcatctcaaaaaaagaaaaaagaaacaaaggaaattgctaagggagtagattttaagtgttctcactacaaaacaataagcatgtgaggtaatacaaatgttaaacagcttgatttagccactctacaatgtatacatatatcaaaacaccaaattgtaagccataaatatatacaattttgtcaattaaaatataagtaaatagaaattaaaaatataaaatttaaccaaaatgcttaatgatctgacaaaggaacaaggactctagcttaattgggaaagtcagtcttgaacagagagctcggagccctgctgtcctggggcattcatagggcaggaagcacccccgtggggaggatctggtggagacggggctgcccgctgggctctgggtcccagccagagggcctcaccacactcggcagggactgtcaccggcagccacggatccctgcgtgaaaccggcagggcgccacttcatcagcagctccttttactgttagcctgggaatttctgaatgaaacacacatggaggacatctgttttccaggtttccctgtcagagcagtgaatatggtgattttgtttgagaaaggaaaaagagaaagccagatatgagctcacttttgagagcctggtcatgtttctgtatcactgagtttgctcctataatatttactcctttgagagtgatatttttttcaattaaatgaatgtgttaggcaatttcaactcatgatgtttctctagcctaggactctccgtgaaccacagacagacccattttatccatctgccttttagacatctccacttagatgctggccacctcagactcagcacatgccccacccaagtcacatctcccctaacccttgtcctcttccgactctttgtcctctctttccctgagatgaagcaagccttaaatgctttccccacagcgcatgagggtcccttgtgctcagagtgcaggtgccatagaggttgtttgaacaggcccatcaaagtacccagacacctgtggatgagctgcttgccaaaccagagagaactatgcacaaaactccactcttttgggtcatcatcattattattatttttgaaacagtatctcactctttcactcaggccgaagtgcggtggcacgatcttggctcgctgcagccttgacctcccaggctcaagcaatcctcccacctcagcctcctgagtagctggaactacaggcacaactaccatgcccagataatttttgtattttttgtagagatggggtctcaccatgttgcccagctggacttgaattcctaggctcaagcgatcctcccaccttggcctcccaaagtggtgggaaaacaggcgtgagccactgcacccagccaactccactcttgtaatacacagacattgttaaggatctacagaaagtcattcatttcatattccatagtccaattaaaaactgtatttaaataaaggtaacagggtactcccttcctcattcctccctgtccttcctaatacttgtccctggaacgttctctggggcctcagctgccactctctccaccagccatcctcataatgtcttgactaaagaacagacccttgctgggccattctcattcagagggacaaaaatgacttctctgaccaagaacttttccagataaatggagactaaaggaatataatcactatatgcaacaggtgatcctacattgggctccagaccagataaaggacattcctggaacaactggcaaactttggatgaggcctgaagatgagtaatttttaataatgaataataatgttgtgtccacgcctatttcctgatgctgatcattatactgtgattatgcacgatgatgtccttgtttttaggaagtcacactaagtctctagagataaggtggcatcgtgcctgcaacttactcaaacatttcaagaaaaatgtaactgtgtgtgttggcccacatgggtttgaagtgtgtgtgtgtttgcacacacatggagggagaaaggatgaatgataaatcaaagtagttaattgttcacatttgaccaatcttgaaaggcatagaagaagtctttgtaccattttccccacatctttgcaagtcttatattatttcacagtaaaaggttttttttaaaaaaaaaaatcggctaggcgtggtggcttatgcctgtaatcccagcactttgggaggctgaggtgggtggatcacttgaagtcaggagttcaagatcagcctgtccaacatgttgaaaccccgtctgtactaaaaacacaaaaattagccaggggtggtggcgggtgcctgtaatcccagctactcgggaggctgaggcaggagaattgcttgaacccggtggggcggagattgcattgagctgagatcgcgccgttgtgctccagcgtgggagacagagtgaaactatgtctttaaaaaaaaaaaaatcttaacaggtaggaaaactaaccaggtagtgacctccgaacttgaagtacttctggtcctctcaggtgcagtctgctccgaattcaagttctactgttgggtttccaaagaggctgagctctctgcttctttcaagccagattctccaaattcccctcacccggctaaacagacaatatgtcttcctctcctggtgaggtctcccggtgacctgagaggtcatatctatatctactccccatttttcatgtagaagcttgctttcctctttgatatctcactaggttccactttttctctctactaaaagagccaaaggctgggtttatccatggcaacgtgtatcagtcaggatctgtgcagtaggtcatgccgcactaacaactgcccctgaagttcagcttacttaactttgtggatgataacttttgagttgattgctcactcgtgccacatatccagcatggcaagtgagggcatatctgtgttcattgtagtcacttaggagctctgggtgatggaggcgccatcttgtctcatgcttccaaaatcaccacagcagatgaaaatgagtgtggtgcattactcactgactctttataagtttctttctttctttccttccttccttttttctttctttctttttcccttcctttcctttgctttgcttcccttcccttcccttcctctctctctctctctctttctctctctctttctctttcttatacagggtctcattctgttgcccatgctggtgtgcagtagctgtgtctcactgcaacctctgcctcctgggttcaagcaatactcctgcctcagcctcccgagtagctgggatgacaggcatgcaccaccaaacccagctaatttttaatgtttttggtagagacagggtttcaccatgttggacatgctggtcttaaactcctggcctcagttgatccgcctccctcggcctcccaaagtgctgggattacaggcgtgagccactgcacttggccgtaatgtttattttcaaaagagacaagtgatttccgctcacatttcattcaccctgaagttcattcctacattttgtttgtgagaaggagagatagaaatgcatttgttacagccctgatgattgtcgcagcactaaagctcagccgttaacctgattttgacagtgaaacttagcatagcagcaaaagaggcatgcccacaagaagcaaggatgctgagggccaccagggcccaagttggaattacagattggccaagcgttgcctgagcatctcctcctctgagaggaggccctgacctgctccgtgtgtgctcccactgtgacctgcacgggcttccgtcttcccaccctagtatgctttcactcttattttgtcataattttctgtcttgttaggtaggtggattttacatgcaccacagatgtttactgaatgcgcctatccatagaagacacctattatttgcaatagaaggcactgcactaggttctgggatataagaacaaataagacattggttctgccctcatgacatttcctggcctgccatgaagacagagaggaaaacagacattttacattgagagagtagagctcagcacaactgacctatttgggaaagcaagagcgtggcgagaggaggggaggacatgggagagagctgttctgcaccacactggataaacactgtccaggttctccatccatcattctcgccagccaagaatagggtccgtgacatgcagcatgccagtggtgggattagaagtcagggtttagaggctactgatgtgtcctgtttttgcaaacaagaaatacttattagacatctgctacaatagtaaaggctaattctacttacatataagtaacactttataattcaggtacccctggaaatcatggctcgttttacaaatgaggacactgaggcaggtaacttgttggggtccttaaaagtcccaactacactgtttagaactcagggtcctgattcccaggccagcgcactttccagtaatccatcctgcctggaccttgtttgagatcctacctgcctgaaggtcctacagtctccaggaagagtttacattcactttcctgacaggtgtggggaaaagtcacatcgattcattcacagtccttggttaggatgagccaggtggatgtgtaagatcctccttttctctggcttgctgttggataattataaggatgaacaacgcacaataaaagtgacttttcaggaggtaccgtctacacttgagatcccagctaccaagcagatggtttgctgactcacagctgctgctgtagccagccctgcttggtgatgtaactgctgtgggatgcagaaatatgggagggggaataagagcctggggtcctgcttctcttgccaggattcacttgtctgctacaacttgcagccaaggaaaggatgctgagtctctggggccaacacggggaaatgttgtggctgcaggccaaccttatcttttccattttctgaggtttggaaagatttctggctcatgctagcctcccattgattaaatgagataatgtatgtagaggccttggcacatagtacatagccaataaatggtaaccgctgtaatagtaataattacagtaataatggccttaattactgtagtaatagagcaataattatttaataatcatagtaataataaatatggtaatataataatcagtggtgtggggagagtagtgcattgggagggaggctcccagtgggaaagagttgtatcagtgatgcaagaaaatgaaaagcagactgtgtgagaatgcgctgtacttgccctacaattttgctggcaagctaaaactgctctaaaaagtaaagtcaattattattaatatatttttttttttggagacagagtctcgctctgtcacccaggctggagtgccttggcaccatctcggctcactgcaacctccaccttctgggttcaagcgattctcctgcctcagcctcctgagtagctgggattacaggcacgcgccgccatgcccagctaatttttgtgtttttagtagagatggggtttcaccatgttggccaggctggtcttgaacttttgaccttgtgatcggcccgcctcggcctcccaaagtgctgggattacaggcatgaaccaccgcagctggccagtgttttttttttttttttttttttaaatgaaagaacaaaatcccagactgatgataagttgttattgtgtttcacttctctaaagacaaggcgcctccttattgcctgtaccaggtggaccagtttctaccacccaaaccttggtgtgccatttttaaatggcctcattggctatgcagatactcaaatgagtcatatgttaatgaagaagtaaagtttgctggtaggatgaaagctccagtgactctttattcaccactgggtgttgttgaatgctggcgaaactggcccaggacatggctgggcacagaagctgcaggtcttgggctgctggtggctctctccacggagctaagcagccacctcatctccactcagcatggctgcagtgggtgtcttggctgtgagcggcccctgggagggtgcccaccacgccccatgcctagtgagagctctccaaatccacagaccagggcaagacttgtaccgacattgccaatgggttggcttcctttcctttgcctgatgcaaggttctctttcctttgagtaggaaaatgcccagataatcagagaagtggaagtggacaaggtctccatgctctccagggagcaggtggaggccatcaagcagctctggcaagatccaggcatccaggagtgttacgacaggaggagggagtaccagctgtcggactctgccaaatagtgagtacagagcccaccctggccgcccgcggtgctttcaggcaagctcggccacacttcaaagaagtttctcgctgaacgctgctgaaatgcggtgcacagtggcagcgctacttgcctttgctttcccatatccctcctgacctcttagtgccatctctcaccacctcctaaagccctcggtcactctgtggatcgcagacctctcttcctgccgacacccgcctgctcttgctgtgttctaagcctgtcgttttcaatgagagactcaaatcaaatctgaggtcccttaagtgggactgatctccttaggagtgctgaaattatctgatttaaacaagaaatacccttgcttttggcttctactttcctcctctctatatccctctgcctttctggtttccccatcagaagacagcaggtccaattgcgctaaaatctaaagtcaagtttagagcagcggggccgtggacccatcagctgctgatctggtgctgtcctctagtggcacagataggaggctgcgctcgcagcacacacaggaagctcaatcctttgtttattggctgcctgcgaaggcctacacactgtattttggatccatacagctcaatttttaattcattaatccttgaaggtaaaaagatttctatttagatgtcccagcatgcaaactgtcccatagagatgacagattttcactttcttgggcatttcctgttcacatctgtaatcccagggacttgggaggcagaggtgggaggatcgcttgaaaccaggaattcgagactagcctgggcagcagagcaagacctcgtctctgcaaaaattacaaaaattagctgggcagctgctcgggaggctgaggcgggaggatgtcttgagcctaggaggttgaggttgcaatgagccatgattacactcctgcagtacagcctgagtgacagagtgagactctgtctcaaaaaaaaagaaaatgtaaataaataaataaataataatatcccggggcaatgcctcctcagtctggtcaccgggtaaatagtttgatatgggtccttcttaaagtggcaataactcctgcttctgcagctcagctctttcacacctgtcccgtatcatcttccatcctctgagggctcagaaatcccttccccagacgtacctccttccctttgggtgccactgtcaccctctgagcaggcattgagctggacaaggcattgggcaggaaagaaagccagaagtgtcacctcctgtggtttcaatgggcttcctttggtgtttatcccgggctgagaattgaatgtcattaatccaggttggcacaaccaatctaagtacaggaatgtttagatgcaaaaaagcatcaaggcaggaaaatacagaaaccccactgaggtgttagatcagcatagagaggtggaagaaagaaagagtgccatggaggagggcttgcctttgacagctcgaggagccaggaacaggtacgacgttcctgagccatacctgaggtggcctgagttacctgcctctgtgaaggcctggggattggctagggctcttgatgtagatccatttggaaaagatccaccagacctgctacagaattcagtgtaaccctgaaaaccatgggggcaaggccactgacatggacgaggggcgtggctagggtggtgagagctgtcacagagaaaacagcctctcctaaacccagtcgcccaaccttccaaaccggcaggactcaaggcacttgcacgttttctccatctgggccagcggttttcaacccctcagctagagatgtctgctgattggacaatgtgatgagtgcttgtgatgcgccaggcactgtggtaagggctgcaggtattatacaaccagtgctctctgctctcagggaatatacagtctggtggagcaactcaggtgtaaatcaaataattacacatcaaagtacagcaaaaacagtgataagccctgggactgtatctgggcagagaggtgggttgtggaaggctgccccagagctttgcttctggagctgaaggcatacggtgaacagggtttgcctgtgacctcttggttagcctgcatgcggacctgctcagcccctgatgcggtgctgggacagggcagggccgacctcagcatgcagcgggctctgcatctacaactcttttgttagcgagggcctgagttacagttattttacctaaaagtgtcttttagaaaggccttaaagttttttttttttttaaaggattctcttattttactacagaaaaaaaaaatatgttttaagctcagggcttcaatatatggccaaaaataagttaaggcaagttttgggttattttaggagatgtagtttcccagtgtcttcaagaggaaaacttgttcttgttgctgttgttttgaatttctcctcggcctgttttacgcctgtgtattttcttagaaactatttaattcattgagcaaagctttagagaacagcatctccattatataatgctcttggacaagggtgagtgggagggagaaggggctctggagggaggatgacagatggggtgttggagagagccatttccaacatcctggtccttccagccccactgtctccctcgctggtcaaatagaagcgatagagcttagaacccaggaggaagagacggagtgctctgcagatgtcccagaaggcgcatggaagtccttctgacccatattgtcttcaaaacagtcgtaggaaggatggagaagcctggcctggcactggctctcaggaaagtcattgatggaattcgtgtgtctgtgtggggctcactgtgagtggggggtgacttcctttgagtaggatggacatttccccctgctctaaaaggagagtcagttcctcgttctctaatatacagttacctgactgacattgaccgcatcgccacaccatcattcgtgcctacccaacaagatgtgcttcgcgtccgagtgcccaccaccggcatcattgagtatccatttgacttggaaaacatcatctttcggtaagtctgtctccctgatgtaccatgaagaatctgcccaggcttggaagtccccaggtggattcttaaacgtgttattcctaagcagggattatatctcttaggacagagtgaccctctctgccaagggtatttagaattgtggtaggtaggtctcaaccctggaatggagaggaagtcaccttcctgttacccttggagaaaaagggtttccttactggaaactggaatgattcttatgtgtaacacacactcatacacacacacacacacacacacacacacacacacacacaaatgtatacttctgtatcccacaaattgaatgtagtgattatcgatgtcttttccttaaagatgaatcatatttcctttctcctctatttccttctccaagatttatccttagaaaattaaggatacaaaaaatgtgtatgaaaactgtgaagaataatatgtacaaactaacagctgtgtaaaaatgtatgcatttccacttacaaatataggaaatacttttaggatgacttagtgaatcttcactgcatttagttatggtaaaaaatgaataataatatagggcatatatgtagcactgcacatttcaaagcacttttatatccactgtttcccttgttcctcctaacaattatcacacacgattttctagttgagacaacacatcagtcctcccacatccgggtcctgtctgatccccagttatagctcagtgcttctctctccagaattgctgtgtttgggaagccctcaggtccagcccctcaaacatgtcccccatctatattagcatatccctgattttaatagtagccctctgtgcctgtgtgcccatgaatttctctaaaccttttcacaattaactgctttttgcaatgtccaaaacctctcagactcccaaggattttgtttattcgttttgttttaaaaaatacttttatttcttctaagtttatccttcttggactgcgatgaatgggttttgcattactttctagaggctggtgaatgggtttaacatcatccaccagtgaaatctattactttacaactcagagcacctctcccagtgggatatttctggctgaaaaattccgatctttgaaattgaggcttttatagaatggcttcttcaagctcaaccttttgacaattgcaatgtcctgtttcaagatcggttccctgctgtgatagccagccatgaacatgtcattgtgggagtggctgcacctccaggacatggttcaagaacagtattgaatttttcattttccttcctgcacttttccagacaacagttctgggtggttggcctgtggaccacctaaccacaatgacccagtgccttcagggactggtgtgtgtgtgtggtggggtggtgatgtaggggtgggtgggggttacttggcagctgtatctggtccattatgtattttctttggctcacttggtgttactaaaaaaacgtttgagctaacacattggataccttgtttctcctgaaaaggcagagactgtggtcatggcaagcctgcgtcttgttctgcagagcttggctgcaggtacgcggcaggcttccctgtagacagggcccccggctgttgtgccatgtatgttttgtactttggggagcccacttggctcattcccataaactgcctgattcttgtagcatttgagctcatgatccctgggctaggagttgctgaaatttttcccaaagacacagatatagaggctttggatttctgtactggacagaggacacttgtaggtttttatagggaacaagaggtggcatccagggaatgcagaaaggatttacaggtaagttagaggagccacaaaaacagaataggctcgggtcctgaagccagcctgggagacccggaagacagctggccgctgcgtccctcttgagtctggtatccagggactctacagtggttgtcacagaacccaagtgaacgtttgcgttttctgtctggacactggttagcttcctaaccggcaggctccctgagtcacctctgcatgtcttcagaaatgtcatttacattctctcccttctttgctaggaaacatccagtggtccctcattgcttaaagcagcagcatcaaacattttaaaacttagaacctcttttctctcttagaaattactgaggactccaagagcactggtttccatgctataattcatgtcctttttccccgaagtgtcatgtattccaacctttgaaggatctgtgtttctacacaacaggatggtggatgttggtggccaacgatcggaaagacggaagtggattcactgctttgagagtgtcacctccattattttcttggttgctctgagtgaatatgaccaggtcctggctgagtgtgacaacgaggtatgctgggcgggaagtttgggtagctgtggaagccagagcctattctgtggtttctaagaaggcagccgggtcaggaaatagaccctcgtcattaggtcaaacagtcttgctactcaaagtgtgacctgtggaccagcagcacaggcatcacctgcatggcttgttagaaatgcagtcttactgaatcaaccccgaccaactacatcagcatctgcattttaacaagaacccaggtaattcaaatacatatgaaaggctgagaatcacgggcctggaacctgggttctaaacttgaatgcacactggagtttgctgagggacttaacaaaaacctggtgcctgagtccaaccccagagattctgaatgaattggtggtgaatggggcctgagtggggggatttttaaaaagcaccccaggtgaatccactgtgctgctaaggtcggaacctattcaaaagcctaggttctcatccttggtggcacagtggaatctcttggcgaggtttttaaaaatgccatctcttggctgggcacggtggctcacgcctgtaatcccagcactttgggaggccgaggcaggtggatcacgaggtcaggagatcgagaccatcctggctaacgtggtgaaaccccgtctctactaaaaaatacaaaaaattagccgggcgtggtggtgggcgcctgtagtcccagctattcaggaggctgaggcaggagaatggcgtgaacccgggaggcggagcttgcagtgagccgagatcgcaccactgcactccagcctgggcaacagagcgagactccatctcaaaaaaaaaaaaagaaaaaaaaaaagaaaaaatgccatctcttggactgaacactaaaaattcatatttactgggtttaggttgaggcttcttttgagagcccaccagggattctactgcacaaccaatgccgagcagcactatctctaaaacactttacctgggcacaggcttcctaacctccataggcccatggtgctcccaaattagatccctagtggaactggggtgggcagtggtgctagatgcttggagctgttctggggctgtctgggattgcatctgccttcacgtctcctgggagggactccctcagggcagctgggatggatccagcctggtcaggcatgcgttgtcccctcagagtggccatagcactggctgcttccaattccatcagtgggagctgccctgagagtgaagaggaccctcacagccacttctctgtcaggttggggacagtatcggtggaacactcatgtcctcctcgtcatcttttcccctgaacttgcattaagacctcttgaccttttaaaaaatgtcttttgtttccaaggcgtgaaagtaaatcaataaaggactcagtccaggattaggcaataactgaacaaattgtatcttgtatttcttgagagcacacttttctctgaggagcatagcttatattacctaattagtggaggattaacccatttaattgtgtcattgtgcaaagaacggaaatgctggctgtcgcccagccctctcagttggagattttttttttttttttaaaggcaagacattcagttatcaatataaaaaaaatagctgcaaatttgtttcaggaattatttgtgacgttcctcaggaaactcaaacgattagtaaggtgcacaagggaccagtatctcagcccaaagtgcttagaaattaaacattttctcttctaaaaatcacaaaatatttggagaaaaattaagtggttgccactccagactttcccctcctggttgtagatatgtattatatccactctgtatactgtctgggaagttttcatatattttatttccttggagatcattatcattcagatcataataattttaaagctttaatacattccagatcgtaattcccccaatgcgtactgagtggcagaacaaacctgggtgtctggaagttgtggggaaagagtgatttatggcgtgtccctcttgagtgtgtgtgctgagcttggatgtttttcactgtgatcccttccctccctacagggaagttcttgtttctttcctcttagaaatacttgagaaagagcagaatgctatctagaacaattattgtcacagataagatttgtttgtgccctgtctgttctcagtaaattaggagcatttaatatcttcttgccaatgtctaacatttagaaattatcactgtctttctacacaaccttccccaggtcccactattacatgggcttgggaaagttatttgaatgttctaaacaaggccaggcgcggtggctcatgcctgtaatcccagcactttgggaggccgaggcgggcggatcgcgaggtcaggagattgagaccatcctggctaacacggtgaaaccccgtctctattaaaaatacaaaaaattagccgggtgtggtggtatgcacctgtggtcccagccactcgggaggctgaggcaggagaatcacttgaatgcaggagctggaggttgtagtgagccgagatcgcgccactgtactccagcctgggcgacacagcgagactccatctcagaaaggaaaaaaaaaaaagttctgaacaacagtatggtcacccatcaaacgggccactgctctgcttgtaaagtgtggcacagggtgggttcccagtagcagtgcgtcctgtctctgccaacttctagcattcctagggccagtggccttgctggaagagccttgtcacttgactgctgaggcccagtctggaagcccataaccaactgaggtggccgtgtcaggtctgaagctggcacttccccacttagtaatcccaacgatcacatgacacaggaaacttgtgaaacgtgggtaggaaccttccttttccaagctgcaccaaagcctttcttacttcgttccatgtgagttttgggctggagaagagctgggatgctacaggagaggggacccagaaggggatggttagtaagaggcttggggaggggcaaacagaagcaggaggcctgtagcctggggccccacatgctcaccagcttcagcagacagtggcccagagactgcggcggggcaagggaagagatggatggactggcaatgcgccatgttgtttccaaaatatttcctttctacttcatcccaagtcccttgtttttcacttagaatcgcatggaagagagcaaagccttatttaaaaccatcatcacctacccctggtttctgaattcgtctgtgattttattcttgaacaagaaggatcttttggaagagaaaatcatgtactctcatctaattagctatttcccagaatacacaggtaagtgtctatcttgtggacagtgttttctgtgctgatctcgtccacctcccgggcatcagtctagagttatcacggctcaaaggggcctccctggtctgcctgcaatagcctctccccctattcccaccttcaaacagaagctctagttgcaccattgttgtgttttcaccacagcacctccacatgtgcttccctcagtgcttggaatacccttaccaactcctttcgctgcctccatgttgttctccaaaacccagcaaaggcctccccttctctgggagcctttctggcttcccctgcccatctggtctgcaggaagggtgcctcctcctttctgctccctcagcagcctaacccctgcttgctctcttggccacatcatgctatgtcatatcctctgctcactcagctctcttcccagtcggctccatgagggtagagactctgcttgatttatctgtgcattcctcatgccagtcagagcacctggtgcttcttatgtgtatgttagagtgtggcatcccttttcccagacacatggtggactcacataacctgtccaaggtaggagagtctcatgccctgttgctaattgtttctggtacaggaggtctcaaaccttaagtttgacactgatatttagtggattcatgttttagcactcttctttccccttttactaaccatactggctgtgtagtgtagcaccctcgagctttaaaatcagcctgatgttagttcccacattcttccttttatctctcctagaccagagctgtctgtccatatgtgttagccaggattacttctcttcaatagtggtccaaatcagacaaattgggtcactatgtttaaacaaatcactgtaaagtacaatttttagataccagaggacattttaaaatatgactattttatgggttcatgatgagataccataaaaataatgctccaggtaaaccgttccctggaaataaagatggatcaaagcaggatctcaaataagaacaagaatacattaaaaaatggttcttggggccaggcacggtggctcacgcctgtaatcccagcactttgggaggccaaggcaggtggatcacctaaggtcaggagttcgagaccagtctggccaacatggtaaaaccccgtttctactaaaaatacaaaaattagctgtgtgtggtggtacgcatctgtaatcccagctacttgggaggctgaggcaggagaattgcttgaaccccagaagcagaggttgcagtgagctgagaccgtgccactgcactccagcctgggctacagagcgagactctgtctcaaaaaaaaggttcttgggaggacatggtgttaagtctgtgtctttattcctgtaattgcacttgtgactaggaccgaaacaggatgtcagagctgccagagactttatcctgaagctttaccaagatcagaatcctgacaaagagaaagtcatctactctcacttcacatgtgctacagatacagacaatattcgctttgtgtttgctgctgtcaaagacacaattctacagctaaacctaagggaattcaaccttgtctaaaagctgctgcccactcctcccctataacagaagatgtgatttgcaaactccttgttttatttgcaagtgcttctgacatcaccagagccagccccatgccaggaactaaggatgtcatgtagatcgtggggacagagatgggtgatggaacttggaagatatttgagtttaccaacatactttaaaagtccttacatcccaaattgtgtttataattattttcttgacttttggctataagattttgtgtaatttttgaatttggtgttttctagaatttttaaaagccactttgatttagttttaaatatgtttaaaaatagcgattaaaattatgtaagcaagg

SEQ ID NO: 38590 - DNA, 148764 bp, Homo sapiens
gccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccggtgagtgacggggccagtctggggcactggcacctcgcgcccctggaggcagctccccctcccccagtgcttgcatcgggggcgcttcccttgcacctccctggggatcccctcccccatcctcttctccgagcactcctcaaccctttttcttcttgggccaccccgtcccggtctcttccggggccccacctttggcccgtgccccctccttggcacattgcgccgcggggttgcgatttctctggcgcccacctagtccttggggcctcgccccctccccagtacacacggtccccaagtcccgagaccccgccccccctggtgtgggtggccggcgctccccttccgtccctagcttccagcaggggtcttcctgatactgggttattgggtagaaaatctcaaatcaatgtgaggccgtcctggggtgtccagcttgtcccccctcaaactcgccatcaggccttgatgagacagcagagaggagatcccctcgcttgctgctcggcaggcgccccaagtttgggaggcgggggttagaccatttctgctctctgctgatcccttctggatacaccccattcccattccctgagccccatctgccccgcagcctcctcgcagcgggtagggtgacttgggagctaactctagagtcggctgtctcagacctgcctgccttgcaccggcagagccctttgctggggcgctgggagtcgaccccggggtgcccggggggccaggcgcgcctgactttctcccttgggcaccgtgcgtggggtcggcggggcacctcagggcggcggcgcctgggcctgcgtcccgggcacccgcccacaggtggttgcacccccgccccgcgccagctgagagctgggccggcgctgcggtccgctgcagggcgtccagttaccagtgagtcttcctggctgaaggggccagatcagatcaaatcaaaccacacattaatcgggcgcccactgtgcacccggcgctgcggcagacggtgccttcgggaatttctgggtgtgactgaggacacagcggtaattgagctttagatgaatgttacagatcatctcgaggatgtcaagggaagaaataacatacccggacttccaaggaagtatataggccttcccgggtgggagaaatgtttggacttcatgagagaactaggaacatgtgaaaagggtctcagatgggaaaatcagagcctgcctggcttggagtttaacgcttcccggtgtaggctgaatttcgagacagtttcaatttatggcaattttatttttgtggttctttgtgctctccataagatatcattttgctatgaaaatacccttttggggcctttttattgatggaaaaggagccaacattcgggtgcttagagctgttgcctttaaaatagcataaaaatgttactgttccccaacaatgaggctctccagctttttattcagctgggagaggaggcctgaggagccggggaggaggagaggggagcaggctgcctctggagtgggcagcttgtgttaggagaggatgtggcgtagtttgcatctcggatctgggaaaggaatgctatccttgggaagtttgacagtgctccttgccggtggttttctcatctgttccctggggatgattcgtttataaaatgtattgcttgtcagctccatgagacaggcttaagtggtgtgcatggtgaatagacccaaacaggtacacaaacgaacaggttgggacaggaaggctgactgattccagccagtgtagccctcactggagcctggtgggggaaggggatatttgcatcctaaaaggtttcttcactttataaaaggctgcttgacaaaagaattcccctgtcccaggtattcccaggacggcaaatttcttgattcctctatgatgtgacttagtgaagcccacattgtatttatgcgcgtgcacacacacacacacacacacacacacacacgtatatgccccctgtccacaggcagataaaaagcaaatgctggcttgtgtcacgtgagctctcagggaggaaagatgaagaaaaatcgccagtgggcacagctcatcgatttaaagatttattagatattaggactgcatcacagtctcctacactaatcttcccagatctgagtgtgtgctcctgtaattaattctgagttacgaggttaacgccaggcggccagctccccaatgcatttgtagcatttgctgctcctcagacccacttcactgggctcactctttatgctgtcctttttgacatttggccctgcttgtcattattctcttttgtgttcctggatttttaccgcttcctgggccctggtgttgccttgctgcttgtcgcaagataggatttacctttgaccgtgataccccaagctggcttctcaggcacccagggacattgccaggctaaatgtctcctttgtaataaaaaccctcaggcggcgttagccttgagaattcctttgctcaacctcctaaaagttggctatgtgctgtcataaacctttttattagccctagttaggatgcttgtgttctgaaattgtctggaacacaataacaccctcagtgtgaccgtgctgtggcacctcagtccagtccagaccacagttattgggcgtctccaatgtgccaagctgtgtgctgcagacacaaaggtgaatgagatgtggcctggaggctcttgggaaacgcaggtgaaaacacgtttcttttattctgggtgatgctaagtgatatgactggcacacccagacagggtgctgtggccggatgggatgggggaatcggaaggacttccaggagactttgacacttgagattatggggtctcagatccagtgtcccttggcaaagccacaggccagttgttgtatataataaagagaaaagtagctgcaattgtttcttctgacagggcttggagcccccttctctggtgataggttgagtcacctagcatccctgagtgttcttttttttgttttgttttttggatatggggtctcatctgtcacccaggctggagtgcagtagtacgaccacagctcactacggtcttaatctcctagccgcaagcaatcctcccacctcagcctctctagtagctgggactgcggttgtgcaccactacacccggctaattaaaaaaattatttttatagacatggggtctcactgtattgccctggctggtctcaaacgtgtaggctcaagcgatcctcctgcctcagcccctaacagtgttgggattacaggcatgagccactgcgcttggcccctgggtgttcttagtctttgctatggatagtcagcagctttccagtctttgataaaataaaatgtgaataaaaggatctttttaaaaaaatctataacatgcagtctaaagtggacttgctgtacaaacccaacttccagatgagcccttgctcgccctaccaaccagagtgccagcctgagccagtcctcttcagaaaccctggccctgccttcgacagcacctccctctccttagcctagctcagccctgcccaaccctcaggtgtggtctggtcagagcagggcaggactccctccctcggcctgccctagacgctttccttctattaatgcagctgaagatcccattagtgtgcttggcagcggcacccactgttgactcatattagctctctgttgactaaatccctggcatcgcttttgctcgtgtggctgttgctcagccccgcctcccgttgccctgtgtgctcagtgtggaaagctgttaggatgtgcggtcggccagttagcactcccgccatgctttggagggaacggcccatgggccattgttgcatttggtgcacttgcctcccctgcatctggaactcaacattgactcattgtggtccagtgtaaacatggaggatttcagaattcgaagatctacctttgcatattgcaccctggctctgcagctttgggcaattgcagctctctgagccattgacttcctgatctttcaaatggggatgttgggaggatttggtgacgggaaggcctcatggtgcaacagagtgctgaaaggttgctagtaggttgtaatcttagaaacctctccttcctctactttgaactttggaaagatttgaagaagtttctagtaatagacattaaaaaaaaaaatgctgtgccaggcaggctaaccattgcttggctcttctttagtggaaattggaagttggatgtagtatgagaaatgctttttaaaagtttcactttggatgtgaaaagtgatgtttttttcagcaaaaacaggagaatccaggtttttagaattttaggactgaaacctctgatctcacataacatacatgatacaacataaaggtcatatggcttattttggagttgaaggggaccctggacagcacctccccggcccattggagaaactgggaagctgtggtctgtggctataaagtgacttcccttcagtcagtcagtgaaagagttggaaccggctgctttgggaaccctgattgtcagcgtctgaaggtgtcaagcgtagggtcagcagtgggagggaagactaaccccacgtcctaacacaggatcatggaagagggatggggtacattcctggcagttggaaatagaacagattttcccaaacagtggaaaaaatgatcccaacttcagtgttcacaaagttcatctgggattttttttcttccattaaaattcccagagcacaccccgagaatttcttgattcagtatatcaggaagctcaacttttaacaagttactccaggtgattctgatgcaggtggtctcttcacagccagtgaaaaaccctggccctagaactgtgagaacagaggcagctacaccatgcattataaactgctgtagcaatggggcgagcaataccattgctgtagcaatggtaggggggttggcagtctttgagctggggtttgacctgtactttagggagcccatttttgtcacagtggagtggagggctaggggagggactggagaccagtcatgccattgcatttgtcaggtaaggggtgatgagggcctggctaggagaagggggcaacggtagagcagctcacaggtggagttgggtgagtgtgttggggagggtgaaggtttgagatagagctgtcttcactcttggttgggaagaattaagggacccgcaggaggttgaagacagcttctcatttctaccctttcccaaggctctggctgccatgggcacactggcttatcccagggctctgggtggcttgctttttttgcccctgtagggtaggtattggctaaaggtggccttccactacttgccccacccacatcccctctcagacctggaatgaggccttggatatctagtgggtcatgagtttgtgttatttttggatatgccttctttgttttaaaagaaaggctgaggtgggggggggtgagagaggggtaatgaacacccttcccaaagggggtgtcgtgatacaagcaagagcactaactccccttctatacttgctggatttgtcagtgttaataaggggcgggggttggcctgcagggggaaggggccgcagcctagcctctccagtgccggtaacatgaccctacactggtacagggctctgaacaaatattaacttgctaagcactttcacgtgcataatctcattgaattctgttcctagtaccctgcagtggatgaaggcacaggtctgtttcgttttgaaatagcagaaggtcgatgggggtggggccttcccttaaattcttgcgtggggacttagaaaaaaatccagcctggcaaccacagaaatcctccgcctaccatttgtcctcaaaacacgtgttccatccttgcccactgcttgacttcctttggccggctgggagtgggctcctccccgggcctctctctgccctgcctggagccttctcctccagtgggaactgcactccagtttccacctgtagcccgtggctgctgcctgagggcagggtcagctgctgattcatctgggtgtgttttccaggttcgtgtgtgtgctctcctttcatttctcgtttacaatgcattcatcgaagacccatttgaaaatacacaaaggttggaacaacatctacagtttcattaaacactgttaaaataggggtgcgcattcatctgtgctttatttcatattcagatataaacatgtttttaaaatgatgaacttaagtgggttgatggaagtctctgtctactcccacctcagcacagttgaataaggatggtcgacttggagcttgtatctctttagggtgaggccctcggctctcctctctacatttcctgggactcttagctggggtggggagcccccagtgcttgttagccatctgcgctgtgtgctgcctgctgcccctcccttggtaggaagcaagctgcctggcactctgaccctcctcaccacaattactttctcttgctggcaggttaaaggtcttgttgatgtgacctcagagtccccttgcatctgaaagcagctgctatggggcagtctcgactctcgccagcccaggatgcctgtgactctgctaccagccagagctgacctggcagagtggggctggagccgggcagcatcctggtgtgcccccccaccaccctaatccctctaatctcactccttctgcagcctctgtggcctctctctagagctagattaattttactagtcccacctgattttaatttctggtttattttaaattgttttccaaaatgtttttgtttgctcacaatatgttttcttcagtcagcaaaggcttactgagcccttacactacattaagcatgggggaggggtatcggagagagaagagtgtttcttaagctcccagtcttgaggggcagacagagtaaacagatacccataaaccaacatggggtggtgccgggggtgagcaactgaagtgtgggctggagttggagaaggtttttttttctttttttggtaacattggggtctcactatattgcccaggctggcctggaacttctgccctcaggagatcctcccactgcggcctcccaaagctctgggattacacgtgtgagccaccacacccgggcagctggagaaggtttggtccccagagtgacaatggaattgccccaaaggatgtgtaggagttcagctgtgtctgggtggagggaacagcaggtggaaacgcgtggaagatgggggtcagaaaagccccatccctgggctccgggttccttggggtaggggattcagatgagttctggctgtatgcctggatcttaaaggagtgagtgagtgagttgcctttgaaatgaagatgatgtcgggaccccatctaggtgattatcttgttgaatcctcacaaaaactgtgttgatggttactgttgttattcctgatttgtagaggaaagaatcagggtttagcagacaggttaagaaacttgtccaaggtcacatagctagtaaaggcagactctagcttgatttgtggtctgggaaggtctctgacagcacagctgggcgaggggggtgggagggctctgagcttgccccagaggttccgagctggatggcgacccctgagcccccaaagggcttccacctttgtaggccacttgggatcagatttacttctttagttagactcattgaatgtcatttcactcgagtgcataatggtttgatggccataattcaacactcagatcagaagtaggtgatgtttttaaaaagtgcttagtagaacaacattaaaattatctcaaagaaaaacattttcatattcctatcctgctgcatagcaactggttggtttcactttgttcctttccatctttgtgcttttgtatacatgtttataagcgtggtgtatatcctttaaaacatttttttcttttctcctccccatccacatttcttgacaggcttctcaccagtttggtgccctcttttgtgtgtattctagaatacttaaattcaactcttattctctgctgtgtgtgatgtggtttgagtgagtaatacctgtctctgggggcttggaggttgatatgcaaagcacctgatcacttacgcgtcaggcagccccatctccaaggcatgcagaatctgtgttgcttcccttaatcactgccgcctgggaaggtgcacgttatcatcccctttgcagatggtctcggagagcagatggcctcgggccactctgctggtaagtatgggagagccagattgaatttaggtttccggactcattttccagtgctcttcccctcagcccatgctgtgcacacccagccttcctgtgttaaatgtgtgttctcttagaactccctgggaaggtcagaatttcatgcagtaaaatcccctgtcttttctgaaccactttgcctttcagcatctctggcatttggattctgtctaccatttctcagcattttttgcaggttcttttccccaaagtcatagctggctgagtgcccagcattttcttcatgaagccaagaactggaagatgatatcccaagggtcctgtcccacctgtgggatcatccggtgcttctttgttacccagctcagtccccccgggtggaatggtctaccctgcagctgtgaggatgccaactgcctggttcagcgggtgcctgcagagctggcatccctcagctctgtggtttcttttccatgcctgtctcatgagctgagtgttgtctgcagcatagcattcgctcaggtgcgttgaagtcagcctgataatgcatctcctttgctctacctgttcacttgctgagctgcacctaccctgaattatgaatttttttgaaaatcatggtattaatataaataacataaaatttactattttaaccgtgtttaagtgtatgcagttaagtggcatgatgtacattcacactgttttgcaaccttcaccaccattggtctccagacgtttttcatcttcccaaactgaaactcagtccccattaaacattaactccctattttcactccccccaaaccccgggcaaccaccattctacttttttgtctatgaatttagctactctaggtaccccatataagtggaatcctacagtatttgtccatttgtgctggcgtatttcacttagcctagtattctcaaggttcatccatgttgtatgtagcaggtgccagaacttcattcctttctaacgctgagtaatgttctcttgtaagagtataccacgtacagtttatccattcatggattgtggatgtttatgcaggtctggaccgtcttaactcggtcctacccattcacttgtggcactgccaccagagacttggatgtccccagccctcacctcgtggtgttattcttggattctgacacctcttccctgggactcttctgcatcatgctgatcatcttccaaggctgtctgggcttcgtttgggggtgtgtggcaggcaagttttctcccccttacatttttgtctgagttgcgcagtgttggcaagccctctgtccagcacattctttagatttttaaatgatgaaatataaatacaaaagactctctataacatgaatagttttagagaaataacacaatgaacatccttgtgcccaccaccgagcttaggaacaaagaccatcaccaatgctgtgaaagtccccacatgctctgtctcagtcacattcccctccctccctccctcctgaagtttgtctttcatccctttcttttctttataggttctctgcatgtgtacgttttcctaaacaatatcatgttagttttgcaggtttgtgagctgtatatacatgaatttttccttcaatattgtgtctgtgagaatttgtgtcagtgagatgactggagttcttactgttttgtagttattccattgcatgcatatactggaattgatcctgtgtggacatttgggatgttttcactttggaactattagggaaaaaaaacaccgctttgaactttctggaattggtctctggtgtacatgtgccaggaagcatctatcctgggtgtgtacctgggaggaagagtgggcggggccctttataatcatacaaaattgttttccagagtccccacagcatgtaaaagcttccctaatccattcttctccaacacttggcattgtcagcttctttgtttgattttaccaggatagtgggagttagtggcacctttgtagtctctaccttcccccagttgttgatggggttgagtacctttcacctatccatctctctctctctctctctctctctctctctctctgtgtgtgtatttcttaataatagagatgggatctggttgtgttgcctaggccattctcagactcctggcctcaagcaattctcccatctcagcctcccaaagtgctggcattataggcatgagctgctgcatctggccagggttgagtgtctttcatatgttgttagcaatgtgtagttcttcctggaatgttttgttttatgattttcacatgtgtttttaggtggagttgtatttttctcactggcctctggactccatgagattgtctcccgtatcccgttccgcttctgaggtcacctcggtggaataagggagcgaacactgtaagccccaagttgacaagcttccctggcaggtctttcctcactaagtaggaattaatgttttgatttcacttttcactgtgaatgagctgaagttggttgctgctggtggctttttgtgagagcaactacgggatctatagtattcacatcagctctgcccactctttttgaagtttttattatggaattttctaagcatattccagagtagcgagaactatatatggaccctaagtagtcatcttcatttccgtacttatcagtttgtggccactctccttttatacccctccctactgccctttcctgattattttaaacaaattctaaacatgtaattttttttttttaaaagacggaatctcgcttcgtcacctaggctggagtgcagtgcgtgatcttggttccctgcaacctctggctccaggattcaagtgattctcctgcctcagcttcctgaatagctgggattacaggcatgcgccaccacgcgctaattttttgtatttttagtagagacagggtttcaccatgttggccaggctggtcttgatatcctgacttcaagcgatccgcctgcctcagcctcccaaagtgctgagattacaggcatgagtctccgtgcctggcctaaacatttaatttcaaacatgtatttcagtaggtatctctaaaagataaggaccagttttaaaaaaatagagttgattgtgatagcacacacctgtaatcccagcgacttgggaggctgagatgggaggatcacttgagtccaggaatccgaggccagcctgggcaacatcacaagacttcatcaagacttctaaaaataatgaacaattattttttagtgtcagatattcggccaatgttcaaattttcttctgtggttttcagcaaggttctttcattgcatttgatagatattctatctaagactcttaacctaaaaaccttctcttcacctttttgagccatttatctgttggagaagtgaggccgtttgtcctattacagtttgttactttccgagttttgttgattgcatcctcaacattggtcacccctgaggtacagttagtaccgggaatggtcttatttcaagcatctgatcagagcacacagagatcagtaagatccttatcctcaagaaggctgagtggagatcagctgttgaatgtcttcctcgagtgtgggttcttcctccctctagctcactcctgcttgggtccccttcacatactcgggaggccctccatgaacccattctgtctctcctggctggagatgccagcagacattttagggaatgcagaatcaatgagaagggaattgggccgagtgtgggacagcttgaaccagtggggttcgcctctgagggaaccgttggagaacacctggtccaaaatctcattctggaggcggcgaaaggcctttcccatctgccttggaaggctgctcactccagtctgctgctgctcaccgtggcaaatgagcagtaacaagggtgtaacaagtgtagcttcctgcacgtagccccccagcgcttatgagcgacatccagcgagcctctttgcccctctgagactctgccatctcttctgaaagcgaccagggttctcaaccctggcacatgagagctggggctttctccagctctcctgcccatgtgatggatgtgggcatcatccagggaaggccggtagactgtaaaagcctaccggggttagttattaacctgcagcgcactcttgacagcccattccatggcatttcaccgactggagtccttttattgctcttgcctgctggggcctgagacccaaggcccatatcacctctgctcagtcggttacaatctgtattgagtggcatcagcactgctttgatggtagcaagaatggctggttaaagtccagggaggggcccaagctggcttggaactggcccaggtcatgcacacagccagcagtgacacatccaatgggacactccaggatgaaacctgagaaaggaggtctgggatatgggatattgtaatgggagagcaggaaatttaaggtcggaggtatttgtttaggatacctcagtattctagagctatgggatttattttgctttgaagtccagaggtatttagctttattctaaaagcgatgaagttcctcttaattaaagacgctcctggaaaaaaaaaaaggaaaaatttaatgctgtcttttaaaagggaaaggattgtatgtactataatagaattactgtaacatgtcgtttattaactcgcttcagggaatgagctcttccacataggtaagttttccagatagttacagttgcatccatttactgacaagaactgttttatttcagctatttcatttatttcttgaagaaaaaaaaaaaaaaaaaaacaactgcagcacatctagtgtctgtaaggccctgtgggaggaatacaaaatggtcaaatgtatgggcgttgctctaaaggagctcatttagggtggggtgtggatgttaactgcattaccttgactttgccttggtggcccccagtggattcttgggtcagctctgtatagtgttccagccttcaaagcattgctttactctgccttttcgaaggctggctgattaataagttaatacaacagtggtttttgatgtttactgcatgcttagaatcttctggggagtttttcaaagtccagcttctaagctataccccagactactgccaccaagattgatgggcttgggaggtgggaccccttcaccagaatgtttttttgtttgtttgtttgtttgtttgtttgtttttttgctcgctctgttgcccaggctggagtgcagtggcacgatcttggctcactgcaacctccgcctcccaggttcaagctatcctcctgcctcagctcccccgtagctgggattacaggcgcctaccaccatgcctggctaatttttgtatttttaatagagacggggttttgccatattgggcaggctggtctcaaactcctgacctcaggtgatccatccccacctcggcctcccaaagtgctggggttacaggcgtgagccaccacgcctggcccagaatgttttaaaactccccaggtgattctgaggtgcagtcaggtttgagaaacaatgttttacagggctccttcccttccttttgtgtggtgttgtaggtttagatcaggctttcacctttgatcatttcatttaatccttatagcatttactcgagagaattttgggtgttctaattttatagaaagctcaccagtaagattttggccccatatcccacagctagtaaatacaaaactagacttaaaagtcatttccaggctgttcaagtccacttctccagtttttcttcacggctgtcactctagtggctctctggcagctccccagtgtccccttcacttctcacctgtgtatctgtacctgtgccttatttttttaatttaatttaattatatttttttgagacagagtctcgctctgccacccaggctggactgcagtggcgcgatctcgactcactgcaagctctacctcccgcattcaagcgattctgctgcctcagcctcccaagtagctggaattataggcactgggtcaccatgcccagctaatttttgtatttttagtaaagacggggtttcaccatgttgaccaggctggtcttgaactcccgacctcaggtgatccgcccaccgcagcctcccaaagtgctaggattacaggtgtgaaccaccacgcctggccttttatttttattttgattttttgagacagagtctccctctttcgcccaggatggagtgcagtggcgcagtctccacttactgcaacctcctcctcctgggttcaagtgattctcctgcctcagcctcccgagtagttgggattacaggcacccgccaccacacccagctaattttgtatttttagtagagaccgggtttcaccatgtgagccaggctggtcttgaactcctgaccacaagtgatccacccgctttggcctcccaaagtgctgggattacaggcctgggccacctcatccggcctgtgctgccttcgtattggctgattcttatcccttaagggcctagccatctttcagggcctgtctcagatgatgccacatttatgaagcttatcccatcattccccccatcctcccaccccaccaccccaccttcccgcgcttcttccacttctcccatatagcattccctctcctcctaggagcttgcagggcatttttttgccttgggtgggacctagcacatgttatagtaattatgtagtaattcaagcaatagatggcattattgacctttttagtttttgcaagtgatttttaaaattgtggtaaaatatacgtgacacaaaatcgaccattagtgacatttagtacgctgacattgttgagaaaccatcattactatctggctctggaatattgtcatcaccccaaaaggaaaccctctacctgttgagccgtcattcctcccctgttcctaaccccgacagccgctaatctgtcttctgtctctctggatttgctgtccctgggtatttcatataaatagaatcatgcaatatgtggcattttatgtctggcttctttcactcagcattatgttttcaaagtggattgaccatttacattgttccaagccctttccatggcttcactctgacccctcatccccccatggagtaggcagttcctattggtatcctcattatataggagattgaggcacacagagatcaggcaactaggagagaacacacagtgcctaagtactcttggcccctgcactgtcctgctggtgtctgctgttgactttgacctttagaagggcaaagatgaaacatcaaggaagaattcatctatggtataagaacaacatatgatacggctccaggagcagaaatcattagaggtgcccctcgggactgcagaacagaattcctggggttgattgtgcgcttaaagctcttggtttaattggagtgaatcagtattgctgtgaatttccctcaaatgttaggggtcaagtataggattgtatatctagtattggaagccagctggcgttctaagaccactgaaatgttgaggaatgagtcttaaggactcagaaaggcagaggtaccccaagtaaaggtttcttttcaaagtagtgcttactatgtgccagacacagttctgagcactttatgtatctttacttggttaattctcacaaaatctttacaaggtagctactgccctgttttatggataaggaagcagaagtgcaaaacagttaaattacctcatcaaggtcttgccactagaatgtggtggacccagggagtctggttccggcatccatctgcttcattcttttccctttaaaaattttaattttctttttttggttataacatacctttcccaagacagtgagaacagaacagcctagttgcttgaataggaagagaaaaagggaaaaaacataatgggaaaagcactgattttattttattttttataaaacttatccggtcatatcagttctgtgcctttaaaaaaaaataaaaggctgggtgtggtggttcacaaccataatcctagcatttagggagaccaaggtgggaggagtgcttgagcccaggagttcgagaccagcctgggcaacattgcaagagaccccttctccacaaaaagaaaagaaaagaaaagaaaaaaaacccagccaggcatggtggctcacacctgtgatcccagtactttaggaggctgaggtaggtggattgcttaagcctgggagtttgagaccagcctgggaaacttggtgaaaccctatctctacaaaaaacaaaaacaaaaaaaaccagccaggtgcgatggcgtgcacctgtaatcccagctacttgggaggctgaggtgggaggattgcttgagtctgggaggtggaggttgcagtgagtcgagatcgcgccactgcaccccagcctgggagacagagcaagatgctgtctcaaaacccgccccccaaaagaaacccacaacttataaaaataaaagtaatacatgtttatttgataatgtttaggaattattgattaaagaatttaaaaattgttttttttttatttatcactttcaccaagtgatcaccacttcattaacattttggtgtatattcttgcctctttttttctaagtatggagaaaaaagttttttcaacaaaaatgggatcatactatgtataccctttttttacccctttttttcttttcttttctcttttttttttttttagagatggggtctcagtcagtcacccaggctagagtacattggcatggtcgtggctcactgcagcccagaactcctgggcttgagtgatcctcccacctcagcctcttgagtagctgggactgcaggcgcatgctactgcacccagcttcttttttttaattgtgataaaatgtaagcttaatctttatattacactgtctcttatgtttgaggaaaagcttagggacatctggttctcttcatgggaaggagaaatcttatctttgcagccagggaggcagctgcaccctggtacagaaggatccagaaaggccatgctgtgagaaggcacattactgggcctttatgactcgtcataggaccgaagttggccagcaagctctaagatcctgtggagaacgttggatcttcgggtgtgttcttagtcctcatatagtcccctaggtcaggatacctcagtatcctgacagggatgacatccctgtcagtcatggcagagcaggttctgcagttccaacttggctaaggaggtagctgtttggggctgaattgtggccccctccattttccccaaattcatctgttgaagtcctaacccccagtacctcagaatgtgactgtatttggggataaggtcttcaaagaggcatttaagttaaaaggaggtcctagggcaggccctaatccaatatgactggtgtcatctaagaagaagaaatgtggacacagacctgtacagggggaggaccatgtgaagacacaggagaagacgaccatctaccagccaaggagaggccgagaacaatgaagagacaggcatttattgaggacccgctgtgtacacagaaccaagccaggctccaggtagataaagactaagtcagggatgccactctttccctgagtaactaccacttgggtaagaatatgtgtcttttgcatctgcagagaactctatggtttttacatgcttttacccagtttcggtctaccttgcttctctggggatgttgaaagttgactcttggtggccagagctctggcatagttgttttgctgcactttaggtgcaggaactggcatctgtaacatgggactaagggaagaagcaggacttgaatagtttattgacaaaaatggttctgaatccagttggagttgtttgtttatttatttttgagacagggtcttgctcagtctcccacgctggggtacaatggtgcgaccatggctcattgtagcctggaattccagggctcaagagatcctcccaccttagccacctgagtatcagttggggttatttttatcggaaatatttatctcaacgcgttgtagcttacccatataagatggcacaggaagtatgtagatgtgtctacatgagattagccaaaactgcatattgaaggcttttttaattcatatgcattatactgagtgaaattaaccttaaaagagtagcctctgtatgattccatgtacacgcagctgtagaactggcagaactaatctgtggagaaaacaaatgagaataactgttgcctcgggggtagggaagctcagggattgacgaggaaggggactcccaggaactttctggggagatgagaaggggctgagtggtagaggagtgtggggtacaccagtccatttgtcaaagtaggataacttagatttgtacatttcaaggcaaatgcaatttactaccatccccaaaaaagtataaaaaaattaatggtgggccagggaggaatgaatagaggaaaagatgatacacagtgttgatcattgtcaaagctgagtgacaggtgtttactgtactcttctgttgactttgtgtttatttgaaattgtaatctttgttgattcctccttctgagaagtcagcctgttgcctcttggggcagatgcaggatctcagggcgttggggctaagtgacggcaagaagagggtttgttttgtgttttcaaattgccattttatttttatgttgttggaaatatcattagtgatgtggaataaattaggcatatgtaaaattacaggttgagcagggctatggtggctatgagtataggtataatgaggctattattttttgttagttcttgagtgatggctcatttgggtagaaatcctgttagtgggggcagtcctcctagggatagtagagtaacaggcactatggatgttagtagtggtaactgatttcacatataggatagtgatcatgttgtagcacttatatttgtattgatttttttattgttgttgtttatttctttgtttttgagacaaagtcttgctttgtcgcccaggctggagtacagtggcacgatcctggctcacagcaatgtccatctccggggttcaagcgattctcctacctcagcctccggagtagctgggattatgggcgcccatcaccacgcctggctaatgtttatatttttagtagggacagggtttccccacgttggccaggctgttctcaaactcgtgaacacaagtggtctgcctacctcggcctcccaaaatgttgggattacaggcatgagccaccatgcctggcctgtatttgtattgaataatataaatatggttactgttaatatcaggtaaagtaatggatttaagattgtgatggtggggttgtaggttaaaattgcggctgttcaacctatgtgagcaattgatgaatacgctaaaattttttggagctgcgtttaattgagtctccctcaaactcccactgagatggatagtgctgccgttgttaatagtatatttaggtccattgagggaaagatttggaacatgatagaaatttgggctagtttttgtcatggccccagccaccctggctgtaatcgctggacttgggtattctctgccctgtcggtgaccgtgaacttttagcttcttacctctggcacttgccaccgccccgtcccttcgctttccctttcatctgggaacagaccctcctcttcggttgactttgtcccccgccccacctagtctcttcttatctctgcctcctccctccttctgtgactcggaagcctttcttcactgtggtgaatccacttgggtgttatttctgttcaccgtagggttgtgttatggcagtggtgtgtctttgttcatagctgcaagctctgctgtgagtgcggggatgggggtgagtggaccatccccacacagctgtaaaagaggcatgctatatgattccatgtgtatgaacttcagcacaggcaggaggaatctgtggtacccgtgggaggaaaggaaggggtagaaattggaaagaggcacacaaggaactttgcgaggggtgaggagtattgctgaaaatgttctgtattttcaccttcatggtggttgccaggcacattcacttgtggtaattctttgagttgtacatgtatgatctgtgcacttttgtctaggtatgtgatgcttcaattaaaaaaacaaaacaaaacttgctgcacatcatggctcatgcctataatccaagcactttgggaagctcaggcaagaaagagaatctcttggggccaggagttcaagaccagcctaggcaacatagcaagacccgccccaccatctcaacataaaggaaaaaaaatcagctaggcatggtggtgcatgcctgtagtctcacctgctcaggaggctgaggtgggaggattgcttgattccaggaagtcaaggctgcagtgagccatgatggcaccactgtactccagcctgggcaacagagtgagaccttgtcttaaagaaacaaacaaaaaaatctagagagccatacaaggttcttaaaaatcttcccattctacctaaataaataagtaagtaatcacatttgtataattccttgaaagattggaagatctgatagcacgatctgatttcccatggagtggcagttggctagacctgtgtagtgactgcccacctccattcctcataacccacttcgctcgttagaatgtcccctgtctttacagcatccagcaggaattcctcaaagtgcctggtgtgtgggtggcaaatgtgtaaccccattgcagaattccctcctatttttgcttctctaggtatcttagaaggtatagggactgtggggggttcagtgcctggtctggtggtactcttgcaggggtacctttggacatggtgtacttttttttgtaagaatacttttggacaatacctgggacattggagccctgtgtgctcaaccattccagataaatttgctctgcttgaactggagaaaattggggttagcgaaaattggtcaactcttagcagttaaaagatgacgagacgttacctaggtgtttggttctgtaaataatttcctatttgtgtcttctaaagtaatatttcatcatagtaccagttaacacttgttccttggcattcagttgttgcttttaaaaatgcgtatatgggccaggcgccgtggctcacgcctgtaatcccagcactttgggaggctgaggtgggtggatcacaaggtcaggagtttgagaccagcctggccaacatggtgaaaccctgtctctactaaaaatacaaaaattagctgggtgtggtggcaggcgcctgtaatcccagctactcaggaggctgaggcaggagaattgcttgaacccaggaggcagaggttgcagtgagccgagattgcgccactgcactccagcctgggtgacagagcaagaccttgtcttggggaaaaaaaaaaaaaagcatatatgattgggaaattttcttcttagtgaatgggtaaggaaaggctaactttttgtgtggtgaacttatagtcaagattctattcacagtagctcaccctaaccacaaaccacagacctcagggaaataatcttgataatctgtataaatccaagcctaaggagaggctgtcagcatcacacctttcttttctccagctgaacgtgtcattctctgccttcttcctgcaagaggcagtgacttttttttttcttaagactactgactcacccagaagaaaaaaggctatctataaaaagacaactttatttgtatactcctccatcagatgaatggatagtgatgccttagttatagttttatgaccctaacagccaagctcaccatagacagggttaaaggaaaaaagttcatgtgcttttccactcattgacctttttgaaaatcttacacgcagagccaagtacatagctctaaagttctgcttcttatgtacagaataccaggcatgagtgggacccaaggagcttggggttcaagactgtgccttggcccaagaagcatccaggctattagggacagctctcaccatcagtttcagtccaggggagtaccgtgcaaagcatccaggggctgccacgcagcgaggcctctgattgccgcagggatgctgtgggaggtcctggggcttagagtcagaggtcctgggcagaggccctggctttgccggtggacagccgtgactgtgccacatgacgcatctgcactggttctcatttcatcctcaaatcactcggtgggaaatgcgtgctatcacctccgttcacagacagaaaacaagctcagaaaggtgaaggggctttgttggggtcatgctggttgtaagtagtggagcccagcttcaaacctgccctctaacttgaagcctgtgttcttgtctcttgttagtttgctaggactgctgtaacaaagtaccccagactgggtgccttaaacaacagcaagcaatttattttctcaccattctggaggctggaatccaagatcgtggtacggcagggttggtttcctctgaagcctctctccttggctggcagatccccccccacccccccagctgcctcttctccctctgccttcatgtggtctttcccctgcgtatgtgtccctggtgtctgtgtgtcccgatctcttctttttataatgacaccaattgtcatccaatcagattggattagggtcattctaacaacttcacttcagcttagttacctctttaaaagccctgtctccaaacacaatcacattccaaggtaccggggttaggactttaacatattaatttggggtggggggtgtgatacagttcagcccataacactaccctgtctcttagccatcatgagctcacctccctcatttttttttttttttttttgagacatggcctcgttctgcagtggtgtgatcatagcttactgcagcctcaaactcctgggctcaaactcagtcttcccacttcatactccccagtgactggggctacagatatgtgccaccatgccagataatttttaaaattttgtgtagagatggaggtctggctgtgttgcccatgccaatcttgaattcctggcctcaagtgatcctcctgcctctgcctcccaaagtgctgggattacagatgtgagccactgcacctggcctcacctccctcttctgtaaataggcatgccacctaaaatgaggctaccttcatccccaggcccgtcccataggtgaacccaggccaaaccctgttaaattcatcatcatttcatataatccttttaacatccttgctaggtaagaaatttactggacatcaaacttagcctgagctgagtaatagagttaggattcaaactctcacctgctgactcccgagtccatgtcttcagtgcactgcatcataaggtgtattatgagattccaaaactatgatttcagggctatggaagcttcatggcttatgggggaacagtcactacaggacttggaagtttcaggaagcgtcatgtgcgagatagcattgacatgccttacttttcaaatgttctcacattcctaagttgcaaggatgggtaggggcagtcatccacccaaagttagtcctttctgttcacgtttcttggctagatttcctgggaatttgttgcatatttatttatgtggagttatttgctttcagaattgcatggagggggaatctgcaatctggctgcaaaaagtaatttggcaatttattttcagggctgcccttcttccagcagcttgtttcaaattcaacctctggcacagagacatccatcattttaattgcatgttactgtttagtgaggcacaaatttgtttcattttctttttctttctcctgtagtagtaggtggttgtgggtttttttcctgatttgccacaaaaaagaaaaaaaaacagaaaaaaagaattacctaaaccacttttttatggccaaggagtttataacactgagctgtctgggggttttttttggtgttgcatatttggttcttaacctttcagtagcagaaatgcgagccttgccttttcttttcctgttcagataatgtccataatacagtcgcctgaacatagtcccaagaaggaaaattgtattggtctcagggtcagaaggtttgcttttcattctggttttgcagtgactgcctggctgtgtgacctgcctcttgcctcactttttccatccataaaatgaaggacttgaatgtgcagatttctagaacattcctatgttcttgtgcctgtaatactgagtcctgggcagggtggccatccaagtatgtccactgaggagcttgtcttgttccatatcgtgatgttcttattctgctgggttgtggattatggtgctttagttcaaagtcaaaaatcaatcctgtatccctcagcaatcttctaagggataaaaatattgtttacataaaattagcttgggtagaaagttagctttgatgttcaaagctaagaacttagctttcattgctgcatatacttcgtttcttgctgtaaaaggacgtggtgtctgtgaagttaggcacaaagtccaggagtgcatcccctttataaggtgcaccaagcactggggcatggggacaaaatgtgactcaacgtccataggtgggtgctgagttgggtgccaggactcttgtgtattgtgttttgttttcacagtgtggaagagattaattgttaatggtttggagtaattttttctgtctgcatctcgcaacactttcctcgtcaccgtggatgtcagactcttcacccagtgacctggagtctccaagtcagggctcagcccacactgtgctgacaccctccaatccccaactcctttgcacgttacaagattttgttttaagtgtttattatggagatttaaaaatatacaaaatatcgagaaagtgtggtgaaactctcatgtacacaacacccacttatgattctgaaatattttaaagcaagtcccaggcaacttattgtttaacctgttaatacttaaatattcactaataaatacttatacacacacacacacacacacacacacacacacacagccacaatatcattatactccacaaaacgaacaattattattttttttgagggggtacggggtctctgttgcccaggctggaatgcagtgatgtgatcatggctcactgcaacttcaacctcctggtctcaagcaatcctcaatcttcctcctacctcagcctcctgagtagctgagactaccggcatgtggaactgctcttggctaaattcttatttttagtagagatcaggtctcactgtttcccaggctggtctcaaactcctgggctcaagcattccacctacctcggcctcccaaagtgctgggattataggcatgagccatcatatctggcctaacaatgatttttttttttttttttttgagacggagtctcactctctctcgcccaggctggagtgcagtggcgtgatctcggctcactgcaagcttcacctcctgagttcacgccattctcctgcctcagcctcccgagtagctgggactacaggtgcccaccaccacgcctgctaatttttttgtattttcgtagaaatggggtttcactgtgttagccaggatggtctcgatctcctgacctcgtgatctgcctgactcagcctcccaaagtgctgggattacaggcgtgagccaccacacccggccaacaatgatttcttaatgtcacctgatacaaagtccttgatgggtttagtgcaattatcttaaaaaccttttatagttggtttgtttaaccagaagctactacagaccacacattgcatctagtagatatgtctcttaagttctttttatctgtacatccccttctcctcttttcaatgtggtttattgagttctaatatggagttggtgatgtagcgtaaggcagcctcagagagtccaatatcgttaacatctttctcctaaacagagttagtgcccttcaaaaaacagtttttagtttatgttttttttttttttttttttttaagaatgtgtatgttgtccaggcatggtggctcacccctgtaatctcagcactttaggaggccaagacaggtagatcacctgaggtcaggagttggagaccagcctggctgacatgaagaaaccccatctctactaaaaatacaaaaaattagccgagcgtggtggcgggtgcctgtaataccagctactcaggaggctgaggcaggggaatcacttgaacccagaaggcagaggttgcagtgacctgagatcatgccattgcactccagccctggcaacaagagtgaaactccgtctcaaggaaaaaaaaaaaaaaaagaatgcatatgtttattctgcttccttgtcttcaagcaaatgaaacctaagttaacgtcatgctgtggggatgtcctaagaagaaacattttttaaattatgaaaaacatcataaatacaaaatcttttatgtacgcatacaataccatgcatacacactgtatctgtgtatatatatggttttcattctggtaatcttttgttgcataacacactcccccagtgcttagtgctgtaaaacaaccacatttgtcatgatgggttctgttggtcaagaatttgagcagggctcacagctgggagatgcttctgctcctcatggcattgaccaaggggtcagttggaaggtgggctcgtgtggagtgtccaaaatggctgcactcacatatctggtaccttggaagggattgctggaaggctgagctcacctgggatggttgactggcacacgtgcttgtggcctcttaaacgtggcagtctcagggtagttagacgtttcacatggtagctggctcttctagagcaagcttcctaggagaactgtcacctagccttggaaatcgcagaacatcattaacaccatatttgattgggttgatgcactgacaggctcttccagattcaagggaaaaggacagagaccccctctcttgataagagtatcagagaattgcagccatgtttgtaagctccacagtttaaaagaataatactgaaactgacaccttaggtatttggctacctggtactttttaagtccccatgtacttgcttgtcttttggtgtaagatggaagccactgggatgggaggcacctgccttagaggtcattcagggtatctcctgcctcccattcccattcatgagggatttgaatggactcaattgggcaagtgcactgtgacagtttacatgacttgccttgcctgatgataatggcaacagtgggaggctcccaatacaaactttaaaagaagtttgtccagtggacctttgtgttagggaggctgcctgatattttgttaatgtccctgtcagtagggatagtatattagccagtgtgtctgctagtattgtgaccagaaaaagtgatgggtgaaaccaagtctcagggcagccagaatcaagtagcttcaggtatccttggctttagtgagcatcttgaggaataaatgggaaacccattcgtacactattgaatcactggtgttagacatgtttggacagacctataggtagacaggaattgaggtccctagcagatgttaggcgttctgtgttgattgaaagagggttcataggaatgtgaccagtggggtcacacagtcctcatagcagccctgtgaaggagatgctgttaaaggaagaaatgagcgctttgaatctctgcagagatctaaatacagcatggcctaaggacagtttattggcctggaacagaggctgatcaatagctgatcagtaatgcaacacaaagtctcagtgttttaaattgatccctccgtgagtcgaagccagtgcgactatggttctgtggtggaacagttgagcctagaatctgcctgtctgggccatctacagcacattggaagccccttgcccatggagtgaggagggccctggtcatccgtggaactgatcatcaatgcctccttccacggactcgcacaccaagatgacaggcagtcactttcttctaagattgttcttacttccttgttgatcaaaattaaggacagttgttttgttgcttcctctgatttctaagagattgttagcctggcaagtcaggaaatcaataacatgtgctctgttttaccagaattgaatttccaggagccgcctagactgttgacgtcccttctcactacagcgtcttggcctctgtgttagtttgtgagcaaataatctgctttccctgtgctacagctttcctgcccttcagactaagtgggaattgggaattgcctccccaccgtgagatctgtttgttggactgtgtgtggccttgtatcccaaccctagccaagaccatgcgtggagtaggctttcagtatttatgtgttaaattgggcttaagaaatatttcttgtttgcaaggcatattgtatgtgcttggagctaaaaaggtgaatgagatggctagagaggtagtgggatgagatagaaagaactctgtcctaaaaatcaggaaggctgggcccctattatagttctgctacttataagcggtatgaactgatgatgtaatttccctgaggctcagtctcatctgcgaaatggggtcatagaacctttgtgacattgaggcacccttcaactgggaggtgaaatttataagctggacagcctggccataagtccagtagaccatggacacttctgcatggtctttgcatcatcgtgttctagttttgagtcaccaaatcttgctgatggctgagatggtatttcttactcatgatgaaatgttaaggtaacttatttggtaatttcagatattcgtatttatgatgtccaagagtaaacagtttatatttgtttgtgacggcttagcagtgttggcaatgggaattcctgggccacttggtggggggtgtgtgtgtgtgtgtgtgtgtgtgtgaggtatatatatgtatgtgtgtgtgtgtatatatatatatatatatggctagtttcctgccaaggctcatagaaagtggcaagttattgaggggagagcagagctggtaactaatcatgaaatcagcacttcctagaaatagctgaaacaggccttgaggttggtgccttctgggaactgctggctgggaagccaactgctgatcccaggtggagctctgggatagcaatttaaactaggggtgtttaaggactgggaaaagaaggaattgatctctagggatgaacatgggtttacaaaagtccccaaaccagactaacctcaatttttctttcagtgaaattactaaacttcacatacctctatttttattaagcatctgacaaagagcacaccatgttattcctgtggacaagtgggagaaataggtttcgatgaaagtcacaataattcctttgtgtagaacaccacagggcgcagtgtatgctcatttgctatcttgctttttcattattagcatgatttagcaagggtgacagggcagatgagagtactccaaaacttggaggtgcctaaggccatggtcatattgctagagaagtggtagaactagtttccaacccaccatttctgcctcacagagtcccagggcacagccccatgtggtacaactgtgtgcagtcatgcctgggtttgaagttaccatcggacaggtgccgttaggtactgtcgaagaacagaaagataccccagcaccaccactccccacgtcagacctgcttagcagatttcccacgtgccgtaaaacaggtatcaatcactgataagtggaataacaaactgagacttgtaatgttcttaataggatagatcataggccaatttaaataggatgcaatttagttggaacaaatgcaaagcctgcacttggggttagaaaccatcactacaactattttggttgttttctaacctaggacttgttagcattttgtatataaaaggcatagcattttgttagccacaaggataggccatagtgggatatggcttccaaaacgtcaatgtcctagtgtgcgttaggacagacgaggggtctggaagggatgacaggagtaacagggttctgcatccaggtcctggccagctacagagaattccagtggatttggaccaggcagatcaggcttctgaaaagtgagttgtttgaagactgttgtaggaactgaggattctccttaatccacattagtgtttatgtttattgagcctcagaatgtcagctggcagagaagcaaatatgaatagggcagggtgctgccaacaaggaagctgaataatgaagagtgttacttgaaattggccctggaaactggcttgctgcaggtggagaaaggaatgggggtgcgggagaagggcatcctaggcaaaggaaggacacgagccaagcctgagaggcggggcctgctgtgtatggtggggtgggccttgtatttggagaacaacacgctttgtagtttgaccggagcctagggtacatgtagggtcctgggagggataaaacttgaattaggttaggcagggttgatgggtgcagagtccctgacaccaggctgaggaacctgcactttattctctggtggatgttttttgagcagagaagtgactaagacaagggctgtgtttacggaaagaccattctggcaaacacaggaaaggtgggtgtcaggagggacccactagggggtgggtgtcttagtccttctgggctaccgtgactaaataccttagattgggtaaattataaacaacagaaactttctttcctttctttttccttcctttcctttccttttttttgacaaggtcttgctgtgttatccaggctagagtgcagtggcatgaacagctgactgcagcctcaacctcctgggctcaagtgatcctcccacctcagcctcttgagtagttgggactacaggcatataccaccacacccagcttttttttttttttttttttttttttttttttgagacggagtctcgctctgtcaccaaggctggagtgcagtggcacgatctcggctcactgcaagctccgccttttgggttcactccattctcctgcctcagcctcccgagtagctgggactacaggtgcccgccacaacgcccagctaattttttgtattttgtttagtagaaacagggtttcaccgtgttagccaggatggtcttgatctcctgaccttgtgatccgcccgcctcggcctcccaaagtgctgggattacagacgtgagccactgtgcctagccctagttttttttattgtctgtatagatggggtttccctgtcttgcccaggttggtctggaactcctggactcaagcgaacctcctgccttggcctcccaaactattgggattatagacgtgagccatcatgcctggcccagaaactttttcttacggttctggggcctggatatccaagatcacagagccagtagattcagtgactggtgaggtacttgtggatggcaccctgttgctgcatcctctcgcagcagcagaggcaaggctgctggcttcaatgtctttcataaaggcactagtcccattcctgagggcagagccctagtgacggggcctgaaggccccacttcttagtaccatcacactggatattagttttcaatgtatgaatttggagggacgccgttattcaaactgtagcatgggaccacttaggggcctgttgctgtagtccaggtacaaagtgacatgacttgagctgtaatggagatggaagggaagaggccttcccgaagctggccacagaaagacttgccagccaggattggtggctcacacctgtaatcccagcactttgggaggctgaggtagaaggatcacttaagcccaggagtttaagatcagcctaggcaacatagtgggaccccatagtggagtacacctgtggtctcagctactcgggaggctgaggtgggaggatcgcttgagcccaggagatcaaggctggtgttagccatgatgacaccactgtaatccacccggggtaacagtaaagaccctgtctcaaaaaagaaagacacatcatctgatggatgtggggcaggtagataaaggggagccacgtttaccctcaaggagatggttcctgagatcactttgactgcataggcaccgtgcttttgcaattcacttcacaagtaggatgtatacatctgactggcacgctcacatacagcttatttcctcctttcaaacctgcctgggatggctggcatcttatgctattgagactaatgagatttgatgggttggtttctatcttctttgttcttccgggaccagatctgacctgttaatgttgcacttgggtcaggttgcagtcagacattgtcagcagcatcttacctaagaaggtcaggatagttcatttattttggggggcagttaagacatcagctgtccagcagtctcccttatcaggagcacagctaggaaccagtgaataagcaaaatgagaatctcaggctggccagcaaagatatcccaatgtccatcccttgtcctgctggctgcctgcctgccccagtctttcactggcaactatgtactcttattttacacatgattttaatgagctgggttatttttagctcatgtcatcagaaggagctgctacagagacatagactgactcaaaaacaccagttgttggtctttgggaaaagttaatgtgttggcagaaaaactagaaaacattgatgcaagaactcaaaggtaggagctctctggagtctactgtgtttgggaacagctcaccatacaagtctggaaggagatggagcattattgcatttcagaacggggatcccaacttagctgtcacattcagtacattctgcttaagaaggcagggagggaaatggtgttgcaacctctgggtttgcgtttcaaccctgttttggatgacttggcccctcaagaagtacttgttcagtgagaacttcctttagttcctatagggcttcccatagtgagggagtaacgtgagttgtgtctgcaacacccagagtggtggttgggacttgatgagcaattggcaaatatttgttaaatgagtggatgaattcgtcacagagagggagacctgggtaacgataaggcaacaagaaatggctttccaggctcgtcacagtaactcgtcttctgttataaccactagacaacgcgtcgcataatggcaacaaaattatgcttaggtaaacagctttggcagtgcacacagttccctaggtgcttgttcatggaatactgaatttgaaaagattttaatgagtgtatcctcttttttaggccttctgctggtagagcaccaccagtctgttgtcagtgttgtagcatggctcatccagaacatctctttcttggccccagatcttacccacctcctgctgctatctatccttccattcacatccatccatctacccatccatccacccatccatccatccatccatccatccacccatccatccatccatccatccatccacccacccacccacccacctaccctcccctgcatataatagtcatttatggagcgcctgctgtgtgccagccaggcactgtgctttggggatggagggacagagatgtgggtactcagatgaacacagctggtccctgtcctcagggagggagtgctctcagtcagaagtaggattctgacacaggagcacaggcagctgcagtacagtgtgatgagtatgtatatacttaaggcacacacctgcttacgggaatgctgaggagggagcacttacttctccgggggcaggagtagagttggggaggctcctgaaagacggaatgtttgggctaagcctgaaatgacagtttgtgtcatctcagatttgtaggggttgccccgggtggggtgtccaggctggcggtgcaggcaaagtaagttacctggagctttcttagttttgagaggggacactgcaggctgggaagagtgagagatggtggtttcaagggcagtgaccttgatcaccttgtcttcattctacctggtaacccactggggacccctgtttggaggatccctccattccagccctcataatttaaccagattattcttgaagctggaaagggctgttgggaattctctcttccagcagaaggtagcaaacaaagaacatacttgggggacatatgggaggggcagttacagatatatttaaaaaagcatcagagttgagtaaagatgatacctatcccccagcccctgctgtcttccacctccgagccagctcagtgagcatctagcatggcaggagggacctgccatcccttgaaagatccctttcccaacctccacctcgagccccttctacactaagagccattttagaaacatcagaaaagtgagatttggaatgacctagacagaaacttaggctaaccctcttcattttacgtaagtagagctgtgatggttcagttaatactctgtgtgatgggatggtcagcccagaaccaaaacagacccaggtggggaatgggttggatttggggccatttgagttttggtggccctgtgtattcagggcaccatggcagatttgctgctgcaggataagtctgggttggcgatatggatttggggaaattgtgaattgcttaaggtcgcagttggtggtgcatctgggactagagcacaggtttcttgcttcctcctggcccaatttttctgccacatcctgctgctaaaagtgttacttaactagttctgtcccactagcagattctctaatgaaacacttgagccatgataataggtattgtgtagagccagtggcaatggatagtaatagggaaaaaaatatccaaagggtgggttgttaaggtcaagaaggaaaagtaccagaatggtgatttttaagaaattgtatttggtctctgacaactgccagaagatcactgttaaaacttggggagaagccaggcgtgggggctcacgcctccgatctcagtgctttgggaagctgaggtggatcacttgagcccagagtttaagaccaccatgggcaacatagcaagaccccgcctctacaaaatattttaaaattagcccagtgtggtggggtgtgcccgtaatcctagctactggggaggctgaggcagggggatcctttgagcccaggagttcaaggctacagtgaactatgatgctgccactgcactccagcctgggcgacagagcaagaccctgtctaaaacaaacaaaaaacttgggaacaaagccatccgcggtttctctatgcttcatcctaatatagatggtttccaatttacagtggtttgactaaggattctgtggctttatgatggtgtgaaagtaataatgcattcagtgaaaaccgtactttgggtacccatgcaagcattctgttgttcactttcagtacattattcaataaattacctgagatattcaatactttatcatacaataggctttgcgttcaatgatttttgctgagcacgtttaaggtaggctaggttaagctgtgatgttcagtaggttaggtgtattaagtgcgttttttcttttctttttttttaagtcaaggtgtcactctgtcacccaggctagaggtacaatgcagcttattgcaaccttgaacttcaagtgatccttctgcctcagcctcctgagtagctaggactacagatgcatgccaccatgcccaactaatttttttttttttttttacttttttgtagagatggggtcttgctatgttgcccaggctgatctcgaactcctggcctcaagcaatcctccagcctaagcctcccaaagtactggaattagaggcatgagccaccatgcctggccttaagtgcatttacaacttataataggtttattgagatgtaatcccgtcataaggagcatctgtacaactattttcattttagcaaatttcctgtttttatcaagcagtctatgtacataacacatatgtatttttatttagttgcaatcacagcttgcttattcctttaaagtctgtttacctaacattgtcattaaaattttccttgttttttatctcatcttcgtaattatcttgtataatggctgaacagtattctggagtgttgatgtatcgtggttctgcgtccctgtggtggagagatgaggccgtctcatccctccagcctcctttctccagttgcatatcctgccttctgcttctgttgacctgttgccttcagaggagtatgtcgaggaaggaaagagcctgaaggctgtaatcccatgatgcagttttcattctttgtttttactttgtgttactgctgctatgtgtgtcacacaaatacagctgcacaaagaaaacaaaggtacccagtttactgggttacaagaaggcagacatcctggtaacactacacaagtcaggggagaaccctgcccaccgcccagaagcccttagtgtaaccttgccagaagatcaacaattaccctgactttattgtggctgcttccttgttcttctccagttttgtcacccaagtgtgcatctgtagacgttgcattttcattttgcctttaagaaaaaagtgtattttaaatctcttttaatctgtaggtatcccctctatctcttctcttccctatattctgcttgttgaagaaagaaatggaatcatttggccgggcgcggtggctcacgcctgtaatcccagcactttgggacgccgaggtgggcggatcacttgaggtcgggagttgagaccagcctggccaacatggtgaaaccctgtctctactaaaaataagccgggcttggtggcgcacgcctgtaatcccagctactcgggaggctgaggcagcagaatcgcttgaatccaggaggcagaggttgcagtgagtcaagattgcaccactgcactccaggctgggcgacaagagcaaaactccatttcaaaaaaaaagaaatgagatcatttgtcctgagtggttctcacaggctaaatcttgcggagagagaggttggggagcaaggttacatcttaggtgatggggtgttcttatcaggaggtacgtaatgtctggttgtctcctgttgtgatgttagtagccactgatgttcagtgcttagaacctactacccattaggggttgcaaaatgatgatattgcagttctgttatttcttcatttatttgttgaaatacttcaataaagaaaaactccacccacctactatttttaaaagctttctttagattcacgtgtcatacagtttgcctatccaaaatgtacaatccagcagcttttagtgtattcacagagttgtgcagctgtcaccacaagcaattttagaacatttcatttaaatccccctgccccctacaaataactgtactccccttagctgtcgtcccccaaacccctttgcccgaagcaaccactaatctaatttctggctgtatagatttccctcctttggaggtttcttataaatggatcatatgatgtgtggtggctccttgtgtctggcttttttcacttagcataatgtttcctaggtccatccatgtggaagcacatatcagcacttcattcttttttacggccaaatgatagtccattgtacagttatactgtcttttgttgatccattcatcagttgatagatatttgggttgtttctacctttgaatattataaataatactgctatgagcatttgtgtacaagtttttacgtgaacatatgttttcatttctcttacctagaagtagaattgttgggtcatgtggtaactaactctatgtttagccatttgtggaactgccaggctattttccagagcagctgcacagttttacattcccatcagcagtatatgagggtttctacttctccaacatttgttatgatcttttttaaaattaattaattaatttatttatttatttatttatttatttatttatttatttatgagacggagtctcgctctaccgccgaggctgagtgcagtggcacaatctcggctcgctgcaacttccacctccccgacctcagcctcctgaatagcgggattacaggtgcccatcaccataccctgctaatttttgtatttttagtggagacagggtttcaccatgttggccaggctggtcttgaactcctgatctcaagtgatctgcccgcctcagactcccaaattgtggggattacaggcatgagccactgtgcccggcctttttaattacagccatcctagtgagtgtgacatagtatttgattgtaattttgatttgcatttccctcatgactagtgatgctgagcatcttttcatgtgtttattgaccatttgtatgtttggggggaactagttgtatgtaccctctgtccatttttaaattggatacttgtctttttattattgagctgtaatagttctttatatattctagatttgcaaacatgttctcccatctgggttgtctgcacttcatgtctccatgtcctttgaagcaaaaaaaaaaaaaaaagtctcacattttgatgacgtccagtttattttttcttttgttgcttgtgcttttggtgtcatagctaagaaatcattgtccaactcaaagtcatgaggctttatgcctgtgttttattctgagagttttatagttttagctcttacatttaggtctttgatgcactttgaattaatttttgcatatgctgccgtctactcttaggttacccagtgctgcagttaaagggagagtcagtgctggattctttccctttctttaccagtttccataataaggagttgccaccgagtcatcctatggagttgggtttttttttttctttgtgattatggcacttagatttaagcatatttgtgtttggatccattgagaatgatgtcgttttatctgagaagcgtgtctgctccgcttgggtgactattaagaagccttttcatttgtcagagacttcagtatccttgtggtggtttctcattcagactctctctcagttttcccaaggagaggtggggagagtaggtatcctgaggcccgttttacaggggcaggaatagaaacgttaggaggagtgacttgtacgaagtcaagtggcagatgcaggacttgaccccttgtttctccgactgctttcttgtgctcatgccccatgtgtataccacatagtcaaaaccttggcatgaacctggaatttgagtttgagtcctggttatggcctgtgacctccagcaggtctttgggtttccctgagacttcgttacctactttgtgaaatcggaagactggaagagccaatttcagaggatgagctttctttcctaagtaaggttgcctgcattgagaaacagcccagcttttgctacgctagagtaaggccctgttacacccttcttcaagtgtgtctgattttggcaaagcttatcttcccatgtaggtattcatccaaaaagtattctttttgtaagaagagactagcaaaagttaacagggttatctagattcttaactttatgctattatgtggcatttgagtttctttaatcatgagtttgtattacccttataatcaaactaattacaaatttaaaaatttgtgtgtgctgacatgtatgcaatttacaaagagaagtaggttttttttaaccttttttttcttatctagctgtctcaccctaagttttttcatcttcccaattgtcttccagaaacatgccaaaggccaggatttgtttgatcagattgtgtaccacttggaccttgtggaaacagattactttggcctccagttcctcgactctgcccaggttgcggtaggttattgctttgattcatttcagaacagattggcttttcattgctaattgcacgtccacagttgctagaaatgggtagagaaaaacaagactaaaactgtgatactgtgccagtaacaggcattgggatggaggttgtggtgcccaagtgccatgcgtcacaatgcttgtaggatgcctcacccttgaggtggccagtaaccaggagaggatgtgaatgggattcattagggatgcattataggcacatttctagaaaaggtagaaagaagaaacatcattatagaagttctttcaggctgggggcagtggctcgtgcctgtaatcccagcactttgggaggctgaggcaggtggattgcttgagtccaggagttcaaaaccagcctgggcaacaaggtgaaactccatctcaacaaagaatacaaaaattagccaggcatggtggcatgtgcctgaagtcccagctactagggaggctgaggtaggaggattgattgaacccagatggtcaaggctgcagtgagctcaatcgatcctgccacctcagcctccctagtggctgtattccagcctgggtgacagagtaagaccctgtctgaaaaaaaaaaaaaaaggaaaagaaagaaactcttctaatggtgctgcttttatttttaaccagcagaagaggctgtgccaccatcttcttacagagtctggctgggtagagagcaggtgctgtgaacggagctgaatgccagccaggcttagtggggttgggggtggatggggttggagcaggtcttgctgttgccgagaaccatcttgcaggttccaggaagctgtgttaggtcagcactttacttactttgcctgagacagaactgttcacagtggagatgttagaatgagtgaactccacaaagctcagacccactctttttaaaagcaggaatgacttcatagttccccttcccaacaaaatctagcttggggtttcaaagataatttattcgacaatctaaatctatttatggagtgcccattatgcactgggccctgtgctgagcattgcggataaagcagtgcacatagatatgtcatatgccagatggtaataggagtcaagaaaaataaaggcgaggaaagggtggactggggggaggggaagcactattttagacagtgtattaaagtctgggttccctgatcaggatgtttgagctggagacctggagctcccataatggttaaggctgtctactggaagatacttatcagatacttcctgattgtatctggaagttgtcaggtgacatgtgacatttgtaaggtgaagatgtacaaaatcggtacctgggaattaggtctgctggagaatgttagtgacatgctgagtccttcggtgacagattggaatctggacgggaatgcatcctggctacagtgcctctggggtggacactcccactggatgtccctgtgcagatgtgtccctcaacctcagccacttcctctgcatcttcaggacgtcctgttatgccaccccaccccacccccaaactgtgtcctcctcaaactgtcctcctcgaaccctcccgggttccttctcatttctcagccagagactctcactccgtccaccggacccgggagaagggcagaacaacttttcctctttccacctctgagtccaattccgcttcctttgaggttgggccgaccagtgtcctaccctctgacctcatgactgtccttcgcatccctcgaggcctttggtgtctcagtttttctcttcctctgggtagcctcaggactgaagttactggccctcctacatattctggacactgtttcctgtcatttaagcttcatttgagcagattgacaagacccacatagattctcgtgtgtcctgtcaccacctgcactccaagatccagaattctgccagtccccattccaggataacttcccttgattccttccattttcccagttcccctccctctgggcttggcccacagcggtctccttctgccctttgtcccctcccagccttctcctgccctggccttcctcccagccccagccaggcctcggccacctcacctgtgtcctcacttggcctttgattctcctgcccccgtgactgtcccctggcctccccttgacacgcaggcccatctgtttcctctgtggcttgtcccagcctgccaggcgttgctggagagagccacggtctgtgccttctggcatcagcaccgatcacaggttcagcagagtccaagctcccgagctgctccctgagcctcagtagccccagattgactcttggccacccgacaggtccatgtctggatctgagcacagacctttagtccagtccccacggaggctttgttccagcagttgcctcacctgctgagaagaccgaggtcgttcagctaaaattccttgaattttcttcccctacacttccgattctgtctgtccatcttttttttttttttttttgcatgtctacttctcaatctactctctacacctggagcggcaggcctatttccacttgcttcctgaatgccatatttagggttctctctgtccccagcatcctccacctgtttccagcacctgccactctccagccctcttcttccctggaactcttcttgattctgccttctcctgtgtgtcttaaagcgtgtggtatttttggcttcagaatatctgtggccctgaactagaagtcagactggaccttgttcctggctctgcctctgactcatttggtaggctttagataggctgccttgctcctctggcctctgttttctcatctgtaaaatggggtacttggacctgttctccaagaaaacttacacttctaatgttcagtcattctgagtctaaaggggacgttggcatgtctgctgcaaatgcgttctctagttagaaaggaggaggtatctttcatttctgcccttagaacctatgcctgttaccttggcagcatgtcctcatccccaagtgacccctcattagccactcagattcccagaaagccaagtctgtgactccattatgaaggcctttgccatgagcctctgctgacttggctggcaggctttcccgcccgccagtgccctgtcactgtgcagcaggaggggtgttcacagcaggatacaggcggctttcccaggccagacacctgaagatgctcaggctctcaggcctttccagcatccaactctacaaatttgaggcaaaaacaggtgggagggcgagggtcctcatctgcctccagctctgaggatgcaagagctgtgcggcagcagcagttcccaggaccctctagtcattcccatctttgctttctgagctggactccttacagtctgggtcttatgatgcctgcacttatctctgtgcctttgcttatgctgtttctccttctgctgtttctcacctgtttaaactcccagccatccttcaagaccatctcagatgacccccccctcacccttcatgaagcgtgtcctgaactctcaaagtgttttttctactatgcaaatcttattttgccttctgtggccatttgactgtttggccttgggtttgttatttgtgtgtgtgtgtgtgtgtgtgtgtgtgtgtgtgtgtgtgtgtgtgtgtatacacacacgtatatattatgtatatatacactatatatgtgtatatagatacacatatataatatatatgtatatatacacatatttatgtatatacatatattttatatatatatataaaactttaaatttagatcctaagacttaggacctcctcctcttaactcggtgattcttggggacaaggcacataacctagaaccttcttttttagccccagaaggaacctgagggagaggcatttgtcaaatctttctagatctttcttttaccatcttctagatggtgaaaccaaagcccttagatcttggcaagtcatttagtgaatagcacagcttggactcaaactcaaattttgcaatttcaggtctatgtgctctttctagtacaccctactcttgagtctcagtttcctagctgtaaagtggaggtagtgtaataacatctgtttcatggggaatttgaggagctcagagaattaatggaggagaaaagtttttgtaacctgggacgtggatatgggtctcctctttgtagctgggcagtgtgaggggggaccggaagtcatcactgcccccaggggtgagcatgctaagaaggtacagttagctgattggaacctgtaaggcccgccttgcctgtgggagaaaccttagccaatttaatcaagaggcttttgggagagtctgctgagatggcttttggggtcattgatttttataggacctgggaggtgattggatgtcataggaggtgtttctgcaaacagtagggtaatagatggacccggaagggaatggttcacttggctattggcttattgccccataattgagcctccttcaagcaatggtgttcccacccagcccctgacatgcagatcagaggttggcagctgcagggctcttggcatggctctctgcatacccagcttatatccccagctccctgaaaagaaccacgcctggtttccatagtgccctgcccagccctgaagcaactgtcaaagcgtattgatatcacctatttttagcagttgggactaggacctcctgtttcccttttccatgtcaaaacaggaggccatccaggaacccactctgcagatttcactttggtacagctcaaagcaggggctgggagtctgtgtctacatatcaaagcttgcttctgagagccaagggctcaggcctgcactgtctcactttcccactgcctgatcacgataagtgctgtttacccagttctcgccctgagcccagcactgaactacagtctttgtgaactcttgtttaatattcatcactgatctataaagtaggccataaaacagaaccattttacagatgatgaagctgaggctcagagacactgatgttcctaagaatgttgtaaaggttaaagccaggattcagaacttggtctcattccaaagtccagcactttccacttggctatacggcttgaatatgcacttggttcatgcgtacatacatatatagaaggaagaaagggaaggttcagtcaatcccattcagccagctttgacttggagcttactcagtgctgagctctgtggttgcacagatgagctggatgttgtccctgcctgccacattctgttgggagacatagacaagtaatcccctgaactacggtgtattcagtcctctaaagaaccagtgtaaaggtccctctgtgggtctggaggagagactgtctacgtattactgataaaatgaacaagatatccaagagaaagggtgaacactgatgtgggccacagagaatgagaggagtttgccaggcagaggaggggcagggatttggggcagtggtagtaacagccccaccaagcaggagcctcccttcctctcttgggagcaggtgtcctggagggtagatgtggccactgtaagtccttccctaagctgcttttcaacatgaaaagggagctttttctgatggtacattttgcagtaaggaatccaaaatagattattttgacctttgtctcaagacttgtcagatgtgcgtcctctggcctttgcagcatagaatctggcagtgagaggcgcagggctgcatagtgaggttggtacatagatatggcgcctgctgggagggttcaatagccactaaagggactcttgcagctcctttggctttgctttaatgattggtcagaatgtcatcacatttgccacttgtgtggacactactgggtgctcttgccatctcagatgtaattataagaagaaaagagtgactattaggtatacctggaggggacataggagagtataaatgctaagagtgggatctatggggatctatgttacaactgctggaaacagacaaaaccccttccttccacccattgggttcagtgcagtttccatagacagtgcttaggggttagttctgttcacaggggctgaaactgaggctcaggtgcccgtgctctgaggtgggctgggggtgtgggggggcttgcttgtggccacacatgaggtgagtggcagagctgcaacttgaactctaatcttctgcctccttgcatggtggtccaaagaaatgtaaactgcactcaagaaatgccacagggcgtggtgtggtggctcacgtctgtaatcccagcactttgggaggccaaggcaggtggatcacctgaggtcaggagttcaagaccagactagccaacatggcaaaaccctgtttctactaaaaatataaaaattagccaggcgtggtggcacatgcctgtaaccccagctactcgggaggccgaggcaggagaatcacttgaacccaggaggcagaggttgcagtgagcccagatcacaccactgcactccagcctgggtgacagagcgagactctgtctcgaaaagaaaaaaaaaaaagaaatgccacaggcctctcctcatcctgtctctgaatgctgggaggcaggccgagtgttttcctgcccacgtgcaaatactggtgctgaatcggaagctgctaaaggggtctctaccactgatttagatgattccaaggaagtcatctcacaccagcaggtagctggtgttaagtgagtttatagggcttggtcatcatggggagcaggaaagatccccccacaggcagagaaggcactttaggctagtccgtggtgtggaaacctagagtactggatgctgacgctgacaggggtgtgagtttgaattccagctctgcctcttatcaaggctgcacctcccacaccccagccttagtcagaggatggatgtgatacagtaaactccaaaggcattcatccccttccttctcttttcatcctttgggtacaatttgattatctcttcagattccttccagctctagtttaaacacaaactatatatatgtatttgagatagggtcttactctgtcacccaggctggagtacagtggtgtgatctcggcccactacaacctctgccttcctggttcaagggactcttctgactcagcctcccaagtagctaggactacaggtatgcaccaccacacctggctagtttttgtatttttaacagagatgggattttaccatgttgtccaggctggccttgaactcctcacctcaagtgatccacctgccttggcctcccaaagtactgggattacagacgtgagccaccacgcctggcctatttttaatatacacagggtcttattgtcacccaggctggagtgcagtagtgtgatcgtagctcattgcagctttgatctcctgggctcaagtgattctcccacctcagcctcctcagcagctgggactacaggtgtatgccaccatgcctagctatttttaaaaaagaaaagtttatagagatggggtcttgctatgttgcccaggctgatcttgaattcctgggctcaaacgatccttctgcctcagcctctcaaattgttgagattacaggtgtgagccaccatgcctgactcagatactcttcataagccaagaaaatttgcaggtcctagaaatcccgttatgagtttcgtcactcagacttaatggtgaaggctcaggagatgttccagcagagagttgttagatgctcttcaactcctgagctgctctgaggccttgtagttccaatgctcccatgtagattttagatgattaaattctacaaccagccttatgggtgtcatatttccagaattgatgtactattggaacagatgggccttgccaagatcatctcacacatcttgatttatggaaaggattttgccagatggacttggatgagaaattcagattagaaaccacctttctaacacccgttagagtgtttgagtgaaatgtcctgccatttgaactcagaattgcacctgtctgtttccagtgactggtttaatggtctgctaagagggccggagccgtttgccttggcgtttacccacaggcggcatggctatatttagccaagacacaggtgaacatctgagacaggtcccgccgctgctgaatacagtcctcaaagccgagcgtaggatacagtttactaaatgccatgttgggctttcattgccccagcgttcaagccacaaggtggtcttgtgggataaaacacgagtgatcagagtctggaaggcccctgcagctaagaagaaagtcagatcattttgaactggttggatacaagataggttttgtcatctctcattttaggattgtgactgggtttcttattgcctctgatgcaggcaagcaaaacctgatctgaacaccaaggggtcaaggagcttttaaaatgaggaagccgtttctgattccattctcggcttcaccagccccagacttttcataggcatctatcctggcaggtcctgctttgggcagggctctgtggctgagcaggaaggatggagcccagcccacaatggctgaaggggtgccttttgcagtgtggccagagggcaaagcagtcagccacccggtaccagcatctggctgtggtctgcctgtgaatgcacaccagccacaggtgtttggccatttcacctcttggactagcctgtaaaacctgaaattgcttgagattttgcagagcccaaacagcaatttcgagaaggggttgtgcatgtttcaagatcatcagaacctcttcctgggtaggagaggatgtggaaaacttcagtactaaatatttaacgggcacactggaagcatttatgaaaactgatgctctgagactctgtttaatgagtcttgggtgggacctgaattttgactttttcgaagttcctcaagtgatggtaatactaatacacagccaggatcaaaaagcacagccaaggagactgcacaagttggacttggctaaagatgagactttgacagtagagggagaggaaagggaggcctaaacttgttctactcaacatggtggtgagaagactaaagaaaggaaagaaatggaacaagctcctttaagtgacaagcctctcatgggctaattagactaggggatgaatggtgaattcttttgaaagtgaaaagaacagttttagtcatagccattagcatgttacttggtaggaaagtaaatattgggcttaaatcaagtctgtatcagccccctccaggggccaaagttgggggttttcagcttgtttgagggcactggcagcatctgattctaatgaggtgaactcataaaacaacaaatgaatatggacgtgacaacccagcccaccccctaaaaataatattctcattaaaataaacaattatgaagcaaggtaaaaagaaagtaaatggcattcacagccccaccatcccaaaataacctctacaattccttctggatgtatctagatagaaaataataattttatataaatgagattccacctgatttttttttctcatgtaacattgtgctgtggatctcttgtcacatcaataaatacaggcctacatcagttttaaatagtatttcattatatggatgagccattttctaatccgtctttgttgatggacatttaggtcatttccaattcaaagctattaacaatgagataaagcatcctgcacatgtgcgtctgagatacacatcctgctgcggtgacattacatggctgcctagcctggagtggagatgacaaaagccccacaacccacgttctcccatggcactgcccccagcttattgtattatcaatcatctgttgttcgcttttgtgtttccttatccccttcctcccacacagtcataatggcctctttggttaggtgtggagtacactgtcctggttgggtcctgccgctccttgttattagactgtgcagagtgcaaatgtgtctgaaagcccattggcagtcagcagaatggcctctgactctgagtaactcatgagtagcccactctgcttgtatcaccccagccgtctttctaacagagaagttccagcatgcattaggtccacataaagtgatgggaacagtccctacttgcctcactttaaaaaaataatttatatttaatatttatttatttctcaagagtcttaacaggggcctgctgggtgccatatcttgtgcctggcacaggaaacagtcacaattaagtgcacggtccctggcctccaggagctgatgtctgtctgcacagaagggctcagtagaatgctcctaaatgcagttctccatggaagttaagtggctgagactccttaggacagcagtatcaacgactttgacttcatagagaaacttttgtgtgaggcagatgattttgtaatctcctcagataagactgaagcagttcttttggtcaaagctagaggaagttaaaatgccctcattgaccagagcaaaatgatcttaggcaaatccctgcctgcctttgcatttgccgtgtggctcattttcctggcaaaagaataaaggggttgtgaattttagttctgtactttaaagagtttaggacgacaacctcaagaccagtgcataatgagagattattggtatcatagcttgtactttttgctagattaatggagacctggaatgcttggagaagattggctgtaacttgagaaactcagaaggaaaaggcagttggtgattctgctgatcaattggttaaggggttttatgttctttcaggcaccactttgtaaaacttccagaaactagggagtcccctccccagaaaaatgcacatatatgcataaacgttgaattttttttttttttttttttgagacggagtttcgctctgtcgcccaggctggagtgcagtggcgcgatctcgactcactgcaagctccgcctcctgggttcacgccattctcctgcctcagcctcccatgtagctgggactacaggcgcgcgccaccatgcccggctaatttttgtatttttagtagagacggggtttcaccgtgttagccaggatggtctcgatctcctgacctcgtgatccgcccgcctcggcctcccaaagtgctgggattacaggcgtgagccaccgcgcccggccaacgttgaattttttataccatcccaagcagtttgcagattcccagcctaagaacccatgatatgatccaaaccctggtttttgtgggtagaattactaaggcttttagaggagggtaactgtgagggctgaataaccttgctgatgaactattcctaaagaaactttttttctttctttcagcactggctggatcatgccaaacccataaaaaagcagatgaaaagtaagtaagcagaatttagctcactcatttattttttttctgagagtaaactcctttgccagtgttttgaggtgttatgttttcattagaacttggaagcattttaaaaatcaattcggtattaagtggatgatttttaatttcttaaggctagccaaagatgagagtttaaaatttgaataaaaatgtttagtggatattgaaaaaccaactgtgctctcatttgaaatcagacgcctctgccaatgagaactgattaacctgctattcagaaactcagctttatacctattatatctacttctaatgagttacaacatagactcagaggatgagagagtaggagggctctttgatagtctgctacagctttctcaatgtacaggtgtggaaaccacattttttaatgttgtttatgcttgggtaatttttaaaaattcatattctcttaaaagtactttaaagtatttttagagaacagaacactttgcatcactttcctttagcctttgtactttgtaaaaactagctgtcagtttggagtattgtggcatcaggggtgaaaataaaatgtcagcttttagtaatctgtctaaatcactagggtttttctcctggaatgaggttactagctaaactatcttagtcagcacaaaagtccatccatctcagtttccctgatgaggactgaaaagaattggctagtgtcgcgtgcccagttatgctgtcctgatgttgtgctaaatgttatagatttaacgtgctttcccttttgtccatcctgtgatcttcaaaactgggggaaaaacatcttcaaccttccatctccaaatgtttagttggacctgcttatgctttacactttcgagttaaatactattcttcagaaccaaacaaccttcgtgaggagtttacaaggtaggccacgatgcagaacaagctcccgcccagcagggcttgccttacatgtcatttatggctcttctcaattgtgggtttgcctcttcttctgtctgctgtctatttctcagcaagagttattagtacttttccggtgcttccgtgttccgttaaaaatccacaactttgcttaatttgacatttttctgagtgaatagaaattagaagatacattttcttgtcacacttctattttcttggaccctgggtaaattaattggttgctctgcggcgttttatttttatctcaactacaaaaagggaaggcagatattggaaaagcatttctcagtccttaatcgccatcttatgttttaagagattgcaaaatattctcttgattgttacaatacaaggaacctctttaagaaaaacagagtaattatagcaaagttgttaaaatcccttcatgttatcttttaactcccctgaatttctttttttttttttttttttttttttgaaacaaaatcttgctgtgttgcctaggttggagtgcagtggcatgatcttgggtcactgcagcctccacctcctgggttcaagcgattctcctgcctcagccacccgagtagatgggattacaggcgcacaccatcacactctgctaattgttatatatttgactggagacagggtttcgctgtgttagccaggctggtctcagactcctgacctcaagtgatccacccgctttggcctcccaaagtgctgggattacaggtgtgagccactgcgcccggcctgaatttcttttttgttttgtttgcccatgtctatgtcttggacttcagaaacagggaagaagaaaaagaaaatttgagtaacattttaaatgtggagtttccctctacccttttccatcagtgaaattctctacaaagccttttcctgcttttgatatccccagagcctccttgtcgttgtttgtgtgatggactgcagtggtgacatataggctatgtaggctgctgggtggttcttagggagatgacccctaaataatgccttaaagactgactggttatcaccatttcccctgggctttttttttggagacaaggtctggctctgtcaaccaggctggagtgcagtggcgtgatcacagcttactgcagcctcaacctcccaggctcaagtgatcctcccacctcagcctccctagtagctgggaccacaggtgtgtgccaccacccctggctaattttttgtattttttaaaatagagacagcgttttgccctgttacccaggctcctgctaggctgctatggttagtttttcttataggaatcaagagttctggccatgtttatactgtgtctcttgtgagatgagtatacaagatggtatcctgacattcagaagtgaagttcagtggtggccaaacacctgtcaggaagcaggaacattctggaatgtactagaaccttcagcacgcccgatctccttgatttctggcgaacagtcattctagtgttgctcctcagagtcctctatgaatgctgcttctagctgtcatcaaagcgattggtttttaacccaggttgtgtgaatcagaaacacctgggaagcttttgaacagctcagattcctgggggccactcttgtgtgtaggattctgtttccgtaggtagggagcagagcacaggcagttttggtttttacaaagcattgtgagtggttctgatgcctacatcctcctggtaaaaaacaaacaaaagatacccctcttatttaagccaagacatttatttttttacttgagtaaaccccatgcgtgttatttgctggcttctttctcattttttgttacccctctaaccatttgcagtccagtgccaggatttttcttgtttcgtgtgtgtgtgtgtgtgtgtttgtgtgctgtgcctgttttgtgttttaaaagagtctgcagttacactgcatcaggggaaaagaacccccagtggttttttgactagaatcagctgcaaactttttgttacaatccaccgcagcagatctggaatccgctggtggagctggctgagagccagaccccgcggccccaccctgcctgggttattggacatgttgcatgcccatgtgccacgttcggctctcttctccagcacggagggggttgtggaggccgtcattggaccatgacgtgtatcacgttccatcctacaagtatcttgcgagttccccacatgcactcaccttcctagcgtggttctgggatgccttcctggagacccaagaggagatgcttccaccaaagttctcatttgatttggactccttttttacaatgcaaaactccatgctgtgtgtggggtggggtttgcagtgggaagctggggattgggagcagctgggaaagagttaccctctgttgacttttgtatatgtttgtcaggtacctgtttgttttacaactcaggcatgacattctttctggaaagtaagtatgtttttgttctaactcttaacccaggatagatcatagtgtatttcaaaataattcactgttttaactcttttacccttgttcccttttcaaaattcaaaaaaagtgcaccaggcattgtaaagtgagtctaatacttgtatcactgtcattatcatcctattttaaatgattactatatggcttgaagcatttccaagaccatttaatatcttaagtgatgtgtatttgggaataactctctccctgatcacatcactgtcccattcataatggcttttgtcgtatttgcaagcaagatacgttattagtatgtatacacttacaagtatttggacagtcaaaaagtgtcattcatcaccatctgcatatatgtaatggaaagaggttatgttctgattccagtagaaagttttagacatctcatctcacttccttttctcctcttaaaaatggctttgaaatactaggcctctggcagcacacagtgatcattgagtataagaagcattggcactgaagtggttgatttcgcatgcagtcttaatttaccgtaaagataagaggtttcaacaggcatagctcttataactgtgtcatttttcagcatctgtattgaatattttctattacatgaaaaactaaggctatattgagtctaaaaagtaacccctgctattgaaaagaatacgttctgattttgaatataatctgaaggaaattaaatatgtaatttccgaatttgcaaactctccatagaatatgtgctataaaaacctcagtgaaatgtactccatagaccaatagaacaagtagattgtacagtgtatacatttgccttattcagccgtgcaatacagacctttggttggtgtgtgtattatgagtgtgtgtacttttttttaatcctctctccctctctctctctctctctacctctctctctccatactgtgctcctcatactaaaggctgtgtaactctagaaattgtcttcggtttggaaaaatattaatggcaacaccttgcatttgtacagtactttgtagtttacatgcagtttagcctgctttgtatttaaaagcagaatggtgttcaagtcccaacattgctcctttccagctggatgacctggggcaagagcccttaacactgagttcctcatctatataatgggagatgggtcgggggggctcactggcaacacctatcctaaaggtttacaaacttgatgcattgaccaaattggataatataaatgaaaaggctttgaaaactatgaagtgctataccaatgtatgtcattattgtttttctaaccaaatttgaaatattacgtatgaatgagatcactgaatttgcagtagtactcttctatggctgtgccttagatagacttagaatgctgagtgtatccagccatgctggcagtgttcgatatggtgtctgtgtgtttatttttaacgctatgaccttgtttcaagaaagatttgaaggcagctttaaaaaagatgcatgtactatatcaagataaaataaatttaaaatatgtttaaaaataataaggcaaagggaatacttttcattctgttttccaaacttttccattcttgccaaattcagtaaaattgtacacgattgatagaaactatacctacattgggttattttgccctatgatgagaattgactttgggaaatttgtagtgcaagtcgcttgttgcattctttaatgtagacagcaaaaatatgactaagaatacaagtcattatctaaatagcgctaccttttgaaaaatgattttaatgacattttgtatggttgtacttaagttcctatttcgaattaatttcattttatttttttcaagattgaaatgcccttatgaaacagctgtggaattagctgctctctgtctacaaggtacattaatctttagtagtaattagcattttaatgttattgctttttatttcaacaaatgagtgtccacagtataccaggcccagtgcttagctttggggatataaatgaatatgacacggtctctgtccccaagtggcgtgcagtccagtgaggaaggcaaggagtagcaaggactgcagtgcagttccttcaggaacagagacgtgcaggaggtttggacaaggaaggcccattgtggggatgagaagaccatgagtcaaggaaccaaggcacaaaagtgcagagaggttagcagcagttgagtgatgctacagagtgaagttcaagcatttggacaggtggatgacctcgggccccatttaaagagaaagaatttcatgcagtcagcagtgacacctttgaaagctcttaagagggagcaggcctggccggatatgcactttagaaaggccacgttggctatatggggagaagggatcagagcaggaccaagactgggactgggagtccagtgaggaggtgctgctgtaatagaagggaaaggaaactaactagggcaggggtttgcacacacacacacacacacacacacacccccacacacaccaagaaatagcattggcagtacaaggagaaggacttggtgattagacttaggtgttgagggaggagtttgagatgattctcaggctgtttctggggatggatagaggttagaagaggtggactctggtggaggaaatggtctgtgttgggtcccttgactaagaggttctagaagctccagcaggttcttgagtacctgaatctggctcactcagagaggtcagactggaagcattaatgtcaggactggtggggtgcaaagggtatttttgcatgtgagtgggaactggatggtaagaggtctgcctgcatgattgtcagcattggccgtttatctgtgtgatgccctggtggtgtgtagtttcggatgcagaagaaacacttgctaaagtctctagcactaattaagagaatactaatgtgtaactgcatatccgggatttcattagtacatcagatagacatatgttgtgcactcatttgccagcatgttcatcagcttctactggattatggattatgacatattcattcataattagtaattacttatgaataccataatgagaattgacttctcacttttgtatttggccagtttttaaaagtggaactgagaggttttttcaaattataaaattagtacacacttactacagaatatcaggacaacaacccaccaataagacaagcataaggaaggaaggaacccactgtcctaccacccacaggcaaccagaatttctagctatgagttttgagtggacttttgaaaatgttattttgatcagtcatctgcaaatttttgtataattttttttacttggtatttttagtatgtgtattttgtcatgtgtacactcatagagatggtttttaatgaccgtaggatgctcccattacctgaaacttctattcttcagtcaccttttaattcctgttgtcttgaactcctggcctcaagcgatcctcccacctcagcctcccaaagcactgagattacaggcatgagcaacctcacccagactcttaattcttattatctaatggggacttggcatatagtagatgcttggtaagtgcagagtgagttgaattattgaaattggagagacccccctcaccccacccccgccaagaactttaaaggcagaacctttaaactggtggtagagttgatggtaatgtcatctatagccatctgtgccaaatacagtgctcagtgcttccgatgtatttttctgatatgacagtctttatggcaagtgctataacgacaggcatggcttggagaacatggccgtggcctccgcactccggccactcacccacttagcaagtggctttcctctaccccagagttcctgagctgccagaggtcacaccatcaggcttgacagcccagcagtagatgtcagggtgtcacgaatgagacaaaagagacggaaggccattaatccactggaaaggtttcctcctaaagccattggcacaatattgcaagcttgtacgttgtcctgaaagatcagaggatgaggtgcacgtattaccatcccaccccattgcaatgaagccctcaccacacttaacagagtagtgtagaaccaaaaccttgccccagagccgagacagacacaaataaggtcagttctctgtgaccgttcttggagaaattatcctttgagctgaaatcataatgtcagtgtgattttaagatacaattgttggccgggcgcgatggctcacccctgtaatcccagcacttcgggaggccgaggcgggtggattacctgaggtccggagttcaagaccagcctggccaacatagtaaaactccatctctaccaaaaatacaaaaattagccaggcatggtggtggacatctgtaatcccaactactcaggaggctgaagcaggagaattgcttgaacccgggaggcggaggttgcagtgagccaagattgcattactgcactccagcctgggtgacagagcgagactctgtctcaaaaaaaaaaaaaaaaaaaaaagatacaattgattgttatgtcagatagaaataaaaagacttggctgggcatggtggctcatgcctgtaatctcagcactttgggaggctgaggtgggcggatcgcttgggcccaggagtttgagaccagcttgggcaacatggcaaaaccctgtctctacaaaaaatacaaaaattagccaggtatggtggcgcatacctataatcccagctacagactgagctgggaggatcacctgagccaggggaggttgaggtttgaggttgcagagagctgtgatcacgccactgcactccagcctaggcaactaagaccctttctcaaaagaaaagaaaagaaaaacactgaagatttagacacaaggcgaggctcttgttacattgtccctccgtgccccctctccccaaccccattccatgagtaaatgctacagtctgctttccacctcacccacagctgagctagcttgtctgggactctaaggatcactagagcatctctgtaggtttgaataaaatgaagggttgtgtttcctcctgtgcttgagccttgaagacatgtcttgctgtggttgtcctcgatgcctcctgagttgtgatacagtggccctgcagggaggctgtgctcttttgggaactaaatttgtggtggatttaaaaattaaaccaggtaaaaggaaaagaagggagaactaataggccactcatctgttgcatgcctgtgctcctttttcattcttgtaacaattcccattttacaaatcaggcaccggagacccagagatgttaagtgacttgcctgcagtcacatagatagattatgatagggttgggatccaagtcctcttgtgtctgagctgtttccaccaccctccacggcctcctagagctgaggcctggctgcagagattgcaaattgagtgaagtgttagttgatgggatctgatgtgtgcagcagaggttcttaaagtgttttccagggtcgccacattagcatcacatggggacttgttagaaaagccagttcttaggccgggttccagacctagggattcaaaaactctgggggcggggcccagtgatgtgcattttaaccagctcaccaggtgattctgatgcgcacccaaattcgaaagccactattatacctcagtgatttttccaacaaatgggcaggcctgtgacctgggcatcttgttaaaaggcaggttttgcttgaataggtctggggtggggtttcaggttctgcgttttgggcaagctcccaggggatggcagtactattggtgtgtggtccacacttggtgtagcctagtgttagagggaactctagaggattccttttcattctggggtctgcttcctgagctgcagggggtgggggagagtggattttctcatcatccctggaggagggggccacctgtatcctcaggccctccatcctgtgggggacttggcaagggcagcacaaattgcagcacaaattgggcttcttgctcggatcactcgtgtggctgctcctccctcctttctgcacagctgtctccctcccaggttctgcctgacttcccgcagttgctcctgcagccctcgcacccctcctccctgcctccctctcgctctgcctctccctccccttcctactttccccctggatgctgcatgtgccgaattcttgatctatcctctccagcactgcagaccctgaagtgctgctctgacctactcttaacgagaggcttgttaaatggatgtttctgggcagatcctcattccctgcaattgccttttattgcaaattcagggttctaccccttcgtggggaaaatgtaactggtgcttccctgggtgggaacaacagtggagagaaagacagtaataactaggatgatgctgtatcacccaacagggaggacattagaatgcttctaggattttgagtgtacatatgactacccaagtgagagttaagtcttcccgaaaggagagagttatacattggggcggggggctgtgctttataatgatgcaaaatgcctttggacctggttgcagcaataactgaaatcattcaatgtctcctattttcctcccttttatgaaacttacagcggagcttggggagtgcgagcttccagaacacacaccagagcttgtgtctgagtttcggttcattccaaatcagacagaagcaatggaatttgatatcttccagagatggaaagagtgcaggtaccttgatgcaaccgtctagcattctgatgtatctattttgtcataaataagtgttgatcacactcctttatctaccagtagaattgttctgttgatggccataaaactgcagcgccaactcttctctccttgtgtcagtcctgtttttccaaaggcccacatcttgtcctttttatttttgagagagtctcgctctgttgcccaggccagagtgcagtggcactatgttggctcactgaatcctcgacctcccaatgctcaagcaatcctcctgcctcagcctcccgagcagctgggattataggcgtataccaccatgcctggctcatttttctattttttgcagagatgaggtttcaccacgttgcctaggctggtctcaaactcctgagctcaagtgattgtcccacctcagcctcccaaagtgttgggattacaggcaggagccaccacacctggccgtctgtctcttaagagatgtgcagcaagaaccaaaccacactccttttctctctctgcaaacagagcctggttctgatttgtttattgcggatgggggagccaccactgtcttagtgacaccccagggcatcccaggcactctcacatacctgcatctctgggacctcagggcctgaaccttctgaaacaagccctaaatttagaaatataccctgttgtataggaacatacatatttgagaccgtgtgctgtacagtgttacatttcaggaagtgtgatcatcatacctaaatccagcagtgtcatttatcccctttgttttttccctccattccccctgcaggcaccactttcatgcctggactaccaacgccacccctcactcacgggtttcctagatgttaacctttcctccctcccatcccatcttccccaaacactgcctcctccaggtcacccttggactctggagcttagcatgactttctcttatccctcagtcattctgaaaagctcctgtgactattttagtggaaggtggcattagtccattctcattgtgtaacactgaaacaacgtaaatgtctgcgggtatggcacaccccacccacacacttacacatccactctcctccctgcaggaagccatcattggcagcctgtagtcttttccttttgcatttacatatacaacttgttttgttgtttccttaagtgatcatattgtaagcactgttctgtgattttgttgttgttgttgttgagatggagtttcagtcttgttgcccaggctggagtgcaatggcacgatcttggatcttggctcactgcaacctccgcctcccaggtttaagtgattctccttcctcagcctcccaagtagctgggattacaggcatgtgccaccacgcccagcgaattctgtatttttagcagagatggggtttcaccatgttagtcaggctggtctcgaactcctgacctcaagtgatccaccaaccttggcctcccaaagtgctgggataacaggcgtgagtcactgcgcccagcctgttctgtggtctttctagtcaattaacagtaaggtcttgggaatctttttgtattactataatttggcatccctcattgctttaattgctgcataacgttccatagtaaggccgtgcccttcagaatcctgtgggcttacgagtcgcagtttacatgtatttccattggtttttctaaggggaaagagccctgcccaggcggaactctcctatctgaataaagcgaagtggctggaaatgtatggggtagacatgcacgttgtcagggtaagaactgtgtgcgtttaagtaatttggttttgctgttactgaaaaatgtatgaacattatgcaaacaaaataacttgtggtgaggaaactgtttttgcattttgcattctgctgtgtgacgacctgttagaaccctctaccgattgtcacttcgtttgtttgtagggaagagatggctgtgaatattctcttggactgaccccgacaggcatattaatctttgaaggagctaacaaaataggcttattcttttggtaatttagttttgtctaatattaaaaatgtcttttcctattttgtggtggaattctatgtgatggatgattattgaggggtatctgcaacacccagattcatcctcagagcacacggtgctgctgttgtgggtctgtggcagttgcgctgaaacttctggataatcacacttggatgaatgtttttattttttttttagtctaagctttaaaagtagaaaggaaactgctatttgatgtgtagatagttttactgcagattgtgcttttaaaatgctttctgtctgactaggcctaaaattaccaaaatggattttaaaaagagcaaattgacactcgtggtggtcgaggatgatgatcaggtaggcctggctcccatttcttcccccttgctgtgaaaatcctgtgttggggttgcaaacgcccactcgaggcccttgtgcttcctctttaagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcaggtagggagccatttctgcaacacggatcacgtcttctgaaggagggcaactgtgatttctttcttgtatgcgaatagagtagtggatttgagtccagaaacttaggttgtgtgtcccatccccacgtttcttaaggtgagtaactgaagctcttttgacccccacctggtcattgataaaatggaactaataacaaaattgttaataactgacatttagtcagagctgtgctgttcaatacagtaggcactagccacacgtggcaatttaagttaatgaatatgaaataaattttacaatgtaattcttcagtatcgctagtcatatttcaagcggccaagaagccacatgtggctagtggctaccatattagacaatatagacacaggacacaggatcattttggaaagttctgttggccagcactgtgccagaactgttcacacacccttaataaggtaggttgattaaccccattttacagataaggaaaccagggccagaggcattacgcttaaaatcacacacagccagtaagtggtagagcggagattcaaccctgtgaactctggctgttaaatttctaactgctactgtattgccttttgcatgccaatgtccagaaatttggggtaattaagaatgagagcagatatcaatgtgtaacccaaggtaggatgagtagatatttgaatctgaaaagagcctgaaaacatcaagagcttattctgatatatttttgcttatcatcctaagaccatttttctcaaagtgtgtgaaaactttcttggtgtttgttaaaaatgaggacaacaacctcatctgagacctttgcagtcagaatctgtgggtatgcatgtgtgtgtatgtgtaaggcctggcagtacgcatttaaaatgtgctcccagggtttttgaggcctatttacatttgagaatctcagttacgatatctaaaacttcacatggtttcataacctctacccacacatggcacatccctgaactctatttaaatgccaaaagatttgctcatttcaaatgtttctactgtgtgaggaaatagctatgaacttctgtttaaagaattattttgttttaaatgctccaaggggtcgggggcggggtggggggaagaccaagctctttttgagaaacaatcaaatcccagggtcctgtggaggatgcagaggttaccggagacactccacagaatgctggtgtctactcggagtggagtgaggcgggaaggacagtcagggcagttgccaaggcaggcttttctctcctgggaggaaactgccccaggcttagtcccagaccatgttcctttctgctcctctggaagtgtaagaaggaagggagtttggaggagaagaggttgcccttagaggcacacagagcaggtgacaaatggtgactaagagcaactggaatgaagcagttgaggagtacatcagacgaaaccagcaacctcctggaatctgcagccgggtgtcacgttggttgaaacccaaaaagccttagtgaaatcagtaatgtttgccttggcatagcaaagaaagctgagacctagttaagtgggtattgataacagtcttctaaaagatgggttaaatgtctatgcagtgtgttctgtgaaaggttattttatgtgaaaatcaatgttctcttaatgagatgtatcaaacctgcttggtttgtgcagccaagtggctggtacctaaattgcaggttttgccctttggtggaaatatctgcccctggactgtagcctggacttggcaaaggagattttatttccaaatggaaggttaaactttgtgtttctttacccaagtgagttcaggctaagttgaaacgtacgttggagctcttggaaataaaagtgcactttcaaaaacaggtaatgtactgagattctgatattgataacacacgagaaaatatttacttcccagtgggcggacagaatatcaagctacacatggctccaggttacgaagaaccagcacctttgagaggaagcctagtaaacgttatccatcccggagacattcaacgttcaaaggttgtgtgtttttcattctttcttggaattttacattatgcttgagtcatttaagccctcgaggagcttggtcaagcagcttatgaagaaagtacccgcagttctccagtctggagcttttggaaaaataatcccagtggtgttcttttaacgggacctggccacttccgccatccctctgtcattagtgtttgccgtggatgtgttcatttatttctcccctttctccatatttctttccatgtgcctctttgcttcttttagacctgggctcaagccccggtacctcaggaatatcacagggaaacacctttcttgcctatagaagatactgtatctccatcatcttgcaattttaagtgtggacatcaggcccatgctaactggaattctgaccacgtacaagtacatgaagaacttttagatattcggctcaagtcccacagtcagtccaaactttcctcacccttaaatttagccaggccctagaatgcctgcccccttcccctttccaaaccccttcaaccttgtccatcagttacagctggggcctcatacctgtatgaggcccggaacacagtacaactcagtcagtgaatgagcaagccaggctcatttctgttggatcccagcctccagatcccatcttgtagctcttctttctctacactaggttgctccccgacttaggacgcccagtttgtactcagtgtttgctcttttatggcagagcctctgcactcccagcctcctggccccttctgtacatgatttccttgtggccactccatgcatttttcttggctcaggacttagtgggcctccatgggacttggtacctctacttgttcccttctggaatctgtaactttgtgttccccaccattctttcctttatgaaccgatggtgcaacagcatgactacctgaaattcttagtcactcccagctgctttagtggagggaaaatgcccacagcacaggaaatagtcctgcccttcgagagaggccaggggatgggagcgtgtccagagaagggcgatgggttgatgaagggtggccacagcgcccgggaggaaggggccagaacgctctctgttctgttccatgaggaggattatgctggtgtgtgtagtccactggttcagagttgtccagaaatagctcagtgtaaggaacaattttccaaagatcaaaagagctgtctcaagatagcagtgcgttcccagcccctacaggtgtatacagcacaaagggagggaccccctggtgtggctgtcacagagggaagtggacgtcctgtggtttgaccccaccagatggctttagagatctgggccccagggtctgtgattcttttccccctccctcttttctctcccttatttcactgacttttttccagccagagttctagcatcttctttgtcaagcttttaatgattttccctgccacatctatccttttaaaaacaaaatggagtgtaagcggctaagctgtacctcattcccagggctctgtccatgcaggccctcacggcgtccccgaggcccctcagtccagacccatgcttatattgcatccctgatcaccgtgtgctgttttcccttttacccacttctctgtatctgcctttctctgtctctagacagggaacttcttgagagcagagactgtgtctctttgtccctgcctcccagagcgcccagccctgggaacctgctgagtggatggttgctgagtgaatcagagggaggggtagtttactctccctgaggaaaggagaagtagccaccatgcagttctgcctgggttggagttggaaaggctctgtgatggtagaagtctcgcatggccattatctgtcattgcatggtgaaagcgataaagttctctaagatgtcataactttctgtttttcctttatagcaagcaacccagtgatagcagcccagctctggtgagtgtccttgagctctagagcacagctctcctctctaaggatcgtatttatttgcaatgttgactttttccttactacagtgaaatcaggaagtgtgtcatctggtaatttttttcccctttttctgctgcctggctattccatgctcatggctttcaataagtacacaatataatgttccaagacagtttggtttttttggcaaacacagctgctttgtttgagtagctgtgtgctttgtttatgataacagtgggtgggaaaggtagaggcctgtgcgcagcacactgtgctcatggcgtggcaggcagtgctgggagaggaaggccttgctcgcgagcaaaagctggacgagagcagatgctagatttgctcagtgacgtgcaggttttacatcatagaagacattaaacacctttactgaaattcctgcaggaaaatgaacttatcacaagagtgaaaattgccagcacaggattcagcaaacattttctgtaaagggccacatagtccatgtttgagactttgcaggctctgctgtgtctttcacagctactcacctctgctgttgtagctagagagccgctgtggaaaatatgtaaatgagcgaacgtgactgcattccaataaaactttacttataaatatcagtggaccagatttggcccaaggggtatagtttttgcaggcctcttccctggcacaggtgtccagggtcttgcctgtatagtagaatgatctggtgagcataattatctgaaacatcctccgcagccacaccccaggcgcattgaatcagtctctcagggtgggacccatatagcttgtttttaaagctgcccaggtgagtctgcccggcatataccgctcttgctctctctgaaacaactgcctgtcttatgtgagttttggcttgttgagtagacaagctgtcatgtgagagaaccacagacttgcattgtttggacctttggtctgaactgcagccgctggtaggtaggccaggttcattaggctctcagtcatcccaggcgcaggtctcaaggcggctgagagggtggtctttgagatgggcacagcttgactgtgccatgcactatcagtcaggacagttggcaaaacgtggcacggggtggagcgggttgcagataccccggtgagcgaggagagccctggctgaggcatcaggaaccctccctccaggtaccagctgtgttctaacccagctctggagacttaggccttcctacttctgggcctccgttttcttttttgcaaatcaggaggttgggctagatcagtgtttttccaaactcttttaccctctgattttcaccctctagaagaaacctgatgtcaaagcccaaaatacagaacagacaaatgtggaggtcctccggatgaagccgagtggggagggagaggccagttcctgcctgctcttctgccactcctcccaccccgtagctccagggcaccttcaaggaacccagggttctagagaacacagctggtccctcatattacacagctggaaactcaacctcgcatctctgattccaaatcctactttcagcgtcattctgccttttgtctctgggttttgttctcagcatctgatgaaggggctcaggggtcctgttgaactgctctgtgtcgccccctgccccggagggtgggaggaggttgcagtattctggatgggttagttgtaggtccctagattcaccccatttttaggatccttctggcagatagtatgccaaatggtatctgtacctttcttagcttgtcggggtgtcttgcttttaattctctggggcttgtaagttacagccccaatttctttactttgctctctaaggtagtgattgttttgcttgtttctccctaataaaattacattttcctcccagcatctagtggagattatatattgggaaccaaaacaaactaaaaaaaaaaaaaaaattctgcccaaaaaaaaaagccctgataaatataccctttaggaacaaatgagctaataactgctgttcgcagctgttcaattgctcttcacagcctgtgggatcccagggtgagtaggattgctgtgggagccgtggatgaaattgtgctctgggctccagaggtactactagaaaaatagcaccttgcggaacgcttaacttacctgatgaagtccagccagaggtgatctggttcagagcctagctctgtgtactggtcctccctgaaaaccagaacacagagccatttagaccccaagcaagacttataacaatgatctgtttgcctctcagtgttggagaagccagcaataacacttgatttcaagcacacctcctggcaataatgattgcctgctctgtccatatatatacatatatatatatatatatttttttttttttttgagatggagtctcgctctgtcgcccaggctagagtgcagtggcgcagtctcggctcactgccagctctgcctcccgggttcacgccgttctcctgcctcagcctcccgagtagctgggactacaggtgcccgccaccacgcccggctaattttttgtatttttagtagagacgaggttccaccgtattagccaggatggtctcgatctcctgacctcgtgatcaaccctcctcagcctcccaaagtgctgggattacaggtgtgagctaccacgcccggcctatatatatatatttagcatttaagatctcatcagccaagcacagtggctcatgcctataatcccaacactttgggaggttgaggctggaggattgcttgagcccaggagttcaggaccagcccgggcaacatgtgagatctcatctcttaaaacaaacaaaaagattccatcgaaataggatcatgatgaggagccctgagccttttctcagtccctctaagagccaagttggtttagcagaaagaagacaggctttaggattctgcagatgttgattctagccctggctcccactgaccagccaggcgaccctgagcaggtttcccaactctctgttaggcaactgttcctttatctgtaaaacgaggtggtcacatttgttgacctcatagccttgtcgtgtggattaaataataacagatgtgaagttcccagtacagagtcttgtctggagagaacattccaaagtggtggccagattattgacagtggttttaatagcaaggggacccacatgtggctcccaccacagtacccagtgggagatgctcaggagggatcggtgcctccccctgccgtgggaagaggctctgcgcatcactggagcttctggtgccggtgctgtgaggtctcccagcaatgccagggcaggcctgaaatgggagtaaaattacttggtttgcccaactgaaacaggacctcatttttgtcaccaaaatatgacattgagactgcattctggaatatttcctactgtttctgtttgtgagctctaaaaggacaagtgaaagttgctgtctggggttttccttgttatatgttcattttaaacagccaataaccaaaaaaaagtcattatgtggaagttcctattagagtatgtagcacataggaatagttcatgattgttaaataaatcattaataatgccactctacaacctatttttctttttttttctgttttttgtttgtttgtttgtttagctctaaaacaaatccagaagtccataattaccaggtaagatactgcttttaaaggttttctttaaagaaggaaaattttaaaaataaaatttaaaaaaaggtttttgtaaagtttctaaattttccataatgagcagtcatcatatttgtaatcagattttgagaaaataataacaatatttgtttttttgagaaaatggtaagagaagagccctttccttctgacccctgccacttcttggccatctgaactgcctgtttttcttaaccttgtcaactggcaagcatcagggacatatgtttaagtttctgggtggccacacacagccccttagtggcattcaagtgaggcagcttttggtcaaagtgtgttttaggcctagggaacatgagtcccttgagatgggcttccaggaaaggatgttttggtcaaatgtttgggaaatgtcacatctttcattccccttcttggattttacagtgtccactgaggtataaaagtactgagaaatcctgcaagaaagacatgttttatttttttaaatgtattgtttccccaaattatttgcgaattgctcccctctcacgcccctgattaaaaaaaaaaaaaaaaaaactagtcttgagctggcacggtggtgtacatctgtagtgccagctatttgggggagctaaggcgagaggatcacttgagcccaggaattcaaggctgcagtgagctattatcatgaataccactgcacttcagcccagacgacacagtgggaactcatctatttaaaaagacaaacactagcctcagccccttcatatcttttttaaaaaaacgctagcctcaacccctaccattttttggtagtggtgaactcattaacacgaatagatacatggtttctagaacctgctttgtaaagcactgtgctaggtgatgtgctaggcccattgcctgcaggaaggagcacaggtacgtttctatggctggcgtcttgctgtttctcaggacggccaaccagggcctgtgccgcctgccagctcacccatgcctggtaacatggaaggtgtggtttacagctcagcctggatcaagcacattcttcctaagccactgtgggtggctctctctctggccattcacagccttgtaccacctggttccaacttctctatttatttctcaccactcccatcacgctccatatgttcaactcacagggaattgcataattgttgccccataatttcttcccaccattctttgcccgtgtttgtctgcctggaattcctttgcttcctatcagtatattaaagtatctctcaaagaccaactcagagttggccacagtggctcatgcgtgtaatcccagcacgttgggaagccaaggcaagaggatcacttgagcccaagaattcaagaccggtctgggcaacatagtgagaccccatctctatttttaaataatcctgggttcaagtgattctcttgcctcagcctcccaagtatctggggttataggtgtatgccaccacgcccggctaatttttacatttttaatagagacaaagtttcaccatgttggccacgctggtctcaaactcctgacctcaagtgatctgctcgcctcagcctcccaaagtgctgggtttacaggtgtgagccaccgtgcccggccagggttcttgaatcttgttattcactgattgttttttgttaaggggttttcaggtgtgagtaactgaaaagttgtagagacaggtaattgataggtgatcagtgcttgaaggagagaaaaattttagaaaagcaaagcagctgagcactgcctgtgccctctccgcatagcctgtagtgtgttctcactgtgcgttttctgcttagagtgaacatgaggcgattgttgaaatcagatctactgaaactcatctaggcattgttatcgcaacatcattggcaaccacgggtcctttggaccttgccaatcttagaggtcttgtgttctatcaagggttgggaataaattgaccgggaagagaacgtcctgagaagtggcctgattggcatgtgaataccgtgaagggtatttgagaggatggtgttgcagcatttatcttatttcaagcactgcaaggtcagccagctgcaaaggatggatctctgtgttctcaatgaggacgctgttggcatttggggagggagagttcttcattgtttgggactgtccctggaattgcaggatgattagcttcccttttctctcttactatgacaagcaaacatgcacacagtcatttcccattgtcctccaagggatatgagtgtaccagttgagaaccagctgggttaacactaaaatactccttgacagttgagaatgtgaataaattgccagaggagaccaaggaagtttccaaaatctttttccaggtctgtggctaaggttcccacctctctctctgatgaatctgatttggttgtgtttaaagccagaggaaaacatagagggtccagttctaggtcagcctttctctattgttgaacagccaatgaatggaacctcattctgggcctgtctatgtgatcaaaacacctggaacagttagactctgggcaaatcatctaaactctgtgggtttctgtagcccctaaaggagaaatatgcagagattgcagcagggagatgctaaagccctggtcagctcccagatcctgctactgaggtattttctccagattccttttcctgcagcatgtccttccgggggctgcagagtctgcttgctgacaggcgtctttgaaggagaaaggaaaggctgcttgaatacagaacaggcagggagggcatctcaggtccatgaaaatggaacgaacagaactgctgagattctctgtgccagagagcaggccactgcttactaagcaaagtatcctgagaaggaggggaagaaataattaaaagagtaacagtggcaagactgtagtgacttaaatgtcaggagggcctaatttgccccttaggagattgagccttgagaagcccctgacttctgctgatgtctaggaccactgccctctgcaggccagaagtggaaaggcaggctgctacctagccggctagggctgcacctcagtccgtttgtgagtacagggtctgtgttctcttcttaaaatggacaacttccttcaaaattagcggggtgtggtggcacgtgcctgtaatcccagctacccaggagactgaggcaggagaatcgcttgaacccaggaggtagaggttgccaagatactgccattgcactccagcctgggtgacagagtgagactctgtaaaaaaaaaaaaaaaaaaaaaaaaaaaaaaaagacaaccttcaacctccttccttctcttctttctctttcttccttcccttcccttctttttctttcttctctctttccctacctgccttccttccctccctcccctcatcccttcttctcaaactctctccctccctcctgttttatcaggatgataagcgctctggatggttttgtttgttttggtattttgttttggattgcattttagaagattatttttattgcataaaccagagagaaagaaaaaaccttcacccacggccctgctgcttcacttagcatccctgtccagtccttgtctgtgtgcagatgtaactgttccacatggtcattgtcattttcagcaatgacaaaaattgtttctgaagagagaagttgcctcccactctccccatctctctgacaccttccgcctcttcccttgggaagatgaatacagcttgtctctggtactccggacgacccccttcaaggccggtgttgtcaccttctaagggcagcttcccagccccttcacagggagccgcctctggagagggcaagaaccggcactgggtgccagcccccagcctttgtcagagggggaaacgtgatcgtcctgggaaacatccaccccctagccagggtctatagcctttccattcttagtcccccagcccctcgggtggatgccaggaacagacaaagcgaatgaggaccattgaaattaaaaggtcatcaaataatcaagtttggtgttttatttctagcctcaatatcatcctaatatccatcccagccagccccggtggcatcctcactctccaaatgtcaggtaagtgctggtgcttccagagctgcaccttcgaaagctttcctttctctagaaaagttcagattctgcttagttaggagtagaaagtctgcatcagaaataacccttaagggatgcattgtcatggccgagatgaataaattttcaaagcaaaggtagccagtgatgtgtgtggatgtatcaaaggtatgctttgtgaaataaaaaatgaattgattttttaaaatcattctgatctcatatattcttggtttttagttttgtgttcaagatgttactgaaaatttctaagtaacatttttctgtcctgagaatttgtttactttaaatgtgatgaaagcttggggattttgttgtcatggggtttttttttttttaaggatttttttttttttttttttttttgcgggggtgggctgggggaatgagtttgctttttgtggcaatagatattttttccctaaactgaggggtcaataaactttttctgtaaaggatcagacagtcaatatattctgctttgtggtcgctgtcacaactccttaactctgccattgtactttgaaaacagccctagacaatccataaatgagaggctatggctgtgcttcaatgaaactgatttagaaaaacagtgggattgggccgagggctgccatttaccaaccttggccccaacctaccataatcctttctaagccaactggcatctgctggactgtgtttatagttaggcttgacaggttttttgtttttttttttttttttttaaggctagctttgtgaaagcaaatgttccttttaagatttgaattttagatcagtcttaattggtgtttatgtgtgaagctatttcagaaacatagttggcaagttcagtttgcataaaggtgaggttgctagcctttctctgagaaagtatggagaataaaatgctggaaataaacccacttagagcaaggccaaaaaaaagtttgttggggaattttgtaaccccaaagcgtgattgtttataaacacttggtagtcacttaactttttaaagcagattaggttagtggagtaataattctaaatcttactgtatttcaaaggtgctttattcttcagacgtaagaaacagaagagatttctagaaacgctattttaattaacattgtttttacaaaagtttgtgcttatcattgcctgttttatcatgttagtttccttctgaggcatggcctagaagcaggccttctgaggaaagccgtaaacagtgcctctctggggtgggcctgctgttggcagctttagtgtcatctggaagcttgtttaatgcaaattctcagccccaccccagacctactggatcagaatctatggggtggggcccaacattttgtgtattttcaagctctacaaagataccccatgaaaacagagtttgttagtccaacacttttggcaaatgctgcctgaggcattcatggtgcatgctggcatgcctccaagcagccctgtagtaatggaacattttccaccttcacttagctttctccagacggacttgacccatgagacaccctttgagaaatgatgacttgaccatagacagacccttgctctgcttggaagttcataggtgatctgcatctgaatttttaaaattcttactaggaaatccattcatttccattcatagccatccccattcacatggctcatggttccccctgccccatttcctttgtgcttgtgttgtttcacttacatttctgcattttcttccattctcccactaaccattcgctctgcaaacaaaacaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagtaacttgagtggtttcagttgtctgcaaccaagaagcctcaccagtatgcatacttatgatatcctgattgttaaatgaagtgtacacttttcattccttaacttagtggacctttctctacagcagttgaccagttcagtcttaacagcctccttttctgccatcctattacctgttggtgttttctaaaggtctttcttctgctcactgctcttttcaccacagtctacccaagtcttctcattctgtcatgattttatcatgctgttgactctgaaaccatcctctgtaacccagactgtcctgtgaacttttggactgacatttcaacttgggtatcctgtgtacacgtcaaactccacctatcaaaaatcaaatcgatcatcttttaccctcctcccacaaaacttttcttctgcctgaattcccttttttacccacagtaagaatgtatacatcatctacaactcttctccctgtcgccacccatatccaaacagtacctaggtctgttcacctctgccttggtattcatacttgggctttcttctctcttcttactggcatggatcccataggagcatcttttctctggctcagaggtgcccttcctgatctccctgactccagttgctcctgacaagctcatgctcctcccagtcactagagtgatctttctaaaacacagtcggcctgtgccattgcagtgcttgccattaccctgaggatgaagtccaagggcctctcagtggaattccccactccgtgtctccatcctcttgctctagcatatatccaccatttctcaccctactgttgaaaatccttcaatgccaaattgcttgtggttcctggcatgtgccacaccctgctgttactcacatctgtgcctttgcaaatactgttctttctgcctagaattctgtcactcccatcccttcccctaactcctgctcaatgtctgcctctgcccagacatcttctcccagggactcttgacggccccacctctgcaaattgggttaatttctgtgttccagtaataaccccctccctttctacccccatctatagcaacgttgcacttacagctttgtattaaaatgggctcttttgtttatctcatcctgaaacctgtacactgcatcaatctgagctttgtgtcttacttgcctttgttccccagcacctgacagatagcaggtgctcagtgaatgtctgctcagcaaatggattattccacattcatttgaaaggagatgtctaaccagataacaggcaataatacatcatctctgggctggtctgaaggtatctgaacaaccttatccagtatgggggcatcatactgtgagtaggacactgaccaccatgtgacttctagattcagtttcatcatctgaatattactcagtgtgtcagctgtgttctcgtttgaggcattggtatcatgctgtacagggcagaagaaagtccagccacgtgacattggaaaccccggtaggtagacattgatctgcgctaatatataggggctagtcatctaatgctaggctttgcatgtgtcacttcatttcctgaccactctgtgagatgggtagtatcctgtttttcatagatagggaagctcaggcttagagtttaaccaagcagcctgtattccagagcctatggtctcaaccacagtggtctcttgcctctcacccttcatcccaccatttgcaaccgtggggatccatatctccatgagactgctagatgatgttgaacagttcactccactgaaatctaattgctaaccagagagccatccactccctccagccatctagtaacccctgtccatctgcattaccaccacaccagtaggtagctaactgtccatacagcccccaccagtgtggcctggtaaccatgttccctccaccatcaccactaccagtcataactgtccatatctcccactcacacacaccagggctggtaaccttgttcatctccatcacctgtgatctaataacgctgtttactgtcttctccccaaacacaccccctccagtggtctagtaaccctctccacaccttaccacccctcccccagtctaaaaatcctgtccccacaggcatcattcagcagtagtcccgcagagattggacattattcttaatgaaccactgcttatttgagacggtccactctatggcttccttccaaagagttcacaaatgaacaatgtcttctggaatattacttgacagtaaaaccacactcactattccataactaatggaattaacttttacattttggaactcgggtatgtactggtttatcatctattcatgtttctgtggtccctcagaacatccaacagtgtattgacagttgtcatttgattgatgtaattcatgccagaagtctctaaatcctgccaggtaattaattaccttggtcttcaaaacccttttgcctatttcgtttattggtctaccatttctgttgaagatggttctccttaaccacaaagatggaggaataaggacagtgtggtaattcctctcagtccttcttgcctgttaatattgcaccatccttccaggtcagcgactccagcctcctgggtcccgctctgaacacaagtaatgacagagtctttttgttgcccttgactttacagcttttaactagtcctttaaaatctgagctcattaaagaactccctgaacagccatattgatcccttcggatcagtatttcccaaacttaagagttgtaaatcaattccctggctgaccaagtcttccaaacgtaccaggaaaataccctacattggtctaggatgatttgcttccactctcttgctacaggaggcggtggacagatgcagaggcgaagcataagggggcggagagaaaaagcaagtcactgttaaaggtcccttgcacatgagaaatggcacattgtaagaaaccctggggatatcaaaaagacaaacatgtaaaatggacattcagctaagccttagcaaaagaaatcctcaatagttctgcaaataggcccacttctgccaaaattagggagctaaagaatggcttggacaacttactaaaaatgtggattgtggcattctaaatggtcagtggtaagacccaagatcctgcattttagcagcccaggacagcctgaggtgggcagtccaggtttgcttttcacttttggaaagcaaagctacttatctgcttgtgttcatcgttattttaatgcctcaattttaactctcagtagaggtcaactcttttttttttttttaaataggcataatgttaagtcaatggatggacacatcataataagtaactagatctgtctgctcagcaaagctatgcacttccttaggcccaaggtgaagcagaaaaatgcgagcattctagtggttctttatatggctttaatttcatcattaactggccccctgcaatctatcaaaccaagtgtgtgttctgccctcccttcccacttcagaagcaagggactagggaattccagctgttggagaaggactgggcgtgtgtatacaccagtctaagcacctgggctaagactggagcccatgattgggaaacagatggaagtttgcagaagtaaaatggcaagacattgccagccagatgagagaaggattaaagggtccacagtgtggtggtctggttttgtcaagggacaagagccccatagttctctgattaggtgaagtgtggaagctttggaatctcacacgatttgaatcccagctttgccacttactagccatgggacctttggccaatttcttctggacacctcattttcctcatccccagatggaatttaccagtatctcactgataagagaattatcaataaatgacattatatacaaaagatgttttgcgcagtgtttgatgctagatggtaagaatttttagtggttcgtaaggtcgtagctgtccatgtggacagaaacaggccaaagagattcaaaatagctcaaggccgggcgtggtgaatcatacctgtaatcccagcattttgggaggccaaggcaggtggatcattcaaggtcaggagttcgtgaccagcctggccaacatggtgaaaccctgtctccactaaaaatgcaaaaactagccgggcgtggtggtgtgtgcctgtgtagtcccagctacttgggagactgaggcagaagaatggcttgaaccagggaggcagaggttgcagtgagccaagatcacgccattgcactccagcctgggtgacagtgtgagactctatctaaaaaaaaaaaaaaaaaaaaaaaagtctagctgaagaaatggtatttctaatagattgatggtttgagatgtatattctaagtttacaaagggaaaggggtgtttggttccaaaggacagatcagatgtaagagcattaacacatatataaagacatgtctctttgaaactaacaaactcagagcagaaacaccatggggatcttttgaggaaagaaaaaagaaatagaaatgatatttctgtccgagaatactaggaaataactgtccaggcagaatgtggacaatgctttcccatctgcacatggcagaattggcatagagtaaagaattggtgagatggctgagagtccattctgctgctacgattgggactcagaggcttggagaattgaaacagagcgtctgctccattcccaccttgtctaatttgggatttcatcttagacgaattggaggaagattttaactatcaggagactgagtggaaagttagtaacaaaagggaaccactgtgctttgttgccattttgttgttgtttttgtttgtttgtttttgagacacggtctgtctctgtcacccaggctggagtgcagtggtgcaatcatggcccactgcagcctccacctccggggctcaagtgatcctctcacttcagcctcctgagtagctggcatgcaccaccatgctttgctaaatttttaaaaaatttttgtagagatggggtcttgccatgttgcacaggctggtgtgaactcctgggctcaagcgatcctcttgccttggcctccccaaatactgggtttacaggggagagctactgcacctggcctgttgccttttttaagatagataatacaaacaatagtaaaaattcaaatacaaatagccaaaagttacttttcctttccaccttcttattccccagttttccttggaagcaaacattgttagcatttttccttgtcaatctagagctactccatgtataaatgagcatatatttaaccaatcaatattgatggacatttaagctgcatcaactccctcaagttacagtggtgctgccattcttgtaccttgtgtttgtgcacttgaacaaatctatctgtagaataaattccctcgaagtagcatccaggttaaaaggtatgtgcatatttaagttggatattgtctaatgaaatttctctccaaatatattccacctgtttatactccccccagctcacagacacccccagcaattatgacaatgcctttgtgacctcacaggaagcaaatcatagcctttgctagcttttttttttttttaacttagtctgatgggtaaaatccagaatttctgttttaattacattctctgtgaacaaggctatgcaccttttaatctttctaaagacggtttgttatatgttttctgtgaaccatctgaaacccctattcttgagtcatgctccttaataaagatcaggctgatgaagtacaattaaccatgtcatcttagcatttataatagtgaggaaagggaaggcttgaatgagttgatatttaccagacatttttttaaaagtaggtttccaggctaagcgtggtggctcatgcctgtaatcgtagcactttgggaggccgaggttggtggatcgcctgaggtcaggagttcaagactagcctagccagcatggcaaaaccccatctctgctaaaaatacaaacaattagctggacctggtggcgcatgcctgtaaccccagctactcaggagtctgagacaggagaatcgcttgaacccgggaggcggaggctgcagtgagccaaaatcacaccactgcactccagcctgggtgacagagcgagactccatctcaaaaaaaaaaaaaaaaaaagtaggttcccagaaattcaggtaacagtcagcatgatactgccctgcagaactgaaaaagggaatgtgggcaacataaagatagcaaagggaaaggaattgattttgaatatctgtgtttcctttcctgtttgggagggtattgataactttccactcaggcttcttagatacccacccagacatcatgaatttccctggtgcattgaccaaggaaggatggatgtacttctagttacaattaaagtttcaatatattggaactgaaattacagccacatcccaagagtcacctgtggttttattggatgaaaggctgcagaatttaaaatattaaaactgctgtagtctaggccatccactaaaaaaggattagaataattagaggaacatccctgtaggctcatgttataagaaacccacagaaacctcctaatcgtcccctactgaatggtgaatggtttaaacatccacattctgcactgagacctcaaaagcaagaggtgttgctatgctaatgctcaaccagcttcattccctggctgaataatggacactgtctgtattaaaggcaattaaaccattaagcccttaaaattcatatcagtgttacagcttcggaggccaactaaggatgttcataatagaagcttctgaaaaacctgcaagaattggggaacagagagaggatcatttgcggaaatttttaagcactaatgaataccaaaataaattaatcctcatctgtatcaccctagaaacacgtacccagtgttcagctccaactctgactcacattggtgtcttgtgcaattagaatgtctaaaacctactcttaacagattatgcatcttattcatctaacctgaactacattccgggatgaataatgttttaatttcattcattcagtgagccggatggcgtctggggagtggaaaaataacacttcccagctcatgcctgagtctgccgtagctctgtcagagtgcacaggatgacaaagaatctgctttgtggacattattttacactcacagctgagctttcgtgacaatgattatttttgtcttactgtccctttggggtctctcatataacactgtttgaggatgtatttaaacaagtggttaggggaaagtctgttaatgctgttgccacctgaaaaaacagaataaaggcacaggaacacagaaatgagacgcaccaaaaaaaaaaatctgtaagaaacccagaagtgaccgggcacagtggctcatgcttgtaataccaaaactttgggaggccaaggtgggcagatcatttgaggccaggagtttgagaccagcctggccagcatagtgaaactccgtctctactaaaaatacaaaaattagccaggtgtggtggcacacatctgtaatcccagctactcgggggtctgaggcaggagaatcatttgaacctgggaggcagaggttgcagtgagcggagattgcaccactgcactccagcctgggcaacagagcgatattccatcaaaaaaaaaaagaaacccagaatggaaagtctagcttattagaagtgactgttgtaaggcaaaacaactatatttgtatttttttttctttaggcaagaaaaagattgaataaacttggtcatgagcctctgagcaaaaatcaactcatgaaatagtaattctctggactgcacacacatgcacacctgtgaaggcacacacacaatgaggaagccattgcaaaacctagcaagaatagcattgcaacacaacagcctttctggcagaaaaatgtcgggacctgcttacacctatttattgaaatcatttgatagttgtttgccaaaagaaaattccagactcagagatggaagcacatatcctgtcctacctcacacaggactcagacccaggaactactgaaccccaaaggctcttgtcagtccttaggatgtgggatgttaatctgcagttttgcagagactacataatgtagttaggaacaagtagggaattcatgtcaaaagtgcaacttttatgaatagatatttgataaattacctaaggagaattaaaatttaaatgcactaaaactaattaattgaataaagttctgctatgtttctgtgcagtgctggtatgttgaagaagatgccatctttggctccaggtaactaatcatcatcagatcaagagctccccatctagcatggattcatacatcaactgtgctagcatcagaattgcttgcaaagttgattggaacatttcttgaaagaaatacaaattggaaaagttttgggccaattagtctctataaaggaatctaaactacacccaaaaatgcagttttgacctttttttttttttttttgagatggagtttcactcgtcacccaggctggagtgcaatggcacaatcttggctcactgcaacctccacctcccagattcaagcatttctcccacttcattctcctgggtagctgggactacaggcgtgcaccactatgcccagctaattttgtatttttagtagtgttgagttttcatcctgattgttggccaggctggtctcgaactcctgacctcagatgatctgcctacattggcctcccagtgttgggattacaggcgtgagccaccacttgtggccaattttgaccttttctgaaaagaaagatgaagtagagtcaaccttctcactagtcttttttttagatataagaccactaagttgctataagaaatcatccctaattaatagatacaacattcataatgtatgacacttctaagatgtcgatacaattttcttcgaaaatccattatgaaaaaggtacagtgtttcaaatatagactctacttgttgccaaatagtatgctttccctgaattcaataagaacatgtaacaatgtatcagtctgtttagtctctaccaaattaaaattgaaataagcgacagctatctgggaaaccagaatgagtaaattgtactttctctcatctctcagtcggacatggcacagatcaaattatatcattgagctgtagttcctggcatacgaatgcttaatgtccaaaaatgcaatgtctgccacccagataagtgagttacctaaggtcacgtaggcaaacagcagcaaagccaagctaagtaccaatgcatgttccttttttgtcattagattgctccttccaaacacatggcaaagcagtattgcctagcaattcagagagcccaggttacctgggttcaaatcccagctctgccatttactagctacatgacttgaggaaagctccttggtctttctgctcctctttccttatgtataaaatgaagataataataattgtcctttcttcaaatggttgttggaagattaagttaactgatggtgaagtactgggcactcaaaaatgttagattttggggttttttgctctgtgaatatttaaagagcatgattactgcactggtgttcaatcaggaggtatgattctggctgacaccatctgctgtaaaaacacactacttgagtcaattatcctaagagagtcccaattggagagccacagttccgggcgaatggactgggtatggactagtggcagggcttcctgactttttcttgtccttggcacacatagaaagtgacgtatagcatgctgggacaagcagacaaggctgcttgaagctccaggctccccatgtcctgcccacttactccaaggactgggagaataaatggttcagcccacttgcaacccttctgaggcttaccagttggaaagttctactgaggtccttgtcagcttatccccaatgtgttaattctgattaggaatatggaattgtccccattgaggctaaagtaaaacaggaaccagtttgtcccaaccagctcctccagaaggtgtgtggagaacttgtgtgctacctgtgagtctactgtgtgggctacatatacactgatcccgccgccaggaaccccaacttggagtgaagacacatgacataaatagctgaggagtaagtccaagttcaggcagcacttgatacgtgtgcactgagcaatccagacgagatgtatgcgactttggataggggaagttcattgcatttcctactgcatcagctggcgtagtacctatgggggacttcttgaccatccagacatgggcattctgttaaaggcggggaatctgttgatttcttggcctgcatggctgatgatttggttacttaggaggtagaagaaaccctgcagttattactgttgtaaattctgttcagcaaggaagactgcattggaaatgtgtaagtaacaagatccatggaagaagaaaaccctgacatctcagaatcatgaacatgaagtgagtgaaatccagggcttaattctccacatattctttttcttcttcttgttgatattcttttctaaaattaatttgtgtgggtacatattaggtgtatgtatttatagggtatatgagatgttttgaaacaggtatgcaatgtgaaataatcacatcatatatgttttactgtttagaaaatccaatttcaaaatgtcatagaaaatagacttgaatattttttacatgggctgtgaatttagaaagcatagataatccgaaagagaaaggctttatgagcctctcagatgaacccacaatttgtaatagtattttaaagagtaggaaggtggaacatatgatcaaaaagaaagcggcacagaactttttataaggactccaaagttttgtagatgctcacttcagttggggcaaaaagatgagcaatttaatgacacccagttttgaggatggtatgtgagactaacaggcagaaacagagctacctgacttttgttgtgcttttttctttttcaacaaggaagctagtcactatactaactgcagagagtgaagagaacaaacagaagaaaattgaagtccaagataagagaaagagtagtcaggaaatattttactgctttttgattagctcaagtctttaggctcagaaaaatggtctcccaaaacactgagaaaatttgcacttgtcattgctgagtcagcatcaatacctttgaaaaagtcttgggaaaatgctagataagtagatggacagttttttttggaacatgaattccaaaaactaggctgataagctggagtgcaatactgaggaaagtttgagaacagagtcttttgtaagcacttagtaaaggaagcagtgttgacttaggaacagcacagatttgctgagaataagtcatgctaatctttcaagatttttagtaagctaagagtggaagaactgtctaacctgataagtagaatttatcagaaactgacatttaatggtgaaacactagataatgtataaacttcagaaataaggcaaggataactgctgatattcaatattattctggagaccttaccagtggaacaagccaagaaaacaaaattaggaataactactggaaaggaagaaacaaaattcacgtgattctcttcttaaaatccaagtgaattccaactggtaagagttgtgcaaagtggtcagaggcagaaatatcctaaagtcagcagctttgtatatccatctagtcattaaaaaattagacaataggggccaggcgttgtggctcacacctgtaatcccagcacttggggaggtcgaggtgggcagatcacgaggtcaagagatcgagaccatcctggccaacatggtgaaaccctgtctctactaaaaatacaaaaattagctgggcatggtgatgcacgcctgtagtccaagctactcaagaggctgaggcaggagaatcgcttgaatccaggaggcggaggttgcagtgagccgagatcacgccactgcaccccagcctgatgacagagcaagactccgtctcaaaaaaaaaagggggggatatgtaataattaataagatctcattttcaattgtgacaaaattgaaaaatacctaggaataaagttaatgttttgtaccttaatgaaaaagtttaaaaattctaactgaaggacattttaaaagatctgagtaaatggagagaaatatgttccttacgaatatattctttcaaattaatccataatatgtaatgctttaaatcagaactccagtgggattttttggaagtaacttgaattctggaattcaagaattcaagttactatcacaaaaggaatctagaagactaggcacatgataacagctaagaaaaaaaagaaaaagaatgatgtgagaaagggaataagatttataatgtcacatatgcatgtatatattaaaacaaaagtaattaagacagtctgatataggattagattagtagaacaataaaagtatgaagaggccaggcacagaggctcatgcctgtaataccagtgctttaggatgagaagtgggaggaccgcttaagaccaggatctgagaccagcctgggcaacatgatgagaccctgtctctataaaaaaaatgaaaaattagccaggtgtggtagtgcacacctgtagttgtaggtactcgggaggctgagagaagaagattgcttgagcccaggaattcaaggctgcaagtgagctatgattgtgccactgcactcttgcctgggcaacagagggaaaccctgtctgtaaaaaacaaatatatatatatatattcttcatatatatatgttcttcatatatatattcttcatatatattcttcatatatatattcatatatatatattcttcatatatatattcttcatatatatacttcatatatatattcttcatatatatattcatatatatattcttcatatatatatattcttcatatatatattcttcatatatatatatattcttcatatatatatatatatatatatgaaaaatccaaagagaggttttgattgtatataagtcatgggcaatccgaaaactgaaactactctaggcatttcttacagagggaatttaattcagggaattggttatacaagggctgaaaaaactaagaaacttaattggacagtgaggtaacctataaattagcaacaaacagaacctgcttatcactcctagagctggagggacaaggggaagtggcagtgttatagcacccaggagctaaggtagcaggaagacagtctagagggagctggagccacagagaactcatggctgcttttggaaacatcactggaggcatgaagaaatgaaggagaaataccctgacttgtctcctgtattcaccctccagtccatgtcagtgcctcccattgaccaaacctatgtaaaagccagaggacagggagcctgagaagtaaagtttcctgtaaacagtgtaagttgcaggggagcagagaaaggatctgagagcactcaggaaagtggcagacacatatgaagatggcatcacaagttcatggggcaagggtgaatgattctttgggtgatcttagaacaattggctctccatttcagaaaaagttaggactttacttcacaatatacacataaactcctgatgagttcataatcgaattgtgaaaaataaaagctggaagttcactctcatgccaacatggagctcaggcaagtcccctctccagttagcatgcattgccaactccaggccttagcacatgcagtgccctctacccagagcaccctatgcagtccctcccccagccactgccatcatccttcaggagccaggacctgcttcaagcatcactaccccaggaagtcttccttgttggttccacttgggttgggcacccctaccccatgtatcaaggtagcagtgagctccttgaaggctgatatggtttggctgtgtcctcgcccaaatctcatctcaaattgtagctcccacaatccccaagtgttgtggaaaggacctggtgggagataattgaatcggggaagtttcccccctactgtggtagtgaataagtctcatgagattcgatggttttataagagtttcccctttcacttggctctcattctctcttgtctaccgccatgtgagatgtacctttcaccttccactatgattatgaggcctctccagccacgtggaactgtgaatttatcaaacctctttcttttgtaaattgcccagtctcgggtatgtctttaccagcagtgtgaaaacggactaatacagggcaaagataacatctcatttgtctttatccttgtgcatggcacagtaccaggcacaagagctggccttcaaatatgtaccaaatgcactgatatttcattttgttctccgtctaaccagtattagttgagcacctgctatgtgcttagtacttttcttagcacagtggaggacacgaaaacatgtgatgtgacagtctctgttcctacagagttaactgtatggctgggaggacaagatacatacacaaggatgtcttagccagggggttctgaggaggacttggattttcctgatgagtgcacttgctgccttaaatagaagccaagacagatggaaagaggcagcagatgggcagcacttgaggcagcgagcagagaggcaggagtctggactgtgtcccaggatcaggcaggtacctgctgtgtgacctggtcacctccctccccatagcgagcccccatccccccatgtgcaaaatgaggaggttggactactacagcaatggttctcagccctggccacacattggatttagagatagattatgatgtaattagtctggggaagggcctgggcattgatacttttcaaaacctcttcttgtgatatttttatcagctttaagatacacatcaattgtacaacttaatgttttttagtattttcaccaagttgtgcaaccatcgctgcaatataattttagaacattttcatcacccctagaagaaactccacacccattagcagtcactcccccttccccccgtccaccatcctccctagtcctaggtagccggtaatccactttctacctctatggatttgcctattctagatgttttatataaatggaataatataatacttgtcctttttgtgtctggcttctttcatgtagtatatcatgttttcaaagtttatccacatcatggcctgctcaatatttcattcccttttgtggctgaataatgttcttttgtatggatagaccatgttctgtctatccattcatcagttgatggatatttggggtgtttctacctgttggctcttatgaataatgctgctatgaacattcacatgtaagtttttgcatggacctgttttcatttctcttgggcatatactagaagtgggcttgctcagtcatatggtaactaatgttcaactctttgaggaactgccaagctgtttttcaaactggctgcactattttgcattttctccagcagtgtataggagtttcccctggtttattttattttattttattttatttttattttattttatttttgagataaaggctccttctgtcacccaggctggagtgcagtggcacaatctcggctcactgcaaccttcacttcctgggttcaagtaattctcgtgcttcagcctccagagtagctgggattacaggtgcccaccaccacacctggctaatttttgtatttttagtagagacagagcttcgccatgttggccaagctggtctcaaactcctgacctcaagtgatccacctgcctcggcctcccaaagtggtgggattacaggtgtgacccaccgtgcccggcctccccctaggcactttaatatttatccaggttttcaaaccaccgaactggatgatatctgaggggctccatttctaaaattctgtgatttcttatccaggattagatccccagggctcccctgaaaagcccatgtcactcagagctgggctgagctgtagagtctgtgattggctttttggggcattgatcactcagccttgttgttgagagaaagccatgcccagcactggtcacaattctggtggtggattccagaggataccattatgcaatatgcaacaattttttttttttttttttgagacagggtcttgctccttgcctaagctggagaacagtggctcgatcttggatcacactgcagcctggacctcccaggctcaagcaattctccatctaagcctcctgagtagctaggaccacagtatgtgccaccataccgggttaattttttgttgttgttgtggaaatgggatcaccccatgttgcccggtctcgaactcctaggcccaagcaatcctcctgccttggcctcccaaaatgctggaagtacaggtgtgaaccattgcgcccggcctagcatgcaacaattttgactgagcaccacatgtttggttgtctggcagtccagggtcagggagaggagatgctctggttgggggtacatgtgggattaggcagggctggaagagcccctgtaacatcacttgttctgcaagcaataaagtctcttatggctaggccccagtaggaacactagcttttctggagttggaggccaaatgggaactgggtcttcccctgagaaaagggaagagaagaaatgagatcagggtcagttctcactctgcatttactaacagggcacattactccctttcactaagccccagtgtctaagggggcaccagcagcttccttgcaggaaaactgaaaattaaccattaaagtgcctagcacagtgctaggcacatagcagccccttcttccacactagatttcttttcaactgccagctcatgaaggcagagactgaagcctacatctgtcctctgtcacccaccctgaaaaccaggatgtgggacctcctttccagaatgccaggagtctcatgaacctcagtctctggtgatgttgagtgtgcagcaggcctcatctcctgggccttagccaaggtctctgagtactgctggaccttctagggtgggcttgacctctgaggtctctatgaagagggaagatgcgcaacctagtgaatgtcatttacattgtagtcggtgagtggcatctccaggagttccgcagggcacaatccatgaagccatgagcaaccccacaaaacttctccatgttagaatcttcaggatgatcccccaggcgtgtgagctgagaaagcacccgagtcattctactgcttgcttaggaacctttgctctgcgaaagacctttcacctgagcagattcaggcggcttcaggcagcttctctgaccctcatctatttctcttttcatttgtttctttctctgcctctctccaaagtagctataagatgaaggtcacacatgcatattttatttgacgtgttatgaaatgcactttctcactccctgcatatatatctttttactgtttaactctttactctgggtttccttgaaataaaaaagttttaaataccactcacttttaacttggaaagacaaatgcatgataccactgtgctcttccaagtccatggcagacatcaataatcaatcacagcactctttccccctgagttgggcacaacctcagactccttctgaatcttgcactccaagcagagagtgcaaatcaattggagttggcatgacagatgatatctatttgccatccctcaggaactcttactcaaagctttccaactccacctccagccctgaatgtacgccagatctctgctacaagacatctttccctttgggtgttcattctcacactctttgttacccacgtgatggtcgatcataattttctctgctcaaagcagctctcatttgccacctctttttttctattaatgacatgccatttgcctggtcctctaggctaaaaaataattggagttttctgacccttccatatctccacattctccctttctcaaatccagctagtatccctatcttttccttttgatgtttctctgatttgtccctcccacctagacaatgatggtgtcagacctttaataagctggcggcagcaaggaagaagggcagggtggaagacgagcccctcagttgggaagccctctccaggccttccaagcaaaggggaattttctctgttatgagctcccagtctctgcagctccttaggacagatattattttcaacatatttgcaagacaggaaaaatattaacaggctttggggtccacagacctgtcgtcaaatcctagctgcacaacttcattaatccatccttcctttcattcttccttcctccccctccctcccctcccttcttccttccatcaaatatttatggaacacctgctatataacaggtaaaggtctccatgtttttaaaagggaatcttttctgtaaaatagctagcacagtatctgagacatacagcaagtactggataaatagttgggggaaaggatgattctcagatacctaaatttgcccagaaatcgcttaacccaactcacgttacagctgagggaatggaggctcagagtgactgcccaagcttctcctgcaaagtaggggcggaactaagacttgagcccaggtttttccactccaactcagggcactttttgctgcctccatggggcatgaagagggtggatactctggttatgtttcaggttggagaggcgaggagggatggtgtttcccagaagccaaaatcgtgccttcttccacattcttacacacacacacgcacacacacatatgctcacacacaccaacacacgcacgtgcacacacgcacacacacagaaccgtccttgagcaaagtctccaggaggcagccaagatgggtcagagatgcagctcatggggcaatgtaggggacaaatagtgccatttcttctggactgtctcctgcatctgcaacacagtcctcaatgacacctcctcccaatgtccccaagtgacaggtctgcaagccctgcttacacagcttcaaaatatcccagaaggcagttcacctcactccatccaccaggttagtctagatcccgccctgcggcagtctcctaacagagagatactggagtctctccccaaccagtctcctccacacagcgctcaaaacaaactctccaaaatctaactcccttgcttaagccctttccttgataaccaggcactctaagcccttcataactagccccagcctgtcttagtctcccttcctgctactttcctcctcacttctccagacatcctgctctttcaaccaccgttcctttgctcatgctattccttaggcctggaacagctgtttctaccttttccactgaaaagaaattctacacacacaaatgacaaaataacacacctcctctgatttcaagcatgtgggttattaattggaaaaacccaagtacttcaagcaataaataaataaaggcatttactggagcttataatggaaaagttcagtggtaatgccagcttcaggtgtggctggaaccaggagctaaaatgataccattaagtttcttctctctctgactacctctaacctctgctcatcttgtctttctttgtgcattggcctcagtctcacagggactacttctctgtgtccaaaaaagatgttcacaaagagccctaacttccatcatccttacagccggagccagcttacccattacacacagtaggcacacaatacttagactcacaatactttcaggggcccacgaaaaggttttaaatattttttaaaataagaaaaaaatggattttccgttgaagaaaatgttttagtatatgttattaacatatttacttttatgcagttgtgaaatttaatttttagttaatttttatagaaaatggacaaaggtggccaggcacggtggctcacgcctgtaatcccagcactttgggaggcgggtggatcacaaggtcaggagatcgagaccgtcctggctaacacggtgaaaccccatctctattaaaaatacaaaccaatagccaggagtggtggcaggtgcatgtagtcccagctactcaggaggctgaagcaggagaatggcgtgaacccgggaggcggagtttgcagtgagctgagatcgcgccactgcactctagcctgggcgacagagcgagactccatctcaaaaaaaggaaagaaaatggacaaaggcaaaagtgcttgtggcacaaaaaggcacaataaggccctgcttgcctgttacaaagaaagagagagccttcctttcagttttcatgtgttaaatcttaggaaaaactctgattgtccctaattggatgacattccagaacactctcattagaaggatgcaggactctgattggccaggctcaagtctcaggcccacccctgaggaggaaatgtcaatcccatacaaacacaaggaatggggtttcctataagaaagaagattctgtttcaagaactgtccagcaaaacctaactgtcttcccccgaatgctctttcccttacaaacaccttcccccaggagaactgattgcttccacttctgcattttcttagcagtttgttctagtatgattgtaagtgactgaatcacagagcttcctactctggagtgtgagttccttgaagacagagtgaaagagtgggcagtagagatctgaaccatgggaatgagcagaaaaaggggttagccctgccagggaataagaggaagggatctttatctgggtcttaaaggctggaagtcttcctggaagaaggggtattttcactgggttgacagatgaggaaggacttcaggaggcaccaagaagtaagaggcatcgggatgggaaggagttagggtgggaagtagaaggatgtagcaggagatgaggctgaaaagagaaagggccaagactgggggcggggggaggtgctgtcagtgccacataaaggattgtggcttttatccttcaagccagggctcttcacctgggtccatggagaggctctagagggcctgatattgtgtgtagaatgttgtttgttggtacagggaaggttcgtggtattcaccagattttcaaaggggtttctgtcttaaagtggttaagaattattagtgttaggctgggtgcggtggttcatgcctgtaatcccagcactttcggaggctgaggcaggcaggtcacttgaggtcaggggtttgaaaccagcttggccaacatggtgaaaccccatctctactaaaaatacaaaaactagccaggcatggtggtgtgcacctgtaatcccagctactcaggaggctgaggcatgagaattgcttgagcctgggaggtggaggttgcagtgagctgagatagtgccactgtattccaacctgggcaacagagtgagacactgccaaaaaaaaaaaaaaaaaaagaattattagtattagagatatattcaagctccttgaagaaggagagcatggtctggaatgtaattagaatagcactctggcaattactctgtggaggatggactaaaggaacgagcagagacggggagagccagcaggaatctgttacaagagtctaggtgggagatgacacggccttcaaatggggcaatcctagttgttttttgttttttttttaaaaggaggtggtccactggaattaaaagatgttgtaagctgggcacagtggcttacacctgtaatcccagcattttgggaagcccaggagggtggaccacttgagcccaggagtttgagaccagcccaggcaacatagcgagatcctgtctctacaaaaaattttaaaaattagccaggcatggtgtcatatccctgtggccccagttgcctgggaggctgaggtgggagaatcacttgagcctgggagcttgaggccacagtgagctgtgtttgcaccactgcactccagcctgggcaacacagcaagaccctgtctcaagaaaaagatgttgcagcactgatgttaactggagctttctgcatgttgtgggtgacagagaggaagagaaactgaccccaagacttctagtttgcattatgatcttgtcataggattatttacaaatgattttttattattgtttttacctcttcctctcatttagagaatgcctttaaaaaaaagaaataaatattatttcatttaatttcaaatacttctttaagttacaagacttaaagtctctgatatatacaaacttccactttgctctttttcttaagtataatattaccattgtatatactttataataactacagatctagtttttgagtttatttctttcagtgtttaatgcctagaaaacgtctttgaaagtacacagagggcttgcaaggcattctgcttttctaaatcctgactgtgtcaccctccacagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaagtgagtaggggtggagggggcaaggcaggagaagggggagcaatgctgcagggcacgagagttccctagattcttaagacagacccttgcggtgcagcacacaatggttgtcatgttatgctgggctaccgggtttgggccagagtagacaagagccttatgcatttgagcagaagcactttagggattatggtttaccagtaaactctaatttcattatagggtcacagttctccacctcctttctttttttcttttctttttttttttttttgagatggagtctggagtctggctctgtcacccaggctggagtgcagtggcatgatctcggctcattgcaccctccccctcccaggtccgagcaattctcctgcctcagcctcccgagtagctgagattataggcatgtgccaccacacccaactaatttttgtatttttagtagagacagattttgactatgttggccaggctggtctcaaactcctgacttcaggtgatccacacatctcggcctcccaaagtgctaggattacaggcgtgagccaccatgcccggtcaagaagtgaaggcttttgaaaagtgattaagtcatgagagttccactcttatgaatagattagtgccttacaaaagagctggacgaaaaaaatcccaaagtgctgggattacaggcgtgagccacagtgccccgcctccacctcctttcttaacagttctctgcctctgtggtacccagcactggcttgagcaatggaaaagagaaagaggggaggggagtgatggctggactttctactttcttcatcatagaaaaactcattctatcccatttttgacattccacttgggagagcaaagtggtgtcaggtagatccaatctgtctactgttatgggtcccagaaagagaagttacaaaaatagagagtgagcaattagaaattttattattttattttatgacagggtcttgccatgttgcccaggatggtcttgaactcttgggcttaagcaacactcctgcttcagcctcccaaagttctgggattataggcatgagccaccatacccagcccagaaatattgttagcaatatgatagaatgagtttatatcttttaaatctaataaaaatatgggctttgattcggcatgtccgttattttatttttctagaaactcacttttattatacgttaccaaagaattcatctttggtatgaaaagaacctgttgtttatcaaatgtggtttgaaaagtactgagggctggacgcagtggtacgtgcctataatctcagctactcaggaggttgaggcaggagaatcgcttgaaacttggaggcagaggttgtaattatgcttgtaatcccagcactttgggaggccgagatgggtggatcgcctaggtcaagagttcgagaccaacctggccaacgtggtgaaaccctgtctctactgaaaatacaaaaattagctgggcctggtggcgtgcacctataatcctggctacttgggaggccgaggcacgagaatcacttgaacctgggaggtggaggttgcagtgagccgagatggtgccaccgcactccagcctgggcgacagagtgagactctgtctcaaaaaagaaaagaaaagaaaagaaaagtactgaagtggaggcttcgattctagctcttacccttgaactgagttccctctttgatcttctattttctcatccatgaaatagggtagagggtattgagatgatgaccaaggaatcttccagctctgatattgtgtgagtctgtgagctgttgagacaggatgggccatccaaccttcaccttggggccacagggaacaactctgtgtcagctgagctggaaatggaaactcgacacccacttggtattgaagaatccgaactctgtccctcatcactatccacactgcccatgccctagtccctgcctcatctttgtatatctaaataaccataacagcctcctaaggggcacccgctccaggacaatctccaaatagtagctgccaaagtcatagttctcaccacataactctgaccacatgccataagacctttcattagctcttcactgtctgggataaagtcctcgcttctgagcagggccatacacagaccttgcgtatcctgacccctgccaaggtcttcattcttccctccactcctcaccatactctagctacacagaactactctcttcttacaaaatactctactgggtctcaactctgtcctttgcacctgctgttccctttgcctggaatacttttccccaccttgttgaactcctacacatcccttagcagcccattcaaatgttcgcttgtcagtgaaatgttctctaacacccatcctcagttccgtcctgctcctttagcaattaaataaaccttttctcagtcttcttcggaatatctccacatgtgtccgtcatccccattagattaaaattttgtctcattcacctctttctttcagctcccagatcccagttgctaacgatacttggcacaagttttaatatgtaatgaatatttaatatttaatgaatatttaatgtattaatgagtaaattcaagctggaaggagaagtagtggcaaatgaatccaaagtagcacagaaataaaaatcaatggatttgattttaggaacataacatggcttttaagggcacgttatatgcctgtttgcctgaacactaatctttccaatttgcataatgcttttccatttttaaagcatttatacataaatgacttcattggatattcacagcaaccctgcaaggtaagtaattttattttcatttttaaatggctcagagggtcagagaggcaaaacaacgtacccaggggcgtccagctcatgtgtgggacagttaagccttgaaaccttgacctcagatattctcacaccctatcagctgatgcatactgaaggcatgagagctgctggaggaggaggccggcagaaagggtgctgggaatcgggcgctggcaagtgtcccttttcccctgtatctatctgtcctttcaacctttccttatttatttctcctggctgctttgtagaactgagtccaggaacacctgccttgttcagtgaagccgctgcccatctaaagaagctggaactggaaactgtgaaggctgctggaccctggcctcctctgcacatcaacataaacaaggtgccaagggccggggctctgccatgaccatggacttggtgctgacatcaaacctctgattactaccctagcctgcctgctaaaccaagtgcctttgccttggagggatctctattccatctttcctgacatttctgttcaggctgtcttttaggagcaaatatttacttaccttccttttgggtgaattatagcattaggcgtcgttcccagtgttttgcctgacaggctagatctgtttgttagttgtctctccctcctactagaccgaaagctccagagggagcatccacatttaccgctttgcatttctagccctctatctccctctgacaatgcctggcacattgtagatgttcagtaaccatttgcagatggaaggaagggagggattaagatacagaaggagaaggagacagggcagaagccaggcccccttttgactagacctattcttacatccaaagaggcagccttataaaagtcaaattttatcttagaacgatacataccactgctggattcagtctgccatttagttcaaccttctcaatgtctcagaccagaggaagggaaatgactttctcaaggttgcacagcccttgacaaccttctcaatgtctcagaccagaagaagagaaatgactttctcaaggtcacacggcccttcacaaggttgcaaagcccttgactctcgatccagtgtccttggcactccaacatgcttcctcgttttctttgccagcgtttctcaactttggcactagcaacattttggcctgatgactcttttttgcagtggctgtcctgtgcattgtaaaatgttttgcagccacaatgcactaaatgccactagggacccccatccagttgtgacaaccaaaaatgtctccagacattgccaaatgttctcagaagggcaaaatctccctagttgagaaccactgttgtacatacattttaattttttaaatcccctaaggaagaatctttttcattcatggttcctttcttcctctttaatgcttagctttgtccctttatgagagggaataggaagaatttggaagaactgctctgtgcagcatgggaaggttacacctcctgcccttcccgtccctgacctttcccataatccctcagcagggcggcctaaagttcctctgattactaatggaccccaactgcaggtttaaccttcaaaaagccctgctcattcactttttttttctatacctccctccatgattgccagctagagagaattcctcctgcaggatggctctgatagccattcaatcaacagatctttattgagcaggcttgccctagctgctagggattcaacccaatgcaccgtgtgccccctgattggtcttctttttcttagtcgcctggttttcaacttttcttctgcagtgtacacaataaatggttttaatgggggcttatccagactttggcaaaatccaaaaatattttgcaaggaaatacagcatatagtgtagcacagaactcacaagctctatagtgatttgcaattgccatgactattggtggagcgttgacaacagcagtttgctctgggtgaaggcctacctgagacacctgtgggttatcgagcatttccctggaggtcaagttacaactcccttcctatctcctccactcaaagaaattggcctggcatggtggttcatgcctgtaatcccagcactttgggaggctaaggcgggtggatctcttgaggtcaggagttcaagaccagcctgggcaacatggcgagaccccccccatctctactataagtacaaaaattagcaagttgtggtggcgggcacctgtaatcccagctactagggaggctgaggcagaagaatcgcttgaacccacgagacagaggttgcagtgagctgagatcctgccactgcactgcagcctaggtgacagagcgagactccctctcaaaaaaaaaaaaaaagaaaagaaatacattagtaatcaagtaagctagagtgatgtgattatacagataattttgactttgtcccgacacacacacacacaaaatatattacttcacactttgatttttttttttttttgagatggcgtctcactctgtctcccaggctggagtgcagtggcatgatctcggctcactgcaacctccacctcccgggttcaagcaattcctctgcctcagcctcccaagtagctgagattacaggcacgcaccaccacacctggctaatttttatatttttagtagacatgggatttcaccatgttggtcaggctggtcttgaactcctggcctcaagtgatccacactccgcagcctcccaaatggctgggattacaggcatgagccaccatgcctggccacactttaatttgttgttgttgttgttgttgttatcatccatgaaacattccttgcaacagatctcccttctcacttctgatcatgacaccaaaattgggagccactggcttggatggcttttaaggttttttccagcctcaaggatcaagaatcctctgattcttctaaggtttggataactttcgcttcttgattgaatggtgagatgtcattttcactgtccagttccaaagtttgtgcccaaaattaacacaagaatttaattctcatcagattttagatgtgtaaacaatttgtataaacaattcaaatatacatctgatcatttctttatccccaaatgatatccccaaacagacggactatttccaactataataatatcaaagcctaattgtcattcatgtctatgttttgaaatctgtaatcccatattgaacaacaaagtatctttccacaattcaaattgactgaacataaaatacaaaatacagtcacaggaaaggagaaagcacaacattcttgaagccatcctccaggaaggaatgatacggtcttggaacccagatgcttatctgccacagagatatcttttatacaaattcatatgacgacgcacaaatttcccaaaatgtatattggccttcacctgcgtcagttcatatagcagaatattacaggtcttgcattgtccagaatgaacaagaacaagccagcttgaattttatgtccaaaaaagcagtttagaattagtaaattcaaggggaaaatcagtgctaacttttcgttcttattttagcagcattctattttttgaagtgggtcttcggtcattactgccagtataactacttccccttaagcaattgtcaaaagcctcaaatgggctttataaccaatttgactcctgtatgccagtataccattctgaaaaattaaatctaattttaaaactatctcttcatgcaccagtgaaatatccattcaattatcttgatgtaacaggatttacaaacacaagataaattatcttaagggtatactgtaaacctcacctttcaaaataaatgttacttatttgcctgaaggagaatgtggaggccctcaggataatgaatccagtcaaatgagccagctttcttcagattcagcttgatggctcaggaacgattgatagctcaggatcgatcattagtgttctcacatccaatgctcttttttttttggttatatatatttgctaactaaagaatctaacctgaaagtgccatttatatctgtttttctcacttgagcaccataacaatcctatgaagaaagaaacagattcagagaattgaaggggaagcagtacgattgactagtcaggagctctggctttggagtaaccaacatcaccatttctggctgtcaatcttggctcctctgcttacttcctgtgtgactatggacaagtgacttaccatctatctgctttgttttttgtatctataaactggggataatgatagtagttatcttgaaatgagatggttgcatgaggggacttggtgagacatgcgtatgaaatgcatagtcagtggctaacccataataagctctcagtatatgttagccactggcactctttttctttttataaacagcatcttttttttttttttgagacagggttttgctctgttgcccatgctggagtgcagtggtgcagtcttggctcactgcaacctccacccctgagctcaggtgattctcccgagtagctggaattataggtgagggccaccacgccctcttaatttttctatttttagtagagatggggtttcgctgtgtttcccaggctggtctccaactcctgggctcaagtgatccacccgccccggcctcccaaagcgctgggattacaagtgtgagccaccgtgcccagcccatgatcctttttttttttaatggtccaagtaagtgaaagagctgagattcaaatctgtctctgccgtcttgctattacataaaattggaaagttctgcttggtctaccaaatgcttctccatatgtttggaggtccccctgggaaactctacctcatttctttattaaacgatattagctggccagttgctctatacttcctctagctttcatagcacttagtgtgtaccaacatgctcagtaggacttcttaattagtgaataagattaatgttggaacttgaagaacttgagagctttgggacatttgattcttgctctggtgcatggtggctgatatgtcacatttagtcctaatattactgaactgacctctagcaatcacacggtcctgtcttccttattaaacacgtctcttctaataatgactgtatattatcataatcttctttagtaggtatttattggacatctactatgtgccgggtaccatattagcattgggatatgaaatgaccacaataggcatggttaacaataagacattatttcccaaaatgtagtgtgtataccatcaaaggtgatttcaggttgtacacatggatgagtactttttattttaatagtgatttaaatatcatcatgtttattataataaatataatagtcacaaagcctataatttcaaagatattattgctttggacacagttcaaataggtggtcccagggtaattcaccttaactggatcacatgaattatagatacatgttcagtgaatacatgagatatggcaaaaattataaaggtcatgcaaattactgaagtacaagacactctacaataagctaacaaatataaatttcttgttgaaaatcacaattttctgcaagatttgttgtcaaactaccaatgaatattttgtacccttcccctggacccaacaagtcacagaattgaatttttctatgtaagagatggcagttatggggaaaataacactggactgaggttaggagacttgaaccaggagatgtcctcttctgccactggctcttgccccatgatgctggaaaagccttttcttctctttaaacctttaccctggcttctggtaggtcctcaccctatttcacgagggaatgacatgctgtgcctgagaaccctttgcaaatagtaaagcacagataaaaatataaggagttggtgacacccctgtctatgtatgtaggtctgtgttatatgcagttatgattattgggaaaagttaatgcacatggttctctctttgtttacaatctgctgtttgtattttggtttgtctcaggctgaagaaaagaaagtctcggagaaaactcttcagactccacttttgccttcccctgttgcggatcatgtgaagtgtaacattctgaaagcccagttggaaaatgcttcccgagtgaacatccaggtgcgcagaatgcatacattcctttgatttcatgttataggatttcctcgatgccacagagaagaaagaggcaccgtaggactgagatgctgtgtcagtcagggtccagtcaggagatgagaaccgggcatgtgaaccatacctgatatgtgaaccatgattttaatttaaaaggattaggtacatgaaagggtgaaaagagaacttgaaggcagcagttctcaaatgttattgtgcataagtcacctggaaaactgggccctgtccccagagatttggtaaattggggtgggggctcatgaatattcctctcctctcctctcctttctctctctctttctttttctttctttctttcttgtctcactctgttgcaaaggctgggctgcagtggtgggatcatggctcactgcagcctcaacctcacagcctcaatcaatcctcctgcctcagcctcccgagtagctgggactacaggcatgcaccatcacacctggctaatttttgtattttttttatagagacagggttttcctatcttggccaggctggtctcgaactcctggactcaagcaatcctcgcgcctcagcctcctaaagtactgggattacaggcatgagccattgtgccagcctgaatatgcatttctaacaagcccacaggaccacattttgggccacacaactctaaggtaccagaggtagcaactgcaggccacactttccatccctatagctgagggaacagagatgctgtcaacattaaaatttagatatttggaggagaagccctgtggagactaaactcagacttctaagcaggggccactgtgcctggcgctggcatttctgagctcttaagacatgcctgtgggtcctggactcagactgaggaggggacatcagctggctggtgctgatatgtctgaggtggataccatgcagctggatctgccagtgttggaaaactgcaaattgtattcagctgtgactgcaggaggacctgctgctgcccacaagaagcagcaaggctggggtgactcgcaggagcaggaagcagacaaggagcgccccatgtggacagaacctatcatggagccacctggcaaagcagacatgaggtttgcaggcccctgggccagctccataaaatagatgtttgaaaggtggacttggagataaaagttgctagtttaatagctgccataaattctcccacttgaactcataacaggtatccctggtggaccatgactctttccctgtgaccctaaatgcagcctcagaatcactttctacatggtgggcattccaaggaggtaccacctgttgatcagagttggcactcaggtggaagcccacttgtcatccttgtcctggaaatattataaaaagctgcagtccgtgatttcattagaaaaatatataactatcttcttcaccctgggcacagtggctcatgcctgtagcctcagcacattggaaggccaaggcgggtggatcacttgaggccaggagtttgagagtagcctggtcaacatggcgaaaccctgtctctactaaaaatatgaaacttagccaggtgtggtggtgcatgcctataatcctactactcgggaggctgaggcaggagaattgtttgaacccaggaggcagaggctacagtgagcagagattgctccactgcactgtagcctgggcaacacagcgagactccgtctcacaaaaaataaacaaataaataattaaataaagtaaaaaataagaaataaattttaaaaactatctccttcattccttataaacctaatgtatatgcttatgttgccaagggtaaagtaaatactcagtaatctcttctattattatttccatttatatatgtagcaatctgaataatttaggtccttccagaacataccatgaaagtcaagagaaagcttacaaaatgtcttttatttgggggttgtgatataaacaggaggcagtaagatgtagaacacaagtttcaaagtcagatggtctggctttgaaccttgatctgtgattgatcaggaatgtcaccttaagcttgtttgtcaacctctctgagccttagttctctcctatgaaaatggagataacaacatctgtcaggttattgtgaagattacatgagattatctatgcagagtacctggtgcaatgccttgctccaccactgcagaggtattgacaacagtggtcacagttgtggcgtgatgaaattgctgggggcactgattgcttacagataacagtagtagccctttttagaggatggtcaggtttatttcccatcacaaactcaggaatgtcaaggttatagtcacaaattctttattttcagtctaccttcattgatttcaggtatgccatttttatactatcacagaacaaacaaaactgacacatattttgcaatttacaaagctgtaattatctacattagaaagttgtaacatgttcccaataaccccatgctgcaggtattatctgtggaggacccatatttctgctccattggagaagtgcagtatcttgaaaatattctattttgtaaagtatagggaagagatgacaaataggtaagaacacatttcctagccaaaaggacacagtggaagggcatgaaagcaggaaaaaagcaggggagtgtgaagtcagtaatttgacattagcgtttcccaagatgttataaggaacacaagccccacaggattctccctgataattctggaaatgctgcacatgaaatcccatgggacagtcccagtacacatcagcttcttatagtctctgaaaagtcctgcaggaaagaagcctgttttactttctttcacacctaactggccataagtagctcctactgttatctgtagaactgaaattcataggaacacagaagcatgctttgggaatccatggtttagagggttttgaggggttgtgatggagggagaggaggttgatgcacagccaagtatactgctaggggtttaaatgttaatcccctattggcatcagtgcatagtgagagtataaggaaaggaagcagaagtcaaacagaccaatggtactatctgttgctaactctaaaaaaggctttggctgggtgtggtggctcatgcctgtaatcccagaattttgggaggccaaggtgggcagatcgcttgagcccaggagttcaagaccagcctgggcaacatggcaaaacctcgtctctacaaaaaaaatatgaaacaaattagctgcgtgttgtggtttgagcctgtagtcccagctaatctggaggttgaggcaggaggattgattgagcccaggaagtcaaggccgcagtgagccatgatcgtgctgctgcactccagcctgggcaacagaacagaccctctctcaagaaataaagaaatcaaaaacaaaaattaaaaaggctttgattaggatgtaagactggatctatatgtgggcaatcttgacaggctaataatgccatgtcctccaagccagcaggcttgaaatctttgctcaatatgtatttagaacagaggccaagctctgtatgttgtgatggtcgtgagggctgcaggcctctgcatgttctattgaccactagtgtgtggtcagctggcctggctggctgagtgggtgtctcttcttcccccactattctttgtgggactcatcagagggaggaggacaaggtttctctcaaaatcatatgacgtgattcctgccaggctgttatggttgttatgctgatgtgaaaggacagattccaaattcctttgtaaactgtaagtgctatgtgaacatagagctgattattattcctgacccaaactgtgaggtgaaggattaaactgcgggtttggcttttcccacactatccctttctaattcaagcatgagctggcacgtagcaggtgttcaataaaagcatgaatgcaagaattgattgcatctgaatgattgtcttaatcctattactcaagaaaacattttttgttaacatatataaacaccagtgcaagattctctattgattgagtacttggtgaactacctctttggtccacttgccaatttctataatcttttgaatgtaagagacttgaaaacattttttgcatgccaacatattcagttttgactaacctgaatgctttctttaacagggtggaaaggaggaatcaccgtttgtaaatatcaataagaaatccagtcttcaggacgctagtgtaaggtctgttgctccttgtctgaatggggaaatgatattctctgtatcatcaacattatccttgaaacattgctcacgagggcattagctgataaaatcagaggacaaataaaacagagaataggagcccaaagagatggaaaaagactggcttaactaactttccgcaagcctcaaaaatgttgcttattctcagttttaatatctctgcctgctgcattaacaaagaaatcaatcacttggggttgtcactcaagcaagtgggcttcacattgccatccccctgcttaaagccctttaaaggctctgtttacactcagaatggaatcccaactccttaacagagtgcaggaggccaggcccttcaagacctggcctctgctcacaactccagcttggacttgggccagcttcccttggcccattgatgtgccctgcctgctgagcttcttgttagtgctggagccacatatgttccttttaaaaatgtatttatttaattattattttttaagacagagtcttcctctgttgcccaggctggagtgcagtggtgcgatctcggctcactgcaacatctgcctcccagattcaagcaattcttgtgcctcagcctcctgagtaactgggattacaggtgcacgccactgtgccagctaatttttgtaattgtagtagagacagggcttcactatgttggccaggctggtcttgaactcctgacttaagtgatccacccaccccggcctcccaaagtgctgagattacaggtgtgagccaccacacctagcctactttttctttgtataaatttatggggtacaagtgtaacttggatctgtgcatagattgcacggtagtgaagtcagggcttttagaatatccatcactcaaataatgtacattgtgcccattaagtaatttctcatcatccactctcctcccatcccctacacatgttctttaaagcttccaggccaccaccaccccaaacccagaggaagtccttcctcccctgatctcacagagaacaggaactctttccttcttggcatggtggtggtggcctcattgccacctggtggtttactaacaccagcagggtctccttagggtagtttcccaaaatgggtccaaggaccactgcatcagagtctcttcttaaaaacacaaactcctgggtcctactccagaccttttggatcctttgtgtgaatgtgtgtggtgggtgtttggtgggtgccagtagagacaagaatcatcatgttagcgggcacctaggtgatctagaaccactgctctggggaactattatactcgatgccaaaaatcaaagctaacatttctctgtatcaccttatgattcccaatctgtgtgcttggtataaatttgtcttactcctgagatacatacccagctgcctccagggcttttcaaaaacttaattcatctcttcccactccaccccactaaccttcacctggattccattcttagtcaatggtattattacctacccctcacccaggcctgaaacctgggagtccttgcttttctcctaccttattccctcatctaattggtcaccaagtcctggcaatttgactttcattttaccttccacatccatcctcttttcctcttgtctataccttgagccctcattgtcttccgggcctactgctgcccacagtcctctaagatgcttctgtcctccctttcacctggtcctcttcattgttctaaggacctttctgtaatgtaaatctgactatgccactcctttgcctaaaacctttagagagttgaggtccattgccttcagtgtagactcctcagcctgaggccccatatgacccggcctcgactttccctccagttaaaaccctctgctcttccactgagacctcaccggatggtagttctagtgccctgcgttcagccaggtctccactctgcctctcatctttgtggtcttcgctccatctggaaagaggaaactcctccacgtagctttccccgatgctgaccgttccacccaagcaaattcatgtgctccctcaatagactatacgttcttcagggaccatgttccctttactgtggagtcgcagcttgaggaaaccatgagtatagaatgcattgactcaaatcctctattttctcattcatgtgtttattcaacatactttttttttcttttttttttttttttgagacagggtctcactccagcacccaggctgcagtggagtagcataatcattgctcattgcagcctcgacctcctgggctcaggtgatcctcccacctcagcctcttgagtagctgggactacaaacatgcgccaccatacctggctaattttgtatttttttgtagaaacgggtattatcatgttgcccaggctggtctcaaactcctgacctcaagtcatctgcccacctcagcctcctaaagtgctgggattacaggcgtgagccactgcacccggcctcaacatgcatttgttaggccccggccacatacttatcaccatattgagcactgacccaaaagtgtcagttgacttgccaggtgtccctttcaaggacctcaacttgttttgatgccttgttggtcctaggaggtaatgaactgattttttaaaaatgaaattagtcatgaccactacaaaaatgcattaaaaattttccttaaaattactattttgagtagggtccattggttacctgaaataaattcttgagtaaagataaaagtgacgcttaatttttagcattttcacacatacatggaattaaaatgtgttacagcaagtcctaaaggtcttctgattatgcatttttcacacaaagtatagtatggttcttatctttttttaaaaaaaaaatatagtctgtgctatgtttaaaatagaatagctaccagattacttggaattaaaaacaggttatccataggtttctcttcattttactggcaaaacctggttatgagccaaaccctcattctggttcacccctcatattggggggcaggggtggctgttacggagcagagaaattttattttgtacctcaattatgtttagttgccccatttgctatattttcttccctatgatttttttcttactgtttggattttctatggttttaaaatataattataattatgaactaagtacggtagaaaggcaaaaaaaatggatttcttgactatcaatgttattaaggtgtacattaactgagaaagcagtccctatggctaaaacgagaccataaaccttttttgatggtattgttctgtttttcggtgtgtctctagaagtcctattcctattcgtgtggaaactgcccagccagctgtggaaaagccggaaatcaagcctccccgagtgaggaagttaacaagacagtatagtttgtgagttctgtactgcaactttttcaattaaaacaactatgatgactaattgtttagatacaaatgcttcttagcccttctgactagtcccagggagcagcccccaaattccatttatttccaatttaggtaataatgagactagccctttctccctgaaaaccttacatagttagcataaggattcattattgactactgtgtaataaattactcccaaacttagtgtcttagaacaatccacctttatcacctcacagttcctgtggagtgggggtcggggcatggcttagctgggtcttctgtatccggggctcttacaaggctgcattcaaggtgtcagggctgcggtctcatctgcaggcttgtttttacggttgctgacagggatcaggtcctcaaggactcttggacagaggatgccctcagcctgtagtcacataggtctctccagccttctccatcagagaaagcacataagaagagccagagagagtgacagcaaggcaaaggcacagtcttttgtaacctacgcacagaactgacatcccatcactttttttctttttgagacaaagtcttgctctgtcgctcaggctggagtgcagtggtgtgatcttggctcactgcaatccgcctcccaggttcaagcaattcccctgcctcagcctcccaagtagttgggattacaggtataagccaataagcctggctgatttttgtatttttggtagagacggggtttcaccatgttggccaggctggtctagaactcctgacctcaagtaatctgcctgcctcgacctcccaaagtgctgggactgcaggtgtgagccaccgcacctggcccccatcacttttgccatattctgttcatgagaagcaaatccctatgtccagcccacactcaaggggagagattacacaggggcatgaatactaggacggggatcattgcaacccacatcagaagctgctttccacggcatatccatgaaaaggcagccccgtctgtcaacagaaccaaagctaatcactgagctttgacacctgtaggaggagccatttcccaaaatgtcccagaatcaccagggcacatgtgcacctgactgttctaggcatcgttagggaatagtaaagtgactttgacaattcccatccaaagactcacactttactggagggaaagacaagagtcacaaataattataatccaaagcagaaagataattgctgtaatcagggtggtgagtactagtaatagttgtagtactgatcacaatggtatttccctttttttttttttttttgagacagagccttgctctgtcactctgtcactctgtcacccaggctggagtgcagtggcacaatcttagctcactgcaatctccacctcccggattcaagcaattctcctgtctcagcctcccaagtagttgggattacaggtgcccgccaccacacccagctaatttttttgtatttttagtagagacagggtttcaccatgttggccaggctggtttcgaactcctgacctcaagtgatccaccccaccttggcctcccaaagtgctaggattacaggcatgagccaccgtgcccggcttgtagttcccatttcttgaccttagctatggcatgggtactgtgcccagatgtgtcattggtcagagagtaactgcagggggatctctggacgaatgaaaaggatgggggctttggagttggaaaggcttctgtcaggcccctggctagtttacagctgtaagctcttggaaaagtgactgtttgatcctctcttccttcctctgtaaaatggatgagataatacctgcctctgaggagttttgtggggcttaacatgagagaatgtgggtaaagccccaataccctggccataggatgaggtcccctttctttcttctctaggacctggaagcttctgaggaaagatggagtttagggggtacccagagtgcaaaatgtaggacaggacacgggattctggatgcaattctctaacagccatctcaggtctgccatttgtacctgtgaaaaggaaaagaggcatgtatgggggatattaagggagatatatcccacctcatatccttcatagaaacttctggtcagctgcatttcctaggaaagccaaaacgagtaaagttcaaataattaacagtcctaatgatctctgggggacaattaagccatgacagtttgcttccctcgaggataagactggcagaacttgccattccttttacattttgaaactcaaaatgttactatcactcatttgagagatgtaatcatgtttgaaacaatgactggctgatatataacctggaaggaaaggaaatttcactaactcaccaaactcactcttttttttgtttttttttttttttgatacagagtctcactctgtcgcccaggctggagtgcagtggcacaatctcggctcactgcaaccttcgcctcctgggttcaagcgattctccggcctcagcctcccaagtagctgggactacaggcacatgacaccatgcccggctaatcaaactggctcttttaaggacactctttttcaaaccttgaactttacatgtgtatttcttaagctgccccaaagtattctgctttgaaaatcaaacaatagcagcattttccccattagtagaaaatagcaacatccatggatgagattttcccagtgttattgtcccataaagagttctcgaatccttgacgctggctaccgctcatttgcccatctttttattattattattattttatttttttgaggtggagtctcactctgtcacccaggctggagtgcaatggctcagtcttagctcactgcagcctccgccccctaggttcaagtgattctcctgcctcagcctgccgagtagctgggattacaggcgtgtgccaccacgcccagctaatttttgtgtttttagtagagacagggtttccccatgttggccaggttggtctcgaactcctgacctcaggtgatccgcccgcttcagcctcccaaagtgctgggattacaggcatgagccaccacacctggcctttgcccatctctttaactctttgatattgataaagttggcacgtgatcaaggaatataaatgggaaaactcagatctctgattttctggaaaatattttttacatcatcatttttgagatacagatttgtgtgcacacatcgcccttttggctgttgtaatatttctagttcctaggctggaataaggtgtagtcagattttaggttgctccaccaaaagcattgtaacattcaggtgctgtgaacaagtcttcaaaccactgcttttaaagatacagacaaaaatctcagccacattatttcctggaaatatgacaaggagggaaaatgtggctgctacatgcagtgagaatggagaagtagagggtctctacagagagtttaaggcaggcgaaaaggtcttttttttttttttttttttcggagacaaggcctcactctgttgcccaagctggagtgcagtggtcgatcacagcccactgcagcctcaggtgattcagctcaggtgatcctcccacctcagccttctgagaagctgagactacaggtgtgtgccaccacatctggctaatttttgtattttttgtagagacaagaccagaccatgttgcccaggctggtctcggactcctgtgctcaagcaatcgcctgccttggccccccagagtgccgggattacaggcattagcctctgtgcccagccaaaagtgtcattttttattgataccagctagtatgtttagaaaatcatgagctattttatttttttccagaaatataacttcactgtttatttaaacatagtgtaaaagtctaaaaaaaattcaatagtgctcactttggcatcacatatactaaaattggactcatacagagaagattagcatggtccccctgcgcaaggtggacatgcaaatttgtgaagcgtttcatattttaaatttttaattaaataataaaatatttataagttaattaaaatatttaaagaaaagaaaaaaaagtaaataggcaagacagaagagaaaagtagccaatttcccagaatcaaaaataaccagggttcatagttgacgactgttacattagacaagtttctatgcttatatattgttaaaatagaaacaacttcaaagcaaaaaatcattctgtatgtaaaattttacttatgaaactgttgttttatgactttatcatgaatttaccttagaaacaggtaaaattggaagacttgctgaattttagatatgcttcttggccataagatctaaactaagacaaaagataaaaaccatgatgaatttggagtctttttcaattttaggcagtgtcagttgactcccttctgtgaaaaatgagctatggtttttaaatggccttttatataaaactaaataataataactatgctattgaggtgataattttttaaatgaggtaaaaagaaattttaaccccgctcctccacttaactagctttgcgaacttgaacaaataatttcacaatcagctgctaaatatcatctgattctctgaaaaatggagatggtaatagggtcggtgtgaaaattaagtgggtgaatgaacgtgtaacccatctgacctatgtcatctatgtggatccaaatacttggtgtattattaatttttccatgtacttattcaattctcacctttccccctttttagtaatgagccctaagtccttcccttgaggcttctccatacacagaataatctaaaacctctcagggacccctcagtcaatcccatccgcactgcagctttgtctcacggcctcatgttcccacgtggccccgtgctgggctgaggccttaccagtgatctgcacaggctgcactggtgcctacctgtcatgggtcttgtatctacactcttgagctcagccatcattctaaatcacaacccctatgcaagggtggctccagaagctctacatggcagatccttagggacaatgtgcctggagtccccagcaccacccttaaagcagagagtcagacagatgtttgtacacccatgttcatggcagcatgatttataatagccaaaagagtgggaacaagccaagtgtccatcaacagatgaatggataaacagaatgtggtatatccatataatggaatttttatattataaaaataaatgaaattttgatgtatgctacaatgtggatggaccttaaaaatattatggtgactaaaataagccagacacagaggaacatagagtgtgtgattccacttatgtgacgttcctagaataggcaaattcattgggacagaaagtggaattgatgttaccagaggctgcagggaggggcttggggagttatcgttcaatatcaatacagagtttctgttgtcactgatgaaaaagttttggggacagatagtggcaatggttgcacaatattgtgaatgcatttaatgccactgaattgtatatttataagcagttaaaatgataaatattatattgtatatattttaccaacaaaacaaaacaacaccctggcaaatgacagaaaattcaccccaatttgttttggcaaaaaagtcagagtattggatcctgcaagctggacatctggtggacatctgtttgggaacccccaatccccatccctggtcttcccacccctgcccatcctccgtccactcctcacagcctgtttattattgtaatgagcagagcttcatgtgcttttagtaaccgcagtgatgaagacgacctccctccagacctggccgaggcagtgggagtgaccacatctacaaccacaaacaccacaacggccgccacacaagtctccgtgccgctgccgtcccccaaggtccagaatgtcagctcgcctcacaagtcagaaggcaaaggcctgctgtcccctggggccaaggtattggggggtggaaagccctggcgagcagccacacttgctgggaattcagtatcaatttactgagtagcatctggtgcatgtatttaaattttgcataatcaattgtgtatactcataaaacaacagcaacaaccagaacatgtttttatataacttgaccccaaaatacaagccaaccatttgtgagacaatgagtgaaatataaaatcaggttcattgtactttaattgcaatgtaagagatttttgagggcagttttcatttagaatctcatctctataataagctattagtccactgtaaagatagaaagagagaaatgattcccccccaaccatagtgaacagtttggaggagcaaaaacatagaagtgtccccatcccttcccttatgtcatatagccggtgttagtagtttgaaaataggaaatattattccatttgctggtttgaaatttcaggaaattgcctgagatgtgaatgggctatgacaaaggctttacacaagatgtttctcttggttttctttgagagacctctagctacgattactctttggcaattggtccaaatacaattgaacctattgctgtccaagtggattcaagtcagaggttgcagtggttcatgtgactacacagagaaaaggtgcgtgcaggaggcaggtgccctgaaggcaagaccggagcttcagaggctgttcccagctcttccattcataagccacagcactcacttccaaaacctttatttcttcgagcctcaatttcttcctcttaaaaatgggaataagatctgctatcttgccctggctggcgtcaggttcagtggaggttaaagtgctcatgcaaactggatgcctgaggcttttgcagcttcagggatcacaattcctggtgacagctgaagaataatggtccagggccacctcctgcattaccaaggccagtctttcacctggtgccttccctgggtgtctctggaaatatctctgcttagtgttctgcacagaaacctgcctggagtgctcagccagcgactggccaagatcgaggttctctgcttctctatagatcacctccacctattggcatctcagcctggattatcctccactgtgtggagccccctgtacaactttgtctcaggtgtggacccaggctcctatcacatatcccacactgtggttaaaaccaggctgaacgaaacatttacgaaacagaagggggttggggtggcgtggaggggatgcaagtggcatcccaccaaaggccacagggctccctctcctggccatctctctccttggggccttgcttgaaccacgttgatgggacttcttttttctcccttaaaagacctcgaggccatccatgcagctaagaccccagagcaggagggcaaaacattttccaaaagcaagcaacataatccacatgccatcacctgccatgaagatcattgctcttagtgtgcagatcagtttagctcctggaggaccctggatttgatcctcttaatctaggacaaggtctttgctctctctttatacattcagaggactctttcaagtgttttttccccaaaagaccagtagaaaagcactaagagcacttaagaaaagcggcccgcagctctgaaagggacagctctctgcaccatgcctacttctacctatgaaaaaattggggttcaagtctcaacattttgtacactacttggtgagggaaatacaaggggattgtcattgctaatgagatcagtgtagaggagaggctgggaacctctgcctgtcttttctggtgaactttatcatcaatgcagtgccgtctctaaccaggggtgtttgtctgtctccctagagcccctctgaccgaggaggtgcctttaccctggagccgggtgatcttctgatggatttcacagaagccactcctctggtaaacttcctattttgctaaaaccagaaaagtcacagaccatagaaacatcttggcagtgggacggatggacagaggtgggcattgctgttgaggagcctcttcctcttgtcctggaggctcagggatcagctttcatccaggggtcaggcactgtgggtccctccacctctagagcccttgagggaggaaggggtgctcctttgctccgagggtagttgtgggggtcctgcccatgcctgtctactgcacttcgagtgttatagggctcctcggtgttttgttctcggcttcttggcttcctggactgcgccctgcatgcccacccgtggggaatctcttgctgttgcttccgacgatccatctggtctgaagcactggctcaaggccacaccccagctttccaggcccctcgcacctcctgccatcttccatcctctgcatacaggtctccccttagggatggcagcccttgtgggactcctgcaggtgagaaacccttttcagggaacaagtaaagggcctggtgggtctgagaattagggtcaatttccaaaaaaaaaacatggtggctttgacaagagtgatgagattcccttagagatcattgtgttgcaggtccagcttgtagatttaattacttatagatttaaatggtcttttctttgtttgaactgaacaggctgagatgagaaaggaagcagcatctggtagggaattggagatgccgtgatctgaggggcaatgcctgccaaatgactgtccagcctctgcttgcaccccttcagtaataggaagctcattctctctccccaagacacgctgctcacatctcagggtatctccaactaagctatgaaatgggtatgggcctgtttcactgctcaggcatgggacaactgaggtccttgcactgcactgagacacagccaccacttcacagctgaagtttgcagtgaatgtgtgtcctcaggataaagcatcctttgaggcatgagtgcatgtatgcaggcctcagggagaaggtatcctgggcatctagctttttggcaagagcttcctccattttgggctttccttggtaccatgggccttgacctcactttgttccagaatcctatttccatgagcgccaaagggtcctagaagggaagaggggactccagccatctgcttctccctttggtcctcctccctccatctgcttcccccagcatcagaaatgcaagcagcagccctcctacctgttggtagggtgatggacaggtctctatctcaggggaccaggcctgcctccgcaagtcagtgtcctggatgctgctgatgagggctgcagaggggcttccttatccatgggaggaaggagccagaagtagagggaggcaagggtgacccccgtgcctgacttgtgaccagggcttcctcaactaactggccccagcctatcaggtggaacaatgccttgggaccatctcatccagtccttcacatatagatgggaaaaccaaggcccagacaggggcagacacttgtcccaagtcacatagcaagtgtgtatcaaagccagttctagaacctagactctgggctgccattccagtggcagatggcccaatccaggatgtgtctgtgtctttccctgttagccagtaccctccctcaaagcgggtcagatgccctggtctcagtctgggctgtgggacagccctgggaccatctccaagctgtcagcccaggtttggtcctcagagttgctgagtggagcatgaggaagggaagtgctcaggtaccttggtctaggagactcagcctggatgagctatggttattttgccaccagccctgtgccctttgcctgtggctgctctctctgggccttcccatcagcatttcctgctgaagaggaagcagccctttacgggcatgaatgtcagaacttcccatgtgctactcatcacacaggcagtgaattacccctccttggtgaatactttttccatgtagtcatttcccaagcttacagcctatctctagccccctgcctcctactggatgagactcctgaggccccaccactatcctggtccctaggcccagtgctggaccaacagggaactggagatcttgccttcattcagcaacgttccaccaagacactatcagaaccagcgtaacctagccgagcgtggtagtatgtgcctgtaatcccagctacacagaaggctaaggcaagagaatcatttgaacccaggaggcggaggttgcagtgagccagggtcacgccactgcattccagcctgggcaacaaagcgagagtccatctcaaaagaaaagaaaagaaaagaaaaagctgggcatggtggtattattcctgtaatcccagcactctggaaggccaaggcgggtggatcacctgaggtcaggagttcaagaccagcctggccaacatggtgaaaccccatctctgctaataatacaaaaattagctgggcatggtggcacacatctgtagtcccagctacttgggaggctgaggcaggagaatcgcttgacccccagaggcagaggttgcagtgagccgagatcgcgccattgcattccagcctgggcaacaagagtgaaactccgtctccaaaaaaaataaataaataaaaagaaaaagaactagcataagcctttcacttttatcactcttgatacttgtggccggtctctgtgtagagtggttttcaaagaagcacagtccaaagagcccagattaataaaaagtttcaatctggaacaggcatctctcaaaaaatcattaaagaatattacattaacacctcctgtaacacatcttgatctctttttgccttttcttttattctcttacattcctgcttgactccagggactttcattcccaaactctccacaaagaaacactctttccaacttcgcttttgtaggtttcttccccctccttttcccaaaccttttcctctctaatccccaactcttttattaggtagctcaatttagcaatcttaagctttagaacttttgcagcttcacgtctttccatttccgattctgtatcagagttcgtaatcagatctgaatttctgcctgggttgcaagaggtggaatacgtgggtgagaagggaaggaggcaagtgagtcaagacagcacctgctctccagttggtattttctttaggatgtgaatgtgagcaggtgcttgggggcattggcgttgactgagcgaggggagttgggggagggtacattgatgcattagtgatgttcaccctagaatgcggagtcctgcacgctactccaagtctaccgtgctagcttccctccccaggtaacacagaccatgaatacctgtgctttctgtgttctttacgctttctctttggggctcgtccctctctgatccccatgcttcatgaaccacttacccaactgcaaagcagagccaattaacacccagatcccttctgggccatgacatgttagtcaaaagttcatgtgtctggaaggacagggccctggccagaggaaggctgtgtagggcattggaacaggccctgggttaggtgttagaagggagtttccatctggtgcaataacttacttttattttgaacttaattataccagcagggctgaagctgaatctcaaattaaattagggtaccccttctgtgattttggctgtgttccctagggcacagggaggtggagagaaatctatttagtccatgatgtcatctgttcactgatacatctaggcctctctttggttctttcgtggctgttttgggtgggtggagatcactctcctgccaggatgtgtgactctctacctgttggacaacattctgtttggaggccaccctgtcctggggcctgccatctcctcagctctacctgagggggttggcagggctggttcttgctgctcttcagtccctgcttcccagcctcagtgtctggagaaagttgcacagggcccctttgctcggtactcactaaagtctactcctcctccctttccctctgacttttctctccaatggtcaaactagccatctcttttcctatctggatgatgaagaagccttacacattttcatcatcatgtatctatgcagagaatctttctgtttccccgagagtcagattttgaactcaaaagccaagcatgtacagatgaatgtagctgcttgcctgcagaaaagacccaaggaagaaaggaaatactaggagaaaaaaattaagtggtattccaaaatagcctttgattccatgtgttatcttatttccttctcacgtaacaacagtctggagcgtgggagccccaggatgttcttttgtttcaatccaatcagatgtatattgagaaaggtcagaaaggcttgtgcggtggatcaacacttctttaccacgaaagtcaaatgctggaccatcccttaaggcgctcattatgttcttcagttggtggccaggacacattttggcttctaggcagtgtggccatgtttcttggtcatttgtgccagcttttattttcttcaaaaaatacccattgcgtgcctgctatcatcagagaagaaaagacccagtggcctgggtcccctgttgtagttgtttctggttggagtatggatgccctggggcagtagtgggaactgttcctgagggtagcagggagacatatttctgcaggatataccctgaggtccatagagagcagcaggagggttttaagtagtctggtaaaagttaactgcaggtgactcagatggattcacttgactaaaaactagatttagaaacagtcaacaaaatgaaccatggactaagactttgcaaatgcaatttctacatctcccaaatttgaatagtaaaacaggccatcgtgaagaccattgtgagataatagttgtaaaaagccctttggaaattgtccaggactgcacaattgtaaagaggacagagatagatcactttggagacggaaaagaggctggcaattttcttgatcatttttctatgaaacttacccaggggctgtgttttattcttcacagcaggatgatatcaactatttaaggaaactctcttgagataaaagacgtgtatatttgttctctggagcaaatggtccctccctgaaacccaaaataaccctgtccgtggttccctctcctaacatcaagcatcctctgtcctccaacctcatcctcaccagtacaagctgttggacctctgctgggcgcatggtgctattcaaggataaggtggagaaccctgcgtatcccaaaggatgtggcacttttttcacaatgtttggtattttccagctaagtagcagggtgtcccagtgtcaaacgagatgccacggctgggcccatgcatctcgtcatgggtcagggtcagtttgttttctgaacacagataacaaagagccaagacatatgaaatcctcaactatatgttacagctgggcacaatggatcatgcctgtaatcccagtactttgggaggccgaggaggtggggaatctcttgaggctgggagttcaagaccagcctgggcaacatagtgggacctcgcctctataaaaaagaaaaattaaaatattagccaggcatggtggcacatatctgtagtcccagctactcaggaggctgaggcaggaggattgcttgagcccaggattttaaggctgccatgagctgtgatcacacgactgcactccagcctgggtgacagagcaagaccctgtctcttaaaaaatatggcatggtagctcacacttgtaatcccaacactttgggaggccgaggcgggtggatcacttgaggtcaggagtttgagaccagcctggccaacatggtgaaaccctgtctccattaaaattacaaaattagctgggcatggtggtgcatacctgtagtcccagctactttgggggctgaggcaggagaatcacttgaacctgagaggcaaaggttgcagtgagctgagatcatgacactgcactccaacctgggtgacagagcgagtctcaaaaaaaaaaaagggaaatgaaacgatatgtttctccccatgatatatttctttcctggtgccctctgttgatatccactcactgacataccacagtgtgtgcccttgttcagcagagtgcaggagggcactgagcatggaaggcaaatgcttcaagtgtgtggccactcctcacttcctccatggctcacatcactaagtcatcctggctatctttctggcttggcctgggcaatgcttcagaaccctcaaccgcgtgccaagaagccactacctgtcctgtgcagttggcacaggagatagcctctacctaccaggcctgggaatggggtcttggtatgtcatctgctcagatgatggagacaacagatgaaagacagaaaggagaaaagaaggctgagagagagggtggggggtgggaccagaagccagttggccagagcctggaagtaggctgtgggtgaggctggcttgagaacagtctggagttgccagatctgtcttgcactgtgctgtctttctctcctttcccttcccctacctcctcttcctcctccccttctcttgccacctcctcctccccttctctcctctcctcgtgagcaggcagagcccgccagcaacccccactgtgcccactctcgctgttctcctccactctctctccccatgaaggaagagaccactggagtttgcatgtaccctccaatcaaaacgaggctggtaggtaccctggcagggagaggggcctggccaggagaggtgaggtgggcaggagccaccaggcgaggtggaagcctgggtgggcgtgcagaagccccagatctcgggcagagcccatcgacaggtgccctcactccagatggatggaggatttggagtccagctggccctggtcagtttggaacatgcagctatggagcccacttcgcctctaggtctcaagaatcaagaagagtttgttttcctagaattttgatgagcatagatgctttccccagagagaaatatatgctttggtactcaccagacggactcttatgttgcatttctattgaaaataaaacttctttaaacttgtcttcttctgctatttatcaagctaatgatgtaataggagtgctacctgacaatgtgaacaaaattacctgtcatcccaatttagcatgattttttgtcatttttacatatttccttctatttattcatatcattcataattttacatagttaaatcatagtaaccatattctctcctgttttcctcttttcacttaatgctgctatgttgtttctagcttgttcttgttaccacattatatgactatttgtatttcatcaagtgaatggtctaccatttatctaacacattctttactacaggatgtgcgctttgttcgcagtttgtcattatttgggagaacacatatagctttttgcatcaggaattttattttcttaggctataccctgctggattaaacatggtgactttggcttttgccccctttctaaagtggttgtgctaacagatagtgccatcagaagagagtgactttgcttttctccacagccttagcaacacagagtgtaattgttgaaatctatttttctaatttacagcaggtataaaataattctttgagattgctaactttcacctttctttcatagcaataataaaccactttctggcagggcacagtggctcacgcctgtaatcccagcactttgggaggctgaggcaggcagatcacctgaggtcaggagtttgagtccagcctggccaacatgtaaaaccccaactctattaaaaatacaaaagttagctgggcatcgtggcacgtgcctgtaatcccagctactcagaaggctgaggcaagagaatcatttgaacctggggggcggaggttgcagtgagctgagattgcgccactgcactccagcctgggtgacagagtgagactccgtctcaaaaaataaataaataaaccactttccctttctgcttcatgatgatctgagagtcttatctgtctgttactttctgctaggatattggtctcagagcaccatgctgactcaataggcaacaagaggagaatgtaccccaagacttcaccccaagggtccttctctcacctgagtcaaaaaggcaatttcaggcctattctggcaattttgagatgtgtaaagagaccaaagaaatttgggggaaggggagcaggcttgggctggacatctcagtacacgtggcaaggatattgtcatccccacatgggggagacttgctttacccatttgggaaagcttggctgatttgggtctgagctaatgtgttcttactcatccctgcctcaccctcccattggagccactgaagagcattgagtagctatcccagtgtccacaggcaagacctcgagacacacaaagcctgctgcccctgggcagtggtggccttggtgtcttgcctgcagccctctgctggcgggtggtatggtatgcattcaccagcaggtgtgcagacagtttctgtcccccaggaatgtgcacaaagctggtgtcagagtcatctggttcctgggcctgatgacgtaccctaggccagcttgaaaaaataagcccttccatttcccaagttctccaggaggccaaagacaaaatgaccaaagagaaagacatggaagtcaagagtctttttcaccaccactacctgatcagctgttcgtctggcctttttcagactagctcagtactacaggtactcccagcactgggcatctttgtgcatcaagccatctgttcccaaaggccgtgggggcaggattctcccatgcttccacgggtttccctgaggtctccctctactggccaaagcgtacagggagtccagtaactgaagtgattagacagggaatactttctagcttaattagcccagccgccttgtaccctgcctgctgtaagagaccgtgtcccaggatgtgacctctcagcagcctctaggccattcccacagctatggagaagtcatcagaagccacctcaggcaactctgactccctcattatccaccttgattgtggctttttatgagtcaggcctggaaagccaagcagatcccgctgaaggcagctccagggggaggcaagtgtgggggcgctctaggaacacgagactccaggctgtcatccctgctgaggcccgtcctgcagtccaactccaggcacagatacaaccaccagctcacactcctgagggaccctttgtatgtgcccttacacgagtgatgaaggctctgcgggggcacccctgaatcctttggttccattttaaaggtgcgctgccaaagattgcaaaactttgttttctaatctgaaggtaacccccttgtctttctctcttttgaagataaaaacattcccggttgatacaatgaacccgtttcctgatactttcaccacagggccacagtttactgtaagtagatccagaaaacagatgtgcattttaaacccttgttcccatgcggtgtgcttttctgcgggatgccagacagcaaggtcaaccgcttcttttgatcaccgttgaactctgtgaggttgggaagaaacttggatttgcagtctgcctctattttattgatgtgacattgacataaaattaaccattttaaagtgacaattcagtgacagtacattcacagtgttgtgcagtgaccacttctatcagttccaatacatttttattgcgtcctccaaaaacctcacacccattaagcagttcctcctcattttccctttgttcctacctgctggcaaccaccagtctgcattctgtgtctgtggatttacctagtctggatatctcatataaatcaattgtatcatatgtgaccttttgtgactggcctctttcacttagcataatgtatttgaggttcatccacgcatgtatcaatacttcatttctttttttgtttgtttgtttgtttttgagacggattgagatctgttctactgccaaggctggagtgcagtggcacgatctcggctcacttcaacctccacctcccaggttcaagtgtttctcctgcgtcggcctcctgagtagctaggattacagctgcttgccaccacgcctggctaatttttgtatttttagtagaggtggggtttcattacgttcgccaggctggtctccaactcctgacctcaggtgatccacctgcctcagcctcccaaagtgttgggattacaggcgtgagccaccatgcccagcctcatttctttttatgatggaatattattccattgtatctatatactgcaatttgtttatccactcatttattgggggttttgggattgttttcaccttttggctattgtgaatagtgctgctatgcatatgtgtgtacatgtatctgtttgaacacctgttttcaattcttttgggttggatcttgataatggtgtggtcttaggtaggtcactttactaccctgaccaccagcagctttttcttttttgcttttagagatgaggtctcactatgttgcctaggctggtctcgaactcctgggctcaagtgatcctcataccttggcctcccaatgtgctgagattacaggcatgagccaccatgcctgccccctcttcttacttaaggtgaaagtagtagtaagaatatcctcctcatatcctgttggggcaaggatcaaaagggaccaagaatttgaaagtgttttaccaaccacaaaacatcccacacctgtcagttatgattgttgtttctcaaggctggagaggcagggtgctgtgatgaacaagaaccagtcaccctgacaacagacttcttgtcaccacctctctgggtgtcactgggcagcttatttattctgccaaggctaggcacagtggctcatgcctgtaatcccagcactttaggaggctgaggtgggaggatcgcttgagaccagaagttcgagatcaacctgggcaacatagagagaccctgtccctacaaaataataataataataaattagctgcctgtagtcccagttacccaggaggctgaggcgggaggatctctggagcccaggaggctgacgctgcagtgatctatgactgcaccactggattccagcctgggcaacagagtgagaccctgtcttgattttttaaaaaattctgccaaatgtttaaatcctgtagtttcctcatctacaaagagagagtttgataatgttcatgcttcttttcagggctcaactcattctttaaatgaaagcttctgcagaagctcactgtataatgagcaattagatggagcagaagtgaggaatctggggtccacacctccttcctctcactctgtcctcctcccgggaaccagagcttgcaatttctatgatccctgaagctccttccgaagggtttttgtgccatctggaggatctgtgaggtgggctgtgggtggctaaaggtagctctaagtgcagtcttacgagatggatgatggccactacccaacatggcttcagccacacagggagggagagagcagtggctgattcaagtttcagaggatgagcagaggtgggaaggtgtccagcagggcaggcggagggaaaaacaggttcctagaacagtccatttctagggtcatgagctgcttccagcatctgccttttaagaatgagagggcagagacatggggctctgccagaatgttagatgctctttccctgacactcgtcctggctccctgcagtcttgctggacacagctccccagctggaagctccggctccacctcccttggttggccatagtggggcactctggccttctgcccagccttggcagtgctgtgagacactcagggaagcccttcccgaaagctgggggccaagatggagcaggaagccaatggcagaaaccatgctgggacttttaagaactgagcaagagtggctcgaagacagctggagcagcagagggaacagcatgagccagacccccagggcgggcggggtcatcacacattcaagggactgaaaaacaggccagtgggactgggatgcggaaagcaagcagggctgggtgagagaggaggaaggggatgtaggtggtgataaaactggaggggcacaaccatgttggccttgtaggccacagtagggattctgatctccatcctacgagcaacaggaaatctttgagggactttgagcagggcagtgacagggcagatgcacttggaagggatccctgtgatcacagtgggaggacagtggcatccaggcagagtggattcaggacagtagcctggaaacgcaggacagtggcttaagggagagagagcagaaagcttgacccacagtggttttgctggtggaggtggacagaagtgcacagatagggaagatatttaggaggctggtaagattcaggattagatgaggcagagagagggtcagaaatggttcccatatttctgatttgcagaatgtggatggacagtgggtccattcactgagataaagaaacttggaaaaagacttggttgggagagatgagtttgcctttggccatgatggattagaaatgcctttgaaacatccaggtggacacaatgaatgggcagttggaaatccaagtctgtaactcaagagagtggactagactggaaacaatgactagggaggcagtgacaggtagatggtaacagaagccaagctcatgggcttcagcttctcaattttctcacccctgtgtgtagtgttctcatctccttcctgccaagatcatgacacttgaactttctgcaggtttggcctctccacaggcctccagacctatcctggcgacagtgacaggggttgtttagcagcgctgggaagctctgcacaaagttggtctggcagtcgatctagcattgatggagctgggtttcaacagctgggctcttgcttgatcccaaaaccagtttctactttgtattcaggtgtattaactgggtctctgctcatactcagccgagtatgttggtccatctagggtggggagccctgcctggctctggccagatttctgctctacatgcttctttctaatctggctctgtccttctgttacctgctttgttccagtggaagcttgttcattcattcactcattcatttcctcattcaacaaatattaaaaaacagatacttagggttgagatttaataatgtaatttttactgcttcttcaaggtcattctttagtgaaactggctttttttttttttttttacttgaagtatatggcaatcaagaacacaatgactactagtacagtttggtgccactacctcaattcatgccaaggccctgccccatttacttactatcacctttgcaccatcagtgcaaattttcctcttttttcagaaagaataaaaaatggcatcaaaggctgggtgcagtagctcatgcctgtaatcccagcactttgggaagccaaggtaggtggattacctgagatcaggagttcgagaccagcctggccaacatggtgaaaccccatctctactaaaaaaaaccccagttatggtgtcagctagcccttgttctgaatactgttcttaacacttacacttactaatacaaaaattagctgagtgcggtggcaggcacctgtaaccccagctactcaggaggctgaggcaggagaatcacttgaacctgggaggcagaggttgcagtgagctaagattgtggcctccagcctgggcaacagagcaaaactccaactcaaaaaaaaaaaaaagaagatactgctcatttgatgatcagagtgtcttctttagaaactcatgtaataagtttctccaaggtcagggccaagaactagcatgaaaaatctagttataaaatatatagctggtattatcaaaaatataaaacaaacaaaaactatgcattgaaaaaatactaaatggccaagcatggtggctcacacctataatcccagcactttgggaggctaaagtgggaggatcacttgaaaccaggagtttgagaccagcctgggcaacatagtgagactgtttccacgaaagattaaaaaaattatccaggcatggcacgcacctgtagtgacagctacttgagaatcttaggcagaaggatcacctgagcccaggaggttgaggctgcagcgagctctcattgtgccaactgcactccagcctgggcaacagagtgagactctgtcgaaagaaagaaagagagagagaaagagaggaagagagagagaacctgtgaggaaatatactgatggcaacagtaaggaattatggaatttcttcattgatctacttttttttttttttgagacagagtctcgctctgtgcccaggctggagtgcagtggcgcaacctcggctcattgcaaactccgcccccaggttcaagcgattctcctgcctcagcctcctgagtagctgggattacaggcgtgcgccagcgtgcccggctgattttttgtatttttagtagagatggggttttgccatgttggccaggctggtcttgagctcctgacctcaggtgatccacccacctcgacctcccaaagtgttgggattacaggtgtgagccaccgtgcccggcctgatctacttttatatatcttctaagctttctatatacaagtaaacagaatagtttgctatataatgaaaatgacaagaatatattatcctctccaaatgagacagtatactctagaccagtagttctgaagctttattgtaattcctccagaagaatcacctggaggtcttgttgaaacacgtattgttggacttcatccccaggcattcttgggtcccagtggtcttgggtgaggcctgagaatttgcatttttaccaagttttaagataatgctgatgctgctagtctggggcccatactttgggaaccactgctacagtaatgaaaaaccccagttatggtgtcagctagccctggttctcagtactgttcttaacacttactaactgtgtgaccttgggcagattacttaacctctctgagcctcactttcccccataaaatcagttttaaaatatacatttgttttcaccttttaacatttcccgatatcagaatgtttactactgggcatgacaaagtttgatagtgggcatgacaaagtttaaatggctacatgtttctttctgattggcaaatgcaaaaatggtgcatcttacaactgatggtgcctaagatgtgaggaaatataatcgctaccttaaagggttgtcaagagttaatatgtgtcaagtacttagcatggtgtctggcacaaagtaaaatcacttaaaatgacaatcgattttagctggtagtgaaaaggaacaggaactgtagagtaaggcttagggagcaactgacagtgtgaaaatggaacccaaattgagattgatctcctctttcctgtttcttctccaggcagacttcagagacagtaaattacagtgctgtcctggcccgacttccccgctgatcccagcagcgaccctgaggcctttgacagagaccgtctccacagtgcagaccatttacaccacccggaaacctgtttctctggcagccaggtaggtcaggtcagcaggttccgacaggtaattctggtgacagggaaaccagggagactctaggttcattgtgtttgtgacacgtacaggcctttcctacattctttcatttattctgtaagtatttattgaaatgtctataaaggggccaggtgcggtggctctcatctgtaatcccagcacaagggaggatcccttgaagtcaggagttcaagaccagcctggctaacatggtgaaaccccatctctactaaaattagccaggcgtggtggtgcacacctgtaattccagctacttgggaggctgaggcaggagaatcacttgaacccagtaggtggaggtttcagtgagctgagattgcaccactgcactccagcctgggcaacagagtgagactttgcctcaaaaaaaaaaaaatgtttacaagggtaggctgttagaggagatagacaacaaatgagtgtgtgtgtgtgtgtgtgtgtgtgtgtgtgtgtgtgtgcgtgtgtgtgatattgacaagggatagggaggaaaatgaaattgtgaatggcaataaggtatcctgggatggcctcaatgaggtggcatttaagcagagccctgaaaagggctatagagaaagctgcagatacctgggaggagtactgcgcagagcaaccagccagtgctaaggctcctgaggaagcatgtgcctgacatggttacggaagtttaaggggccagcgtggccagagcagagtgaatgacaatagaggaggcctgtgaagttgtgggttaaggccagactgcgtagggccttgttggctacagtagaaactttgttttctaccctgaatgaaattattaaacttggttagtgcctttaaagatgtgtattttgccaggcatggtggctcgtgcctgtcatcccagctactcaggaggcagaggtgggaggatcagttgaggccaggagttcaggagttcaagtccagcctgggcaacatagcaaggccccatctctaactaaaaacaatgaaaagatgtgtatttactctgtgtgtgtgtgtgtgtgtgtgtgtgtgtgtgtgtgtgtgtgtgtttaaacagtggagacaggttacatagatatgcaactggacctgaggtccaaaaagtcagaggcaacttctcaaaacagccaattttacttcattcaatttgattcattaaaatataattaattatttgttacaacattccctcagatattcatcaaatgaaagcctgggagaaaatgcacatgaaaccaatttaaagcatgatttaaataaatctaacccctggacatcttcattcaaaagtctttactgagggccgggcttggtggctcatgcctgtaatcctagcactttgggaggtcgaggcaagtggattgcctgagctcaggagttcgagaccagcctgggcaacacggtgaaaccccgtctctactaaaatacaaaaaattagcttggcatggtggcacgtgcctgtaatcccagctatgctggaggctgagacagaagaatcgcttgaacctgggaggtggaggttgcagtgagccaagatcacgccactgtactccagcctgggtgacagagtgagactccatctcaaaaaaaaaaaaaaaaaaaaaacactttactgagtggctgccatgcaccagatactgcgcaaggctctggaggtttagagatgaatgacatatagtcagccaggaactctcagcatggtgggactgagaaaccagtaagtagccaatttcagatcactgaaatgctagcaaatgtagatagtcctcaaggagtctaaaaaagaaagtccaacactgagatcaggaaagaacctgggagatgatacttaagctgtctgcttctgcaatttttgagggattgtctcactattttgtcacatacttttttttagtgcagagacactccggcaggaactggagagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctctgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaagattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctactctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttc

SEQ ID NO: 38591 - DNA, 28860 bp, Homo sapiens
gctgagctgcaggcgcggcgaaacttccctctacccgcccggcccgcggcgcgcaccgttggcgctggacgcttcctccttggaagcgcctctccctcaggtgggtcacttttcgccacaaggctcccgtcccttatctgcttcagctcacctccagtccctgctgctaggaccccactccccagcccatcgcactgaagaacaggtgcttgcaaactccccgccgcgccccggcatcactttagaggaaagtcacctgaggctgctccgcgattcagcaagcttctaacttcctggagtttaaggctcatccctaccccagggtgcagacaagcccaaagggggaaaattaaggggttagattcttctctgcatcttacttctggattggcgcactcttggggcgcccatcaaaaagtaggctggaagaatgtggctttagcagtcagtctccaaggtctcagatccgaggctgcttcttgaccaggcactaaaaatttgtcctgatacctgcaaccacttccatttttttatcttgatttaaatttcctcttgcaatttaaaggttatttttctggaggaagattgttcagaatataatttattgtgaagagtaaataaagcctcagttccgtttgtttgtccagagacagaattttattattctttttcccacctctagatggtaatttaggaactttctttaaaagattggtgtactgaggctgggtacggtggctcaagcctgttatcccaacactttgggaggccaaggccgatggatcacttgaggtcaggagttcgagaccagcctggccaacatagtgcaacccagtctctactaaaaatacaaaaattagccaggcgtggtggcaggtgcctgtaatcccagctacacaggaggctgagacaggaaaatcacttgaacctgggaggtggaggttgcagtgagctgagaaagtgaattggatagagaatgggggaggggaggaagaatactattcctagttctataataactagaacctcattatctcagcctcagtttccacagatgtaaaataaaaggctggctactgggccagatgatccagaaagttcaactctaacaaggtgaaaagccgtgactaaagatgcctgcaagtttgaaatacatagaaaatctccttaatgctacaactataattcagtggttacttttttcataataatgcatgttccatttttataaggaaactctccagttgtcgggggaagagtctcttcccacaggagcatcttaaagttctgccacatttatcattcagagaatactctcagctttcaaaaccattcttcagccttgctatgtgagaatgtcctattccctacaaatggcagtcatataaatgtcactcacatgagagaacattttttttttctgatacagtaggtataattttgtaaaatggcacatttatttgaagcagtaacttttctgagatatggccttttgcaaggtcccaagtttttcagaatgctgtgatttagcacaatatgagatttgacctgcatgtattctacctgcatggcaaacactgccaacccagaaaacaggatgagacacttcctatttatcaggctccaaggctgtaaagtaaatggtacatgtgtacagagaaattgggtcatagcagtttttctatttggtaacgtttacagttccactgaggttcacgttgttcacattgttgaagttcacattgttcagaaaccaggtgtacaaggcctggcccctagctgaagaacaatttccagacttctgccttactaaagctcgctaactgttgtttagaaggaactaaacagactttttaagattgttaataaattaaaaaccccaggccttgcactatgtgtgaacaattttaagaaaaataaggtcatttgttatggaattttatattcaaagaaacttggagtggtcactctgcattactttgtctcttgaaggacttcccctgaatcaccctactattattaatactgttattaaaaggatataaattctccttttaaaggctgggtagctgattctgttgtcactctcaggaacacattccactgttttaggatccttaccacctagttctcttcataattaatttagacgtgtttatcaaatgctacttaaaaatcattttttttttggaaaatcttaggaaatctgataagttgctagcaaacacacacacacacacacacacacacaacagcagcaacacagtagtccttcaaaacctgaagattgggcactttgctagggcactttgtagctagttttttctgggttgtcctctgagaaggtaatttgctagtgcctgcagctacatctaccaataattcttactataacaatgcagagtaggatggggatagtgaagttttctgggtgggattttgtttgtttgtttgtttttttgttgtaagtttatgccagataataataatgtaaggtttacagagataagatctctgaagttacctgtctctgttcttcacagatttttttttattattatactttaagttttagggtacatgtgcacaatgtgcaggttagttacatatgtatacatgtgccatgctggtgcgctgcacccactaactcgtcatctagcattaggtatatctcccaatgctatccctccccactccccccatcccacaacagtccccagagtgtgatgttccccttcctgagtccacgtgttctcattgttcagttcccacctatgagtgagaatatgcggtgtttggttttttgttcttgcgatagtttactgagaatgatgatttccaatttcatccatgtccctacaaaggacatgaaaagagactggtttactaattaggaaaacttcctgaacagttctatatactgtgttaactccactcaagatatttctgatgacttttaggtcatttccaaagtgatttgaattagtatttgtccttttgttaagaagaaatcagtcctggaaggaatcaaactaaataaataactaaagaataattaatgcataaaacaaggcatgctaagaaaacattcttggcctacatagattaacaatttgttcttcccaaatcattaaggaatagaaaacaatgaatccttgtgctgtttaaagatcctctttcagaaacatatcattgcaaaagaacacactattctactaaaggaagtatatacactctaattaactaggcaggacattgacatcccaatctaaattcttctccacaatgttctgtaagagtttattcagccatgtgtggagaggtttactgtactgtactttggcagtcacatatttctgaaaagctattttgggaggactttttttttttttttttgagactgagtctcgctctgtcacccaggctggagtgcagtggcaggatcttgcctcactgcaacctctgctccttgggttcaagcagttctcctgcctcagcctcctgagtagctgggattataagtgcccaccacaatgcccagctaatttttttatgtttagtagagaaggggtttcgccgtgttggccaggcttgtctggaactccggtcctcaggtgatccatccgccttggcctaccaaagtgctaggactacaggtgtgagccaccgcgcccggttggagtttttttttttttttttttttttttaatgcagattatatgatcaatcctaacatcaggataaagttcccttttcatcttaaaaggaaggaaaatgtttgcaaagagtaattttgaaaagttaggaactataattctaaataaaaagaaggctaaaagaaaataaaactatatagcacagctcttggaagattattagtagaatacaagctagtcagtttggcctcagcacccaattttttttttttttttttttttttgagacagtctcactccttcactcaggctggagtacagtagcgcgatgtcagctcactgcaacctccatctcctgggctcaagcaattctcctgcctcagcctcctgagtagctagaattaaaggcatgcaccaccaagcctacctaatttttgcatttttagtagagatggggtttcgccatttttgccaggctggtcttcaactcctgacctcaagtgatctgcctgtcttggcctcccgaagtgctgggattacaggcgtgagtgaccgcacctggccagcacccaatattaaggaaaaaaaaatgcattaagaacagagccagggctcagagagctgatggcaccagcactgtggagcgtagaaataggaagggataattaatggtcatcgctgattgttcatctttcatctatacctgctctttttacagggtgtgaaaacagttttgagctcaagttaaattgtggctgcaaaacttttgcacagactttggaaaacttacttgttccgcttcctggcagattcaagtccctcctagcctgtaggcgcccatcctctctacacattcgtctgctctggccattacactatgcattgcaacaatttgattatatgcttcatctttcccaagaccaaagctccttgaggacagggtccatctcgtttctcactttatccctcttagtgtggctattcaataaatctctgttgaaagcaaggcattgctaataacactgatttttatttttggaagatacttaccttatggacatagtacataatgagtatggatgctgcctgcacaatattagttaacagggtcaaagtgcagtggcaaagtccacattttaacttcctaccattcagggagaggcatgaggttgctttgaactgtatagcacatataaagtgaatagttgaaattattataacattttatttaaagtagaagaaactgcaggaaccttggtatttcctgatttagtgtccctattatgttgctatactgtattgtagttacaaatttatttgtaatattttgtattctaattcgttttaaagagtgatatggggccaaacacggcggctcacgcctgtaatcccagcactgtgggaggctgaggcgggcggattgcctgagctcaggagttcaagatgagcctggccaacatggtgaaaccacatctctaccaaaaatacaaaaattagctgggcgtggtggtgcacacctgtagtccctgctacctgggaggctgaggtgggagaatagtttgaacccaggaggctgaggtgggagaataatttgaacccaggaggtagaggatggcaccaccgcactccagctgtctggaaaaaaaaaaagtgatatggggccaggtgcagtggttcacacctataatcccagcactttaggaggctgaggtaggagaatcacttgagaccaggagttcaagactagcctgggcgatggtaagaccccatctctacaaaaaataaaaattaaaacgttagctaggtgtagtagtgcatacatgtagtctcagctacttgggaggcggaagtgggaagatctcttgagcctgggaggtcaaggctgcatgagccatgatcatgccactgcactcctgcctgggtgacagagcaagaccctgtctaagaatgatatgctcttctccagtaccaaagtactaaagtgatttattcatcctattcaattccctgacataagtggcacaagaaatgggaggagattgaggagaaagcaattagctggttggtaaatggttcattgcagttaataatgaaagtgtgccagttgcctctggttttcatagttgagatcctaaactgcacttaccctagttctgaggtgtgtctgaataactttaaaatacgtgctggggatggtggtacacagatgggtccctgtatctatctcccttagggaaccaagagtctaaagctatcaggtttatagctaaaattgtgttgatgccatgtgtgaggtagagagggtctggaacctttgttggggtagggaaaccacaaggattctgttttcctaaagaacttaggagccttgtaagaaggtgaggccataagaaaatagatttatgctcagattcagccaggactgggaaaatggtattatcccatcagcccaaatattttcccatttttgtggtcacattccagagtcttggggaaaagggtaaaagaagcaggggaagaaccagtggtatgttggtaaatgcctctctaaggaaaaaaaaagtcctgatttgtagcacttggtgattgtcataaggtaaaaactcctactgtgactgatttcaagctcccagctggcaagctggccacagccacaccactgaaaggctgagattaaaaacctgaaaactaggccaggcacagtggctcatacctgtaattctagcgctttgggaggccaaaggtgggcaaagtggcataggggatgtggagggaggggctgattacttgaggccaggagtttgaaaccagcctggccaacatggtgaaacccagtctctactaaaaatacaaaaaaaaatgagctggacatggtggcacgcacctgtgatcccagctactcaggaagctgaggcatgaaaatcacttgaacccaagaagcagaggttgcagtgagctgagatcacaccgctgcactccagcttcggcgacagagcaagagtatgtctcaaaaactaaaataaaataaaaaccttgaaactaaaaagaaagagctgtttattttaaaatatttatcaactagcaatgctctcaagcttgtatatcagaatattacaaaaggttagaagaaggaatttcaagagcactttctcccctgaggtcagaaatggagcagctgcaaggccagattatagccagcagctccatctgatgggtctcagcaaacatcagaggcactggggccatggggagtccttgcctctgagtgccgtattagaagttacccaaaagaagatgaagtaggctatattcataagcattgtggactgcccccagagatttctaaaaatggttgggagataccttaaagcagaatggagttcctccaacagcaaggaatgggggtggggtcaagatccacaacaaaactgctttctccaaactaactggcagttattgatatttagataattcctattggccttaatctaaagataaatgcccattcttaagaaattttatttgaacaaagttaattcaaaattgaaattacaaattacttcccaaatatctctgaccacaatagacctagaaaagcaaaacccactaatgaacactaaatattaggggagttgatgcagatcatcagattaagcaaatgcttatgtagtatgtacaagccaaatgccaccaaagccatgagatagagctgtttttctgatagtggcaatccactggtcctggtcatgaccagatgcctaatctttggtgacccacagatttgtaagaagttgttcaggatttaaaatgtaaatggaagtcaaggtaaattaacccagagacacgactgaatccctgaccttgttgtcatgagtcctgggctttaatcagataaactaaccagcttggacagcagataatgaacctacctgatgaaattcttggccagagaattataaaacaatcttaatttatcttgacagatactgctgagatcgaaatgtggcaacatgtattaatgagatttttaattgaactagaatttcgacaaagaacctaaatttaagataaataagtttatcctaaaatacaattaaaatagttaacatagatctctattacctcactttcctcataatttatagtgttagtaaaatattactaacaatcactttagttgccgcatatgacatagttagttcatagctagttgttagcaattcatgtaggatacatctctatagaacattaatgtaaagattgcctttaattatgctcttgtgacttgatgaaactgtgcaagttaagattactgtgtttttgtgtgccattctattgtctagcataaaaaataatcagcaaattcagttgctatgggatacaaaacattttctcacaaaacaattgaaataatcagttttttagcaaccaacctgaagtagtttctttatgtagaaaaagagctttaaatgatatatttatattaatctatagcaattagtaacttaagtagttactagaacttattttggaaatcacaagttgatgatttatcatgctacaggattgctctaatttttacttaaactgatagtaagagaatgggcagcaatatgaacttatgagaagtgcacatgtctaagaaattagatgtaggttctgaaaattagtttggataagcttttgctctctttaactcaagttcctctccccctggagtaaaaggtgtgtgtgtgtgtgtgtgtgtgtgtgtgtgtgtgtgtgtgtgtttacaagaaccagtttgatgtaattagaatttaaatttctaatcaaattatattttaatatcagaagagtttatcttagttctagttgacattcaattaaaaagggatactaatacacaagcttgaagtttctttccagtggaccctgttcctctgaccacattctccaattctcactcagttaaaaagagctacaaatatataaaagcatttcataatctttcatttcatatgacccagctattaaattatctttaaatgtcagtaatagcttctttactaatctagttgcaaattaggctattttaaatggagggcagattgtccccaacttatgtaagttaatggttcaacttaagatttttttacttgacaatggcacgatagcactatgcactcaggagaaaccatactttgagtacccaagcaaacattctgtttttcactttcaatacagtattcaataaattacatgagataatcaacactttcttataaaataggcttcatgttagatgattttgcccaactgtaagctaattaagtattctgaacatatttaaggtaggcttggccaagctaaaatgtgggcagtttaggtgtataaactgcatttctgtcacaatgttttcaacttattatgagcttattgggatgtaaccccatcataaattgaggagcagctgtatttttgtaagggttgccctttgctaccacagttagttcatacatatgcactcactttcccccctgcctggaaaactcacctgcaaactccttcttgcctgtcaggtctcagcttgatttaaggttgccagataaaatacatgatgcccactcaaacttgaatttcatattaaaacacatttgtgtttttagtacaaatgtgtcccaaatattgcaggggatatacttacactaaaaaagtattcattgtttatctgacatttgagtttaatcggcattatgtatttttatttgctaaatctggcaaccctcacttgactggcacctccttggagagatttatgctaaacagttctcaaaactagtctccctctctgtctcctcccaacattttctattccatcactctgctctgaattcttgtgaacacttactaccatctgaaattatcttatttttatgtgtgtgttgtccaactttcttataataatgtacacacacactgtttttgaagcacacaaattcagagatcagtcttagcactttgtaaggagataacatttccaaactctatatgagatctgtattcttcacctctttaccctcaacctatagaatagcatgtggtacacaataggtgatcaataaatatctgatgaaggaaggtgttaatgtgtatattaaaagaaagaatttgaaaattatacataaatatcaccaggaagaaattgcccttgcaaacagcactacttctaactacaaagctaaattttaaaatatacatttatattttcaaatgacttatatatggcttaaagattgaactgtccaaaaaatgttagaaaaagccatttattatgggcattcttttttttaataaactgtaatcagtgatctttttaaaccaaggtctactgattttgctacagtaatacctacctgccaataaaagaatatgtagttgaatgtgaatgtttgttatccctagggagccttgatctcactaaatacagaaatagctcagtgaataaattggatacgtttgtgttttcatggaaggtttttattttttttaatattttttgctttctaattgtccctgggatatattaaaacaaatgctgtgaatcacaagaagactgatatagttgcagaaccccctcctgcccttttgccttgtgatgaaaggaaacatttgattgatggatttcggctcattacaaatatgttatcaagtcatcaagggcttttgggttgaaattcagaaagaataataaaacagaaggaaggactttaaaaaaaccctcctatttacagctgttaaattaaaataaaaaatcctgtcacatcttaaacagtttgaaggtgttatttgcatttcaactctctggaaggtgccaagccagatctctgatttgtgtgctacactagtggttgtatgtgtccagaggggataatgtctgaggaattcagatgtttggatgaatgattatttcagaattcaaagctgaattctcaaaaagagaaagaggcagaatgattttattaatggcttcacccaactgattagtaacacgttatcacattatgctgtactatgtgatagttgctattaggggtaccgagtagatgtataagtagatctgatcaaattataatttcatggctcttggaagacaactctttaaggtttccttgagagagttatggaacaaaccttacctacagtttgacaagtcttgaatctggcataccttgaactctctcttttccaaggcctgcacactcaaaacatactcattttgcctccggttctcaaaaagagaggaattctagcttctcagccaaagaagacttagaggaaaaaattgtaaggaaggtgaagtttctgcagctccttacaaccttaacatcctgttcttcctcttatctttcctctccctaccacacctctccaaaataaaaaggaaaagaaaaagataactttacctttttccacctccagtggttctccaaaacgggtgctcttcagaatcgcttaagtttgttttagtttggcttttaaaatacagatgcctgggctctacctcagatcaattgattcagaatctcaggaggtggttccctagcattttaacggctcctcagctgattctaatgtgttaccaggaagaagaaccgcagtagcaggccattaagtgaaagctaacataaaagctgataaaagctttaaggcaatggttctcaagcttggctgtacatttgaatcacctgggggagcttaaaaaagtgcccaggctctaccctagaccagttgattcagactctccaatagtctgggccttcaggctctctacctgattctcatgtgcaccagggttgagaaccactggtttctagtgtaaccctttgcagaggtatttgcattttcataagccttagtgtagacctttgcagagttatttgtattttcataagcaactaagaagttgcttcaatgattaaagacaggaaagggtgctaggaaaacatctgtctgtctgtaccaccaccatgtcctctctctttctgaacccttccaaaccaatctttgtagataggttcttctatgcctacttatctaatgacggatcccagcatactattctctgttactaaaaattatgttgtgatgattgaaactgatgaaagactgttgtctttacacttgtttttataatgattacctccaaaattttcatataaaacttttttacattttaaatttgtatatttttgtaaaattaggtgagctaagaaacaagttagactcctaatggtgtgcataaacaatggttgagtctttgcataaagaaatctatcttcatttgtatactttgtgtgttttttaaaaataaaagaaatcagagggattcatggaggctaattttcccttccaggcctatctgtaccaaagaaaagggaagattttcttgccttttctttttctacaaatggcattatatgcataggtatttatatatttttatctttatgaaatttcagggggaaacaattggcccattttccaagtgtaagaaaagaaagtaccaccatttagaagagatatggttaggttgctgatctttgttcttattactaaaagaaatgagaaacaggatctattccagggaatgggagggacaaagggaccatttggccccaggctgcttacacacaaagaccttcaaaattgatttttacttattatttaaatgagatctatgcatatagtccatcatataactttaaacttgtgcccatttattagatacaggttgagtatcccacaaccgaaatgcttgggaccagaaatgttttggatttcagatttttttttttcattttaagttacttgcatatacataatgagatatcttgagaatgagacccaagtctaaagacaaaatttatgtttcatatacaccttatacacataacctaaaggtaattttatacaaaccgtttaataggtttgtgcataaaacagagttttgactgcttttgactgcaacccgtcacataaagtcaggtgtggaattatccaatggtggtatcatgtctgaaagttttggattttagagcatttctgattttatatttttgggttagggatgcttaacctgtatctacacactgctattatgcttttgtatgaattaattttttagcacagtcatctatatttttctcctaaaacatgaactgctttgcattgaagttttggaatatttttaagcattttttttaatttaagcatttaaagtacattttttaaaatttatgacaagattattctaaaatttataggactgaaaaggaactagagtagctataatagttttcaaaaaaaaacatagtgggaagaatcactgtacccaattttaagacttattataaagctacagccatcaacattgttggtattggcagagggatagacacatagatcaatggaacagaatagagaatgcagaaatagacccacacctctatgtataactgatgtttgacaaaaatgtgaaagcaattcagcaaaaaataaggatagtcttttcaacaaatggtagaagagtagttatgtattcataggtcaaaaaataaaccttgtcctaaaccttacactatgtatgaaaattacttaaaatggatcatagacttataagtaaaacttttagaagaaaacattcaggacctagggctttgtgaagagtttttgggtaagatactgaaagcgcaatccatgaaagaaaaaaaattaaataaattggacatcatcaaattaaaaaatgtttgttttatgacttcggatgtgttaagacatgaaaaaaacaagctataggctggcagaaaatgcttgcaaatcacatatctgacaaaagactcatatgtagaatatataaagattgtcaaactcaacagtaaataaacccaaacagtccaattagaaaataagcaaaatacatgaagagacttctcaccaaagaggacacacagagagcaaataaacacattaagagatatgcaacataattaaccattaaacaaatgcaaatttaaaccacaatgaaatatcagaatggctaaaataaaaaatcatgactcataaatacctggtaaggggtaaattagtacacattcgaagtcagtatagccaagtcttagaatgctaaacaaacaccatatgacccagaatttgtatcccggggtctttatcgcagagaaatgaaaacttattttcacacaaaaacctgtaggtgaatactcatagaagctttatttgtaatagccaaaactggaaacaaccaaaatgtcctaccttagatgaagagttaaactttagtatatctatactgtagaataccgctcggcaataaaatggaagaattattgatggatcttaagtatgttatgctgagtgaaaaaatgctagtctcaaaaggcttgcattactgtgtgattttattcattctcaaaatgaccaaattgtagtgataaagaacagattaatgacctccacgggttagggttggtagttcagagggcagcatgagggatggtctagtctctaacctgattgaagtgatgggtacatgagcatacacatgagataaaatgacatggaaatatacatgcatatggctccaatgtcaatgtcctggtttggatattgtactctagtggcataaaactggaggaaactgggtgaaagatgcacagggacctcctgtactatctttacaacttccttggaatctataattatatcaaacaaaagtttgattgatttatttttttaataagaattgacttgttaagtataagaactgaaaatagattatttttgtaattccctttggacctttttatgtttctactatgctggaatcctcaaaagctggaagggcctgagcctctcagacctcttacctctgagaggtgagagaagtaaaattcaccagccaggctggctctaacatcctcatgggaagcctagttggaaacatcccagaagaatactgcctcaggtttccaaggcctgtggggtgagatctgcaaagagagggatgataagcaggactcctcctgacccacacttggtccctcatatgacacacacactcacatacacacacacacacgcgcgcgcacacacacacatggtttctcagagtcagctgctaccatggccttcattgtcatctttgccacctttgtatctgcgtcactgattgctaattcctaatctatgtaaacacccttgtgagatcactttacgcatcttggctgtcatctctgggaaatgattccataagaggcaaaaccagtcctgcagattttccaaacccagaaatatttctgttgtatttcctgttacataactgaggtttgtggagagcccatgagactgaaggaaggagaggaaacccctatgttgtgttttaactattttaacccacgtttcccttaataactcttcttcctgtttactaccttttttattattttctttattatttctatcctggatataagagtaaagtaggactagaaaacttttttaagtctttgaacaaggaacctccatgaacgtatatttacacacagctattttgagtttcaagatgcctgaaaagggtgtagcagcattctttagatagtacctaatgcaaaatgcaccctcaacttgatctcccttgtggttgagagtgtgcatatatctatttcttttctttttttttttttttctttttgagatggagtcttgctctgttgcccaggctggagtgcagcagtgcgatctcggctcactacagcctccacctcccaggttcaagcgatctttccccttcagcctctccaatagctggaattacaagtgtgttccaccacacctggctaattttttgtgtatttttagtagaggcggggtgtcaccatgttggccaagctggtctcgagctcctgacctcaagtgatcctcaaacgccattttatatagagttttatttataagaaataagtgggacaagtaggagattcttaagaatcgttgcactctagttcagatattttttatatatttataataatcatagttatataagcataattaacccttaatttgtaaagtttatataaaggctacattaattagatacttgattcaataactaatagattaccaatctatttaaaatacccattttcttaaacacttactaggtctcaagaactgttttgagatgcaggaattcatctaattttcactgccgggcgaggtgtgagagccctagcatctgaaagtggtcgacttgcgagttggtaagaagaatttaataacaacagaataggtttgaaaaaggaaagttttagtagaaagaaagaacactgcagaagagtgcagcagggcgccttagcaagatagaactgagtgggccatggtggattctccttgggagcatttatggaccttaagacagaagcttgagggtaatttggaccatattagccagacaggtcatgataaatgatgacatttatagtcattttggtgcctttgtgtcagcaagggttgcacaatgagtttcagcatagcgttctggagatgtatagaaattttagttacttagaaatttttttgaaagaggcctggaaccagatgcctatttagatactagagaattttaaatacttctaaattccctcgatacggagttttgcctctgatggcctagttgatggtcaccaggtgttctttgctcccttcatgatacttctaaattcctcagatacggagttttttgtctccagtacctgttcatggtcattagctgatttttgctgtcctcactcgcagtatctttcaagtaggtactagcaatccctcattttacagatgatgaaactgagacacagagtttgagtaactttctcaaggtgacattgctggtaagaggcaaagcaaaaaataggaccatgaagtcaatatcttcattaaaaaatttatgaaagattagaataaatgaatatagtgaccaaatagtcaaaatggtctggaatcactctctctttgcaatgattaagataatccaaatgagaatatttcagttaacaaaatccatctcattacaggatactggcaactgcatcaaatctacattttgcttgcaaatgttcatccagtatgaaagagagaataaaaatattaggataaaataatttttttaagtgaggagataggcagtcacacattcttttgtgacacaaaccagttctacagtagaataatgaaggcattgttcagcagtttgaaggtttgatttataaaactaggtgttaactgattggcaatcaaccaatagaaggtaaattgctaaactagtctgcatgtgcagatgctagtaagaaattttcaaaggcacagctgcacttttatacaaagttccctgatcatctacaggtacttccccacatgtggtcatgacctttgatgacacccattcaggatatcagtcgccagtttgtttataaaatgattcagatgtacttaattagattattcagagtttctgtgggagtgcaggaatgtcctgtatttcttgtccctttctcccataacttctacctccctacaaaggcctaaatgctctgcttttgatggaggcgtgcaacttcagataagctccggtaagaatataggtgtttttgataggctaaaatggaaagcacaaatttctgaaaccccaggaaaaaggtgcaaactctacatacactgtgcaatctgcatgaaatccaccataggagaattgagtagtgattaagtctggtttgaaaattctgcatcaaattcacagagttttactttcaacccatttgggtgaaagaaataatgtccttacaacatctcttccacttctttccttctttcttactcttctccattggttactctttaatcattcagcatcttcctttttatttatctcacactgtgcctgggacacagagtaaacttttgtacttccagccccttcatcccacccttttaatatagttcaacgaatatttataaatttcctagactgtggtagttagtgcttttctgagcactgaagatacatcattgaacaatagacacacacaaacacacacacatacacacacacacacacacacgcgcatgcatgcaccaaaaaaaataaaagattaactgaaagcttaaactacatattggaaaagaaacatttttgagaaaaattcaatactgaaagaaaagatattcttcaaaagtataaaaaacaacctagattattgcaggagatcatacaaactggtttgttttttatttaaattctacagccacatggttcataacagtatttcagtttagttttaacttgcatttttttttagttttgggtaatattaagaatattttactgtgtttagaagtcttttatatatttccttaggataaactatcagctcatattctttgcccaattttctaatgggcaattgtttttttctcattgatttatatgagttgaaaaatattttttccagttcgttgattatcttcattatgacattgcttagcggttttgcattgcagaagttatttatttttatgcaatcacatttgtccaactatttgttaatggtttaatgatgtaggaagaggaccttcccctctaagattataaaagaatgttccatggtttcttctagttctgttctagtttcatttttctaaaaataaatctttagctgggcacagtggctcatgcctgtaatcccaggactttgggaggctgaggtgggcggatcacctgacatcaggagttcgagaccagcctgaccaacatggagaaaccctgtctctactaaaaatacaaaattagccaggcatggtggcacatgcctataatcccagctactctggaggctgaggcaggagaatcacttgaacctgggaggcggaggttgcagtgagccaagatcacagcattgcactccagcctgggcaacgagaacgaaactctgtctcacaaaataaataaataaaataaatctttaatttattttgaatttaccttggggtggagtataaggtataaatttatttttttctttcaggtaactcttgagttgccccaacgttgaaaccacctttgcaaaaattctaactgaagaaattatgacagtgaaagagatcagaactaactgactccatctggcttctaacctttaagctgtccttgttcattcctggttgcaggcagaactaaccttgggaaggaatttagtttatggtttggctctgaaacaaaattgataatgtcccttttcccaaaaagacccacttcttgcctggggaccagtctgcctttgtaggactaacagattaactacaggattagatattacattttaggggtcatgcagcctctggctacaagagtctgaccttccccagattgctcctatggatagcattactattataaaacctaagatcagtgcttgagatattttgcagaccctgcactggatggatcagctgacaccacccagattggtaatctggcttaaccacttctgcgatcccctctataattctatctccaacctgaccaatcagcacttcccactttcgagctcctattttaatttaaattatctttaagaactctgatcttcgtgctctgggaaactgatttgtgtaataataatactcgtgtctcccatacagccagctctgcctgaattactccttctccattgcaatccccctgtcatgataaattggctctgtctaggcagcaggcaaggtgaatccattgggcagttacaaatttgggggctcgaccaggattgcctttgttgttacctgctctgtagcccacctctggtgatggatctggaggccaacccaagtggccacctagttctcttggactaggggctgactctggcactctctgccagtggggtgctgctgacccaatgtgcatggattcaattgcagtggagaagtaatgctagggagatatctcataactgtagcctcatcactgggtgtctgtagctgtagcctcaatgcaaggtgtctgatttggtgagtattccaggcagctaccaacagccccttccttctcctgatttattggcctctctggaggtgctgctgtctcttagtaacctcccagggtgtctgtctgtagccctatcacaaggtatctgcctgtagctccattacaaggtgtctgtagctgtagccccattacagagtgtctgtctgtagccccattaggggttgtctaattggatggagactaaggaacttgtttggaggactactcttggtttgagactgggtctggaatctgtgtcttgaaggccttctgttcatcttacattgtttgcgtgtgtgtgtgtgtgtgtgtgtgtgtgtgtgtgtgtgtgtgtgtttatatgtatggagggccctgaaggaattgctcacagcagttttctgggggcaggggacagagtctcactctgttgcccaggctggagtgcagtggtgcaatctcagctcactacaatctccacctcccaagttcaagcaattatcatgcctcagcctcagagtagctgggactataggcgtgcgcctccatgcccagccctgagttatcattttgggtaaatgaatgacttatggtgacacgggactctattttgtgatatccagtgttttaaatctttgatatttgacaaaccttccaagatcaaattataagtttaaaaaaaaaaattagatatcctgaagttcaaaaagatatattaggcttatttaatgtattaaaatcatgcaggaaacattgtcaaatataaaatggtgtttaactttctttgagttatactcatataaatatgttattagtatgtgttataaaattgtataagatttctataattctaatatgcctcagtatatgttatcagtaataattataattgttatgttgaatttttgtgtgccacagaggtaacaaatttccttgtcaatttctttgactgcggcttccctaaaacatttctgtcatctgcagacaattgttgtcttgatttggtcctctttaggagatggttttataatcagctataaaactttgacaggtgctcttgaatgcaagtttctgataaccttggagattatgacattaaaataaaggaaaaaactttcgggactctcataaagagctgaaatgttctttcatatgaagaaatcagctctgtctaggtagcaggcaaggcaaacctgttgggtcattacaacattagctattaaataatctgttttctcattgacctgagatgctatttttatcatatgtgtttgggtccatttctgaatttttttaaaacttattcattaaaatttttctacttttcttttttcttttctttctttcttttttttttttttttttgagacaaagtctctctctgtcgcccaggctggagtgctgtggcctcctgagtagctgagattacaggcgcgtgtcaacacacccagctaatttttgtatttttagtagagatgggatttcactatgttggccaggctggtttcaaactcctggcctcaagtgatccacctgccttggcctcccaaagtgctgggattacaggcataagccactgtgcctggccagaactttatccatttctttgatagtaccacattatttaattattttagctttataaaaattttaatatttaatatgactagcatcccatttattaacctacttttcagaatttatagaattagggaaaactgacgttgtgtgagccttgccatccaagaacatgctgtacattttcttttatataagttctcttctcctgattcttaagagcatttaaaatatttttcatacatatgttgcacatatcttgctatcttgttacatattgtctttattttgttgcagctataagtaggatcctttcatgtattaaatcttcttactggtttcttttttaatatatgaagaatatttattttaatcgagttcccagcctagatgttgaattatttttgtatgtatgatacttttttggttgattttcccagtttttaaagtttgatctagttcgatcatctggaatcccttttgaatttctgtacctctgatttctttctctgatctagttatgttagagctttcagaacaataactaaagtggtcatagcagatgtatttgtctggttcctgactttgttggaaatgtttctactaatgtttttaggcataatgctgaattttaggttaagatcaataatttttatatgttaaggaaatatctatgtatttctctttcactatgaatcaagaataaatgttgaattttaacagatgtccttttaacatacacagatatgacagactttttccttaaatcttttaatataaaattaaattttaatcttttaagttatattaatgaagtttcaaaaattgaatttatagaactaatcttcacatttgtagaataatccccatttgatcaacataaaccttctattaacaagctgctggattgtgtttgctaatgttttatttagttttttttggtatcactaaacaagtgaatttatctataatttattggagcatattttttgtcagattttgccctgtatccttttatcaaacagaagcttttcaccagtgattttgttaaataagacacatatgaaaagatatatgacaatttttactccttccaaatttggggggaaatatatatgacaatttttactccttccaaatttgggggtaaatatagttaagataattagattacaacaagtcaattacattacttcttgaatatagctctctttaattttccaggcacagagcatttatattttgttgggcatttgtgttattatttttcagttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctggcatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtaagaataaacaaatttacactcaatctttaaaacatgaatcattaaatgtgcacttgcctcaaagattccaaaatataattccaagatgaaatgcccactaaatattacattttgctaatatgtgctgtgaataattttcttgagcttgaccaaataaggtggtcaactgttatatctcccactgtctgcaccctcagattttagtttgatggaaccccatggtgtcagcctctggaggcttcttgtcagtactagaaactaatacttggtgaatatccttttctgcttccattaccttgtatgaaactggttccatttatacactgagattagaagcattcataagtgatgcggcaccacaaacacagaagatcaaactactcacagtgtggagaaccatgtcttttataagtgtgatgtgcctaaaaccatcatcaactaaaaaccctggtacttacctatctaagacaccacatacaagtttaaaacatcttgttacatatgttaattctacatccttattttaaaatcggttcactgttttacgtcatcatttggcatggtgctgttgtagcctttcaaaataattattaaataaggaaaaggagtaaatacagaattaattaactgtttttaaactaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcacttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggtaaatctcttcttatatattttcttctgctcctgaaatcagagactattgctacatcatattccatttcataattatagaaagtcactcttctaagcatcttcttttttaaagtaactagaattagaaatgtcatgtcagttttttaaaatgaatccagtttagatctcatacaactattaagaataaaagtttgccgggggcggtggctcactcccataatcccagcactttgggattccgaggcaggtgaatcatgtggtcaagagatcaagaccatcctggccaacatggtgaaaccccatctctactaaaaatacaaaaattagctgggcatggtggcgggtacctctaatcccagctacccaggaggctgaggcaggagaatcgcttgaacccaggaggcagaggttgcagtgagccgagatcgtgccactgcactccagcctgggtgacagagcaagactccatctcaaaaagaaaaaaaaaaaaagaaagaaaaaaaatgatactttccaggttcgcttgggtccagatctgtattcccagggctcatagagatattggcaaactgacagatttcatggctcaagaaacctaaagacacctacttgaattcctttggttggcagtcaaatgttaactagtgtgttttcaagcttctattcttaggcatgttacttccttttggaagtcaaaaccaaccatcttttaagtaagagggctaaccaaatatgtgccacactaaagcaaacaaattcacaaaagagcgcttataattcccttaatgtttgacttgggggaagttgacctcaataactagaaaaccaaataattctgagcaaatatcaaatattgtcttatgcataatcaaaagattcagtgagaatcagctgaaggagttttaagacattctcagaggaagtgctataagtcagttctagtttagaaatagctagttttgatagatcttacttcagtctcaaaaattattagttagtcattaatgatgcttctatgggtttctctacattattttcccaacaaatacatgtaagtttcctgggtaagagtcacactacaagtgtctgattcctctcaacttgtggtgcaagactgatgtattatattatgatgtatttattatcatgtataataaacatgaaagaacccactttgagagtgtgagtaatccacatataaagcagaaaaacagaattctgatgtaattgtttgagaacatcaagttttgcttggggaacaaaatgcagatggtaatgaaggtttaagtgagtgtttactgtcttttagaatttacagggaaaatcgaaactttctacacaactcctagaatcaagtccaaacagaaccaattactttttttgccaaaaaatataatttctaagtgtatttttcactaaagttattttaaaataatttttaagaaatgccatacaatttgctttgagcaaataatttgtgcccactgtcaaagtgtgggcagtttgtaaaatgtagtttgtaaaaatgtagttttgtaattgcttataatttttcttaggcaatactcaagaaggagaatccatttagcacctcctcagcctggctcagtgattcatatgtggctttgggaatacttgggttttttctgtttgtactcttgggaatcacttctttgccatctgttagcaatgcagtcaactggagagagttccgatttgtccaggtaagaacttcaagttcattcctaacttttcattttgctccatcacttccctagcaatcatatttaaaaattcaaattagaaaatgttgaacccaggtacaaaaggcagaatccataatgatttgatttcttaatactcgccaagattcctgactgcctccatatctacagctaagactatagggtgaaaaatactaagaactattacaatttatgtgtggagatgtactaggtacaaggcaaaaagaaaccccaagacaaaatttcaccatctaaaaaattaaccttacaacatggacatacagatatggaaaaccagatgttgagataaagtttaaaatcttcacagcaagatttgatagatgtcatcacaccggaagacttaatgctcttctgtaagagggaaaattgttttcttccacatgtcaagcaccaaccaacccctctttaaaggcagttagtaactacacattcttgtagaccagtggtcctcaaaatatggcaccaggaccagcagcatctgcatcacctggaaacttgttagatacacaaagccccaggccatgcccaggcctactgaatcagaaactctgaacctgtggcccagaaatttaatgagccttcaagatgattctgatgcatgcttattatgagtataatagaaaagagcattagtctttaaaattaggttagaattttatagaactattggaatcttaagtcttgcaatttctcccagggaccaaatgcagtcaacatgttctcattagcagttttgttcaaggtattaaggcagaaataaacaataagctttaaaatgtaggctgaaacaagattggctattgctctttattgtgatagaaatgagctaggatctggttttagtcagtaacatatactaagatggtgcttcttgaggtcatactgtgtcatattcatctctgacctctagaaaagatgataaataaaagagtttcacctttgggaaccaagacaagctacattatttattctaacttggaagagtttactcctgggaaacttttccatccagctaggttaaggtgaagctactatgtcatttgtaagaaataatcttgttttaaatgaagtatttaccatcctgaagaagggttagtgctttttttcagtacttggcaaagtgtcctaaacattataggtctcaaatgtttgtggttgttgacaaatatctgtcactggcttagagtgtttcactttaagatgtaaataatgttaacttacatatttttgtttcttgtttatagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacatt

SEQ ID NO: 38592 - DNA, 9219 bp, Homo sapiens
cctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggtgagcgcgacccccgcccggcccgcacctggcgcacctgggcgtcggcggcgggagcgggcccggcggtggccgcggaaggcggccggaagccgacgcaggcgccccttccccgcccgggcggcgcgaggacgcccctcccaccctcccccacttgtttgctgctggagccgcggcgttctcctcgggcccgggccgcgcccgtgggtgctccggaccggactccgcgggcgcagctgtcccgacgctgagctggggacccgtggggttctcggagaggggcagagacccaaggtcacagaggtcccggaacgccagccacagccacctgggcaggagctggggcggcgtgagggacacaggcgcgagggcacccccccaccctgctgcctgctgccccgcgccggcctgggcgaccccggcgtgacacccggtcctgggactcccttcggcgcccagaacgcgtcggcagcatccggcctgtgggagggagggagggagggagggaggcgtcctgaggcagcccggcccctgctgccctgcgctcccgtgcggccccagcccgtcctccgcaccccgagcttcccgggctggcccccgccctccgcgtgcgcccagcgctcttgcaggcggagggtgcgggccgatccccccgcgccgccccgctggccggtcttggcgatggtggggccgagtagggcctgagccctcggaggcgctcttcccccggcctggaggttccgggagagtggcctcctgcctgcctgcctgctggaggcctaagcgggctgagtccagctgcccctcggcctccccgccacctgcttccctgtttccctgtcccggagcgccatcccagagaggctgcggaggagggcgagggaacctggacccttccggaccctccgagctccatctacccacgccgagctctgccagcacgcccgcctgccgcacttgttctgccagagcagaggcctgggctggccttggggctccagggccagagaggcatcacccagggactctgcggggagcctgcctgacacgggagggatggctgggcagaggccgtgctggcggggtatattatcaagggcaggcatggctggggcagaattctctgtaggtagggtgtgtcacctggggaaggacattctgggtccttggcagggtgactataaaagcacactggcatgaaggcctaggtggggccatatctgaagggctggggcatgctctttgagtcgtgggtagagccgtgagcccttgccctttgtcctgagccagtgtgtgcctcccgcagcagccacatgcccgcggattgatgtcaggagccacctctgcaagcctggcttaccacagggagccaggctccaggacagcagagtgagggagaggcactggctccatggcacccactgtgtctggggggcatccaggaggctggctctctgagggcctggggaacaggagagcaaagaaggggagcacttagattcacgagcccagcccctaggggatagaagcctaaggatcctgtgaggtatgagtatggggtgacataggcctcccttgtcgaggggctgtcactgtttctgtggtgacccagtagtaccaggtctttggaggcctcaagagaagctgggaatctgggctcttatgtgaacccatctcgttgtcacatgtagaaaatctgtcttaaacccctggtgaaaccagacgtagccagtcggaggccagattggaacctggcctccactttgcagccagcgggggtccaggaacttgagggaaggacccaggaagtggaatctgcagggaaggaaggaggtgggcagggaaccagagaggaagggcagcaggtgtgggcatcatcctggaaacgcaaggtcaagcccaggacggcctcttagaccaacgcaaaatggaccctggagaagggtttggggcccaatttcctatctagcccgtgcagcagctctgccagcgctcaaactgtggccctcggtcaagcacctgctgaggatctgcccagggaggcagacccttgggggcagcccggggtctcagccatgcagcgctcccagccttcaggctgtccgcctccccaggcctggacttcagcaatgatggacacccttactcctaggaggttgcagggtctggagaggaggcagacacctgccacacacatgcatggtgacagcagaccgttaacgggcctgatatctgcctatgcccctctgagcctgtcccttttccctgagtacaaggcacaaaggttgtgccccagcttggctctttaatctttccccaaccaagagggaagcagggggaactgtggtttgtgggccccaggatgtcctaatgactcgcctccaggggagggtgacacagcctccaggcctcattgctgctgctcttaacaacgtggtcctgaggcaagaaagtgtggcaggggctcccaggctggtccctctcctcacctgagctgcctccccagctcccgagggttatagggtgccagcatggcttggcagagccctggcatagggcctggcccatggggaggcagtcacagagttggacccacagtcagagaagctgagggcaaggcgggtggaggagctggcaggcgggggaggctgcccagggccagggcctgcagtgtgtagggaaatgacagaagggttggtgtgggcgggagcccgtggggccctttatctcctggtaaacaggacccgggggagaggggaggcccctaggaaggaagcgagggtaaggcgcaggctgttgccagggtgattcaggcagcatcacccaccactgcccacccagcctgtccatctgaggcagtcgtgtgggacagagaaagccagggtggggctcgggggtgggggtgggcagtggctgtaagtaggcaagcggggactggcatctaggcaggagggaggcgcacctgcaggtgcaggtggctctgaacccattcctgatggctctctaggcctctgcacctccagtcccatccctgtgggcgagtgctgcctacacctggtgtcacccagcaatgggtgagccctggggatagccagctctgcattcaaggggttaggtttccagggtaaccgagcccctgagcccagcgtggagcctggcagagccagtaatctgactcccctttccctcccgccaggggctgtccagaggctccgctttgcctcagcctttagccccagagaggcagggtgtggagggtgggggctggcttcttgggtaagagatgcctcagggaagatctacctggctccctgctccttaaacctttccctcctgcccaggtccaccccttcctcttccctggtcacttggcacttcgacctcctgcccgtttcggaaaggggtgtgccctgaggtgactgaactttgcctgatcatgaccttgatcatgcacagggctgctggtggggtgaggccatcccacgcaactctggggtctgtgaagccaccaaggatcaaggaatggaagagctgcctgagtgtagagggagttcggtcaggcttcttaaacttggagacttggaaacagaaggccttgtaggccacataggttttcagagactcgcctggcagaggcctggagcgtcctgctgcgtggactgtgggcaccgagccaccaggaggttgttgatctcattcttgctcactggtccctgccagactggtggtgcctctctactgtcgggcagccccacctctgtgctgccccatccacctacagccctcatgcctgggcccagctggaggttctgacaggggccccctggggtggcatgcggacccttcagggtgccccaggcgcagcacaggtctccagagacacaggcaccagggcgttcagagctagtcccctcgctgctgttgactgtccttgagcagccccagggccggtttctcaacctcatttgctcacctgagcaatgaagtgaggtgggctcctggaactgcagcagccaccccccggggccatcgtgaggctaagaatccagtgcagggtgagcaaccagcgaccgctacaaggacagtgaagagctagcaccaggaccttgggtagcccacccgctggagggagcgtgtgctgcaaaaagcaagagtgggctttggaggccaacggatggagcggattcagtctgaggctgttccagcccttgcttaggatccacctacctaggtctggaaatcgtatttccacttcagatgccttctcagaggataaaataacccccggtgggggagagtactggaagagggctaattcccctggttttctccccatgagcattagtgtcagtgtaattttagagtgaccccagctatgtcacgtgtggcaggcacaagaacagatgtcaatgagctattgcagaggtggacacccagatgtgtgcgctggcacactggaggggcccgtagggtggctctagaccgccccctcgtgacggcttgcctaccacctgcaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacaggtgaggtctggggcgggagggggaaaaggcgggggcgggctggttgtaggttccctggtctcagtcccgatccttcccgacccacccagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggaggtatgggcgcagacagggaggagcacggggtggggggacgggtggcccccgcaccctttccagcgtcgggcctccgtcccccatagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgaggcgagtgagccgggacgcggggttgggggacattcagaggagcccccgcggtgcagaactgacagcaggaaccattccgaggagaaagctgtcggaagttcagttgctagtttcattcgcaaatgctccgagatagaaagttgaaagggctttctggcaccctctacccctacccatcgcccccgccaccccctagtccttggccatgcgagtcccaaagggaaagggccgtctctgggggcccccttactccgccctcagcacagcaggctcactccctccacgtggggggcatctgaagcctgtgccccttctccaagcccttccaggccttttggggcagcagcagggctaagggagggtgcttggtctccccacagactgactcacagtacacttcggcagtgacagagaacatcaaggccttgtgagtactggcgaccccagagagctggtggcgggagagctcggtgcggggtgttgtgctggcaggttcctgcctccccatgagatagtgcctttcctatctcgtggggaggcagggacctggtgggggaggggtgggtgtgcagaagtggcccagcccctctggagctctgctacctcagttggctgggtgtagggggtggtggggggctggcactgggtgagcctcaagaaagggccacagtctggtgggctcggcccctctcagcccctggaggctgcatacggactaggccttcccgtcccccaggttccccacggagatccattctgggctcctggaggtcatctcaccctccccccacttctaccctgacttctcccgcctccgagagtcctttggggaccccaaggagagagtcaggtactagttactcccccataccctcagcaacccgcctgcctgtgctgagaacccatctactggtgtttgagtccagggtgtttccctgcagtgccctgaattctccatgggaggacccgtgcatgggggtggggggacagaagctgcccacccagcggcttctctgcggagccacaatggaggtggaggggtctgaacttctgaggccccgccccggcccacaggtggaggaccaaacagaacctcgattactgcttcctcatgatgtacgcgcagtccaaaggcatctactacgtgcaggtcagccccaagccctgcgttgccctgccctgccctgcgccgccctgccctgcgatgggtctggtccatctgggtgcccttcctcagccccagcccctctctgctcacctcgcagctggaggatgacatcgtggccaagcccaactacctgagcaccatgaagaactttgcactgcagcagccttcagaggactggatgatcctggagttctcccagctgggcttcattggtgtgcccctccccttacctgacggtgcctttcagtcccacctgcctctgccatcctctctcccagtcccactgtgtccactgtgagcctttgcccaggtgggccctgcctggtgtgcgtgctacagccccacctggcctgttctcattgcctgtgcatcagacatgtctgccctcatcacctgtctgcctccctgccccgttatgcccacacctgcctgaagcctgcccctgggtttgctgtgggactcgggggccgctgcagggagaaaggaagtaggcagagcagcactgcccactcaggcccctccccaccaggtaagatgttcaagtcgctggacctgagcctgattgtagagttcattctcatgttctaccgggacaagcccatcgactggctcctggaccatattctgtgggtgaaagtctgcaaccccgagaaggatgcggtgagcaagagctggcgggactggcaggggcagggccaaggggcaggcagcctccaccccaaactgtgtccctgtccttgcatctgctcacatagagcactgtcagctgtgggagggccctggtagtccccaggagaggccgtgttgaggaaggagggctaagccgagccctggggtgttgcccaccctccacagaagcactgtgaccggcagaaagccaacctgcggatccgcttcaaaccgtccctcttccagcacgtgggcactcactcctcgctggctggcaagatccagaaactgaaggtgggctgcactgcacgctctccctaggccgggatcaaggtcggggcccacgccatcactgctgtccctcctccgctgcaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggtcagtgccagcaccatgggtctgcgatgggggcggggctgggtggcccccagggtgtaggcttcaccggcaagttatcctcacgttcttcagtttccgcatctgaagtgggcctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagctcacaggcctgcctggctgcaggttcttcttccgcagtgggaacatcgagcacccggaggacaagctcttcaacacgtctgtggaggtgctgcccttcgacgtaagttcggtgggtgtggtgtgcactgaagccgggcctcctgtgaccacctgcctcagcccttgattctgcccccagaaccctcagtcagacaaggaggccctgcaggagggccgcaccgccaccctccggtaccctcggagccccgacggctacctccagatcggtgggtagggtttgggggagagcgtgggctggggttcagggacaccctctcaccactgccctcccacaggctccttctacaagggagtggcagagggagaggtggacccagccttcggccctctggaagcactgcgcctctcgatccagacggactcccctgtgtgggtgattctgagcgaggtgaggctgggcagggccaggccaggcacggggagcagccagggagaccctggcggagctcagaggccctgctgaccctgggtccggctcttccagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaag

SEQ ID NO: 38593 - DNA, 18512 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacaggtgagtccaacaggaggtgggggtaccctggcatggggtctttccctgccagctggggggtgggcgactgcaggcaggacttggagggggcgcactttgccagctcagagctcatctcccagtcatcagtgaccctgtgacctggatccctttaccctcagaattccttgccccctcctcatgctccccagactgcctctctgggccaactctacatgctgggtgagcccccttgcccggcaaggcctggggtcccccacactgagcccagtctgcccagcctgaggggaggccgccgtgcagatgcagagccccggcccctgagacccagccagttctgcttggctggagaaacacaagcggcttgctgctgctgccaacccagctgctctgctgaggaaagggtctccctggtgccaggccaccagtgggcaggggcttgctggagcttgatgggtcagggctaagtctaaggccgggtccagttcgggacaggggagacaggtccagagcccagtagctgggctgggcagggatgggcacaggaaccagggggctggggtcaccgctgagcacacactctgagcccttggacactgggggaagctgagagccttgggtcctggtcttggcacacaaggaaagcaacagtagcagtacctcgaaggtgctcatttctaagatttgccagatttctgcggtggagagaggaagtgggtggtgggatgacagggtgggaagctgaagggcctgggcgactgggtgcccctgaggctggtggaggtgtgtgcgtgcgtgtgtgtgcgcggaagtatgtgtgtgtgtggtgtgtgcatgtgcgcgtgcgtgttgcatgtgcatgtgtgtgtgcgtgtgtgtgcatgttggggaggggcaggccaagatccctcacctcacctatcagctggggccgcccagcagcccacacccaggccatgagccccgcgtagcctgtgtcctttatgatggccatgggctttctcctcctcctcggccagggctgggacttgcctcatttcctgccgcaacctccccaataaagctgcatctccccatcaccagctgctcagctgagtaacaaagcaaacaggcgtccaggctgccccaggcccaagctggtgggcagggatggggaggagacgccccaccagacgggcaggcccaggccatggttcagccaggccagttgggctgagcttccctccacccacctgcaagaggggccagagccaaggacccccagcttggagtcccaccaccccaaactcacagacaaatggtggggggcattctcggagctcccaggcaggtggggctgtgtggaggaggtggtctcactgcgtaggggacccaccctcgcctttgagaggctgacagtgcatgtacaagcatttcctctgagtgaggccccgtgggggtatccagagctgaaaactaccagacttgcttattgcacactgtcagttgtaaaacactttggttttcacaaggaccctctgaattcgatagggcttctctgtcaaccaagtctgagggaatagggctgcactcagtaggtgctcagtcgatgctcagaaagtgtgatgctggcaggaagtgcaaaaaccgggagaacccactttttaccactgaggtcgttgtgagtataaagtgaatagccctgaaaccgttagagcagttttgtgctaaatgacttgttgcagcctgagtataacccggggaagttaatttagtctgacagggggacacagaccctcaaggtggagggcaagaaggaacaggtgaggtcccgccatgtgggaccgtgggcgggtcacttttcctcactgtacttgcaacaccttgtctgtgaaacaaggttagacaaggctattgcctgttaaagcaggcttcacggaggagacagcctggagcaggaccttgaaggctgtgtaggagttggatttgccagccggtctcctgggcgttggggggtggtggcgggtgcgggggccggggggaagtgggtggggcaggaattcttggttctggttcctcctagagggcagggagggtgggtgaagcctgcagctgcctggactgggctagagaacaggacagggccccagcctccctcaccaccatcctcagctccccccagactccactctctcgcccactccctctactccccatcaccttccgcttcttcctttgctccccggcttcctcaccccattccctctctctttcctcttctccagctgatcccctcacctgtgcccagggcccccctcatgtacactcaacccatcataaatgatttccattcaccctccatctcaatctccacaacccctttaagacatactcttgacagcccatttaacagacaagaaaaatgagcctcagagggggctgagtcactggccccagccccagagctagagagcagagagtcagggatcaaaccttttctgggaccctcccctggtccccacccccaccccgttcatgccccaccctgtgcccccagccaagcgagtggcctgtcaggtggaacaactcttcccaaagcaaactttgcacaagccgagttgccctgggctcttcctgacatttaatgccaagctccttctcctggctagtttgcatgttttcagcctgggaggtgccccctgccagattctgctctcccacctctcagcagccggggttgggggtgggtagaaaggggcctccagacttggggagggagaggctcatccttcctccccagccagggaccttagtgtgactctgctgggggtcggatgggaccgggacctccccaggattatgacggcgcaccaccaggataaagacccccctccttctccctctagctctggcacaggggagacgtggctggagggactgcccagcccggggctccagcgcctgagactggttgcggggcaaggcccaggcctctctgctcctggggtagcaagttgctttgagggctgctgggacctagctcctcctgccccaccctaccctctgtgccaggacaaaagggggatgtgtctctgctgacacttcacaggtgggaaccggtcctgataaccccttaataacccactcccacccatctcaaccttgtttgaagcaatttctgttcttagcctgtcaggacagttctttctggacttttctcatctgtgatgttggagtccttcactttgtcctaacacccctctccaagcctggaggtgtgctccagggcctgaggatcagggcgcaggaatgttttttcccttcagcccatcaagattttacagaccaacaaccaggtgtgtggagggcctctgccttccctggcctgtgctgggtctggaggggccgcagaaacacggcagatggagacagcagtcaccactgtggacacacacctctcgggagacagtgaagccttctcacatcgctgtcctgcctggtgacttcaaaatccagacacacagctgtctttatgagtccctgtttcactgctgaagaggctgaggccaagaggatcggccaaggggcctcaggcaggagcagcagagctccggtgacatccgtgtgttctcatgccctcaacgaccctgctgggcagggctgtggggagcaagagacccaggaaacctcacgacccctgtcctgtggcaagctgggaggtacggcgtatgcggggctggaggagggtagggaagagggaaggtactgtggccggcccttcaaggagtgtaccggcgatttgggggtgaggacgagactgtgccagagaggggcagccatgtgacccgggctgcatcatggcaaagcggggatgtgcaggtggtgggggtatggcagccttggtgtggctaagaggcctgacgggggcactgagaagtgaaatgtatttatatacacatgggctcaaccagggctgaaggaagacgtgaatggcaatttctggaaagccctgaaggttgagcggaattgtagttgctatggtgggaaactgggttctgtccccgccccgtcagcatgactcactgcaagccccaggtttgtctgggctggggtccctgctggctggaggaggcggggaggcactgctgctggggtgggagccaggcctgatgggcagctggtgaggtgcaggacagcctgaagctggctctgcttcttcagaagggtgggctgagtctttcagagcctccagacatcaactccagggacagccacacccctcatcctgccaaaagtgtcagctgtaaatggagtatgcctttgcttacaagggagccccaggtgtccacctctgcgtccccaccatccttctttaagtccccaaagccaggctgatggcaagatgagggtcatggatcgtaaaatccaggcagtgccagggctaacaaagtcctcagagatgacctggcctacagagcaggagactgagggctggagggaccagggactcacccagggtctctcctatggagggaacagggcagggtgtcacctgcacctcctgaagtggaggtcttcgttctttccagtccacatccccttttggagtaaactcagccacgatggtccacttggggctgcggtgggcctctgtacctccaggctgcgggcacctgtgctacccacaccccactaaggcaactgctgtggggctgggttggcaggtggcctgagcagaggcaaaggggatggtcaacaggggcaaccttaggagctagaagatgccgggtctgccagcaccagcagaaaggagggtggagccgagtcttgagttcgagtccctgctcactcacgcatggacaggtgccccgtagcaggtcacagcgcccttgtccgtcaagtgggaataatgctggctgccccagctgggagggcccggcaaagcagtttattcagtttgaccttcctcctgtcccagaaagcgctggaagtagtgccagtgagggtgtgtgtggacacccaggctgcccatgcagcagggcacagaggaggcttcactgatgcaatgtgttcctgctgcccgtgggaactgtgggaagagaaaaaccactgggttcccctggcgctccactttggcttccagtgccccgtcttcctgctacgtggccccgcccccagcttccacctgcctcccgccccacaaagcctcacccactcccctgtacttcccccaacagaccccagctcctgggcccactagctggctccccaaggtgaaactcacacagatcagggctcctgaagaagttgttagggggacagttggcctggacagttttgtgcccagaggaggtggggaaagcccggagatctagaagaaacccacctcgtctactcatgctgagtccaagacagcaagatctctctcactcagtcacctccctgctctcttcttctgcccttggagaccctggggaagcaggtgcttggagatggccacaatggggtgcttgagagagggcaggagctgctggcccgaggtggcagcctgggcccccttcctgggcagcggggtggtctgtccagcgggcagaagtggtgctctgggcagtgaatggagggccgtaaggaaggggtctggcacttctcttgggtccagctagtttgaagagcagtttgaagggtgaggttgcagcaaggtcctccctgtggaagggttggaggagcagagaaggggtgggaggaacagcagggcaagagagaggctggggccccaaggggatggggcagggcaggggtcagggtgtttggagaagccagacatgctactgcggctgggcctggtcatggctttggctgggacttcctgaggcctgggtagcccagcttttctccaaggtgctgaccagggcaggcccatgtggcccctgcccactctgcatggctcctggccaagacctggcctcacctccacagcccctgactccagcccatttaaggggacccagggacttggatggatggagggaggggctgacagacagctcagtaggccacatgggaaagccagaggaggtctgttccccatcagacctcttcctcctgcagtgaggccggctgggggctgagcagcagggccagagtggccatctctgtcactccctcagtgctcttctcaatggggactaaagctggggtcttgggctctgggcgggctggcattgggtctcaggattgaggtaggggtgaggatacatttaccccacaccaccatctccccaggaggtagggcctgagagccgggaccaagcaggatatggaagacaggctccaacccgcacagcgacctgggtccttagcaaacgcctcccaggtgactccattcccggaaactgtggttcgggagctgtcagggagggcatcttttgctgatgccagttggggtgtgggagtgaaaacctgggaggcaaagggttcaaggggcacatttctagccccgaggggtgagagtaggcagggtagtggcaggaaaagctgcactaaatctctccttttgggtccctctgctcactttccttaatcttccttcctgggggaatggaaggcgctgagagaaggggcccaaggtggctaatccccctggccgccaccccaccattctgctcctgtctctgggccttggcctccaccagctgttaccaaactttctttgtctggagtgggatctggggcctctggagcaggagggagccaggacacgctgagccttaatccagacatgtggcttaatccagaagagatcaactcgaggtttgggagctggaggcatcgctcaggagacggcagcccgtgggactggcaggccaaggctgcaggaacgctgggtcctgccatctgaggaccctggacatggcagacacctggcacgtcccaggacccttggcctacggagcagtggcctgagtgtcaggaggcctctggtctggccctggctgtgctgtgtgactgtgggcacctccctgccactctttgagcctgagcttttccagtgcacatgtgtccccatgggtggaccatcactgatggatttaatcctgggctgaattgcatggcacagatgaggcgagcctaggaagtcgcaggagggagctattagggagggctcgctggggcaggagggctttgggatgaattgtgatgagaaggaaagggcatcttagaaaatagccatgttgtgcccacagcacaggggcaggtatgaaatgccattctcattagagcttggatttgtggtcactatgtcaatccctggttctggtccggaccctgctgctaataagcacatgaatcccttccccactctgggcttcattgttcccattctatgaaacaatcacataatatatggccccttccagctctgattatctgggccaggtaggaggtagactcagaggtaggcaccagccactgggatggggcaatggggagccatgggagattcttgagcacaggggtgtctgatgaaagggtgctgcagggatatgaacagtggggtggaatgaagagccaagaggtggggacagactttagagcatcaaggagcccagtcaggaggtgggcagatcccctaggaagatgggactggccagagcatgcacctcagagagaatgtggtccagtgagcagaacccacacctggccaggaagaaccctggacaagctgcacagcctccctgagcctcactgtccgcatctataaagcagggctctggagtccacgtcaccctggctgtgggtaggaaagcgggtgatgtgggtgaaagcctgggcgtggcactggtgctcactgccaggggctcacagtgccgttctctcttcttccctcctgaggccagcccagaaccttgagacgcctagttgcaggttgggcacaccagccctggctgcctgaccagtaagccaagcccccctactctaggcctgggctgccttggggacggagcattccccaccacccctgatctgcagagagtcgaacctttcctccaaccacacagttaaccattaacttatttttcatcagggaagtgttggagctaggaccgaggcttggtggggagtagattccttggcatttaggtatagggcaaggtcaagctggaatgtggggtatagagggtgaaggagcccgagccaggagtcaaaagacctggatttggggatttacctctctgcaccttgacttccccattagcaaagtagggatgagaataagacctgggccagatgaggtagcttgtgcctataatcccagcagtttgggaggctgaagcagggggatcacttgagcccaggagttcgagaccagcctgggcaacatagtgagaccatgtctctacaacagattttaaaaattagccaggcatgatggcacacacctgtagtcccagctacttgggaggttgaaacaggaggatcacttgagcccaggaggtcgaggctgcagtgagccatgatcatgcccctgcactcgacagagcgagaccttatctcaaaaaaagagagagtaaggcctgtgctgcctttctcctggcaaggggatggatgtgagggcttcacatgcactcagcaaatgtgtcaaggatgtgtcattatatgccttcctggcaaaagctgccacctgccctgcccattcatccccaccgaccccacacaaccatgcctgaaacacagcagctgcctcctgtcctacctgtggctgaggccaagcaaacaggagggccacaagggaagcgagttctgcttcttggaaaagcttctgtctccctggcatggcgcccagggtgttggcagagactgtcctaacgtggcaggcatgggggctctggggatgtggacggggcaggaggcaggcagggggtgatgaaggaggggtggggggctgcgggggggggtccccaggggtggagccacctagcgggtagggcatgggcaccaggcagggtggggcccaggggcagagcgagctgttggcactgcctgagtaaataatgtgggcccacagcacacacgagtgtttgcacagaaggacttgaaatgattccaggtctgccctctgtcccccacatccccagccccgccttggtctctgcccaccccaccccaccctgacctttccttccttgtcacttaaaggagcccttgaatgggagagttgaaatcaaagggaacacccttccctcctgctggcattttctccaccacaggaagctgcagggctgccatgtaacactgggaaggttgggcactgcacaaggagggtgggcagaggaagctgaaattctacctaggctccattcgtcaagctatgctatccagggggaagggatgtcattttctgagttgtgtgaaattgaatgggctagctgtggccctaccgaagtggaggtgtcttccagactgggttctttcccttgtcccacctgcagaagcaaatgccagctgcatacggaggctgcgcgggtcagtctcacagggtaactggagatggatcagggagcccccttcccctcctgctgtcccagtagggcaccataaatgtcactgttagagaggatttcagtgctttgattaaagccttccccccaactggccagttacctttaaagcaaagatcctcaaatttgaacatgcacgagaatcacccagaggccagttaaaccagactgcggagtctcccccagagctgctgattcagtggctgtgaactgcctgagaattcaagtttctagcaagctccgaggtggcgctggttctgctggcccagacggcacatttggagaaccactgcttgaaactataaataaccctcgagaaaggacacaaattaacttgcccttaacaggtttatctgttcctttcctcctccctaactggttctctgtattattaggagcgtatatctgttggtaatcttctgcctctggcttgacgtattctttgtgtgtgtgtgcgtgtgttttgttttttttttcgagacggagttttgctctttcacccaggctggagtgcagtggcacgatctcggctcactgcagccgcctcctgggttcaagtgattctcctccctcagcctcccgagtagctgagacaggagaatcaggcacccaccaccttgcccagctaatttttgtatttttagtagggacagggtttcaccatgttggccaggctggtctcgaactcctggcctcaggtgatctgcccgcctcggcctcccaaagagctaggattacagtcacgagctactgcactgagcctgtcttgatgtattcttaagtctcaggcccccacatcactgccatcccagaatgtcctggggtttcagtgcttgcgcacctctccagtcccccttctcacccaaactgtgcactctgctattggtttcagggaaaagggcctgggcaaaaccaagccggggcggcccgtggggagcaaggcctctgactgcttgtgttgaggccagatggttcccccggagggccttggggcagcagtgaggagcaggtggctgagttgctaagggttttaggtgttccctggagccctgccccatctcacaaccaccctggctcctcctggaaagcctggcatgtggcactgcctccgggtggccgcatgctcctccaggcatcggggaaagtagagagcactgggagctggaaggggccctgggggcagcaccttctgagggagggtaaggggaggtgggtaccatgcacccagcctggggtattgggagacacacacctgtgagctcttgctcagtggccaccttgagagtgttgagtttacttagatcccccagatagccctgtgggagggcaagggctggcctactccccggcgtgtgggagggtttctaccccgccttgttcctctcgtctttcccctgctggtgaagatgatagccacctttaggatggtggcctctgcctgccacttccactcctatccttgtcaaaggcagaagaaaaacaagctttgctatatcaggaaagatttggacactgagggccccttgttcccacctcagtttgctcatccgccaaatggcgcaatcatgccttccattgtgagggctgaatgaggtcaggaacctcagaaggctgttttaagcacagtacatgtgtggagctttgctgctcccagccagcctggcttccttggggattgagggagcgatctatttctagtcctgcacccactcccacctcgctgtctttcccagccagaaggcctgtctgcccaaccatgtcgtggctgcccaatgacccggaagcccccaactctgtcccaggcccagcccactgtccacagggcccctcatccccataaccagcttagcggcccccacagggatggagaagcagtcaaacctgagtcctctttcatttccgtagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcaggtgagccctctccatgtgcctgcttccgtaagatgggtcacaggcaaggctgaggtcgctggggtgggtcggggcactgctggatggactctggccacctctggcccagcctcgggcagctttggggatgctggcacttctacacacagtcagctgtgagcctgggccaggaaggtttctgtccacctctagtgtcccaaccatgccagcctagggtccccactggtaggtgctggatgatatgaattcaagctctgtgtcccccacctcctcttggacttcgctctcccctcattcactctgctcccgccacactggcctgtttgctgttcccacaacatttgctacgctgctgcttcttcagcctagagcgctcttcccccaaatatctgtgtgactcacttccttcaggtcttggctcagatggcaccatccgcatgaggccttccctgacccctccattaaaattgctgcccatgagcacaggacatggtaaagaaaacaaacaaaaaaatgaaaaataaaagaaagaagaaaaatttctgctcacatccctacctgctgttctcacctgcttcctctcatagcacttacactcctcggacgtgccgcaccatatctgttgatctcgctcactctctgtgtcctccactagaatgtacactccacaaaggcagggattttcatttgttttgctcatcaatccatccccagatgctaggatagcaccttgaatataactgatgctcaatagacagttgttcaataataagcatttcttttttttttctttttcttctttttttttttttttttttttttttgagatggagtcttgctctgttgcccaggctgcagtgcagtggtgcaatctcggctcactcactgcaagctctgcctcccgggttcaagccattctcctgcctcagcctcccgagtagctgggactacaggcgcccgccaccacacccggctaatttttgtatttttagtagagacagggtttcaccgtgttagccaggatggtctcgatctcctgacctcgtgatctgcctgcctcggcctcccaaagtgctgggattactagcgtgagccaccgcgcccagcctcttcttttttttttttttttttttgacagggtctcgctctatcactgaggctggagtgcagtggtgtgatttcagctcactgcaacctctgcctctgggttcaagcgattctcctgcctcagcctcctgagaagctgggattacaggtgtctgccaccacaccctgctaatttttatatttttagtagagacggagttttcaccatgttggccaggctggtctcgaacttctgacctcaggtcatccgtctgccttggcctcccaaagtgctgggattacaggcatgagctacctctctgggccgaaaagcagttcctaatatgccaagccttattctaggacgggggaattgagtggtgaacacaacacagcccctgtgttcgtagggctgacatgatagtgagtgacacagatcacaaataaatagagaaatgtgtcactgttcttgtgggacggaaggccccgatgaggaggggacctcctagggcctggcatacatgtgtctgtcagccagacctggaaggcgtgattatggagctgatgctgtgggtggcggggctgctgagtctctagtcctctgtcctgctgtcgcctctccagcttcaggcagtcctgacccatgtccctcatcttcaggccctggcattgcagcactgaactctgtgcagctttccctgggaagcaggggtcttcatgcatccctcaggcccggcccctgcccccaaagctgccccgttgacgtcctcatttgaagctgctcctgccgatgccccaagtttcccaatgcccatgccaggccgactccaggagttctcccacagacctcctccccacccacagggctagggaggggagggccctgctccctcaacaatgggaacagaaacaaatggctttgacctcagggaggaaaatgggcttattaagtgggggcagcccagcctgcaggtcacccagctgggacactggctggaccatggtgttcacttggaggccccattgtgaccatgcccaccagcctatcccccacctataggcctatgaggctcaccccagagcagcaccccagggggacatctaggacctagccaagggctcccctcctggcctctggggcctgtggctgccccatggccaccctgtgccctgccatttacttattcaacacatgtgcctggagcagctcctgtgcgtctagccctttattccgtggaggacaaggggatggagtgccctgtgcctcagtttcctcatctgtaagatacaggggctggagagaatggtggggttctaagactaattcccaggtaggtgtttctctggttccttgaggggtttgggaaaggcaagaagtacctgatggagaagcccaggtgtttctggtagagtgtcactgtccctctagggctgaggctccctcgaaaggtcctttggagaggctggagggatctgggaggacccaaggcctgggtgaggcgggcagtacagatgcaccaggttaccctgccctgaaccaagttcattttttagggccctggttccttcctctcgccccactctcttcttgggtacccacttccacaggggccctcaggggcctgtctggggctgacctatccccatccccaagagcacatggtctcaggccacaggttcccatgggtgccccatcacagcagggtggtgctctcaggccacccctgagctgaggggatgcctcttgcccagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcaggtaggatgtggcatggctgggagcagcccctcccaggctccaagccagggacaggatgctggctaggaggttgccctctgctagggcagcagccccttggcccccaactggactccactctgaatctcagccccagtttcagctgcctcctggatcctggtgcactcttcaccccaacccactcccagccctggtcaaggccccagagctttgggacagagcacctgggaggttaaaaggtagaagtcagactgtgaggatgcaggatgtcagagctggggacaaccgtggatactaggaagtcctttttccttttaaaattttgtttgtttttctttgttttctttgtttttttttattaaagaagtaataaatgtgcatgttataaaatagaccacagtgaaaagtagtgtaccatgaacagtttccccctcccgctcccgacccccagcttccaatcccctccctagagggaaccactgttacaagtttcttgagtatctttccagggaaagtctatgaatactcgagcacatttacatatatgcagttcttattcttttttttttttttgacataagtagtagcagagtattacactgctctgcacaccacagtatgtcttgggtattgcccctgtccgtgtccacagtggccctgttttaattttagtttttgttttttgagacagggtctcactctattgcccaggctggagtacagtggcacagtcacagctcactatagcctcgacttccctgtttcattggatcctcccaccccaatctcctgagtagctgagtctacaggtgcaccaccacaccctgctaatttttgtattttttggtagagacgggttttcaccatgttggccaggctggtctcaaactcctgggcttgagcaatccacccacctcggcctcctgaagtgctgggactacaggcatgagcctccacgcccggcctgccctaaatttctaatggctgcgtgtcagcccctgagtgtctaaattgtcttgatctcagtgggcacccactgctgcctgcacagggccaggtgctttggaggaggtggtgcctgagtcaaggagtaagaaacaggaccaactcataggaccctgtcagagaccagtgccccgccccagcccaggcaagcccccatgtcagatgtcctcatctgaacaaggggttgcatgcaagccctttacggcccctcccagctctgaaatcctgaattttcttccaggaagcagcttcttgtaaccagcttgcctccccaggttggcaggaggcagggagccacaggggcaacccccagccacagaggggctcctgtggccccacagtcccacccaaacgcctcccctcctccaccctcggggcctctcctgggtccccaaccccctctccttgccctgcagcggcctggatgaaagagcggacttcacctggggcgattcactactgtggtgagccaggcagcggcagggtggaggcgggggctcgggtggggtggaggggtggctgccaatgaagccgggactggcctcccattcccactcaccgccaccctccctggccacccagcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggtgagcagggtgcccaaggggcgctgcagggccagtgagcatggaggttgtgggggcttctgccaggcacggtgcatgggggcaggggcgggcagaggggtgaagctgatccccacctttgtcctagatgccaaatatgcagctctcatgggacagccctggggtctgtgtgcaatctgtgtccacatctgtctcctgctagactctgtctcacttaggagttttagtactgcacagcacctggaacgagctccaaatccactctccctccaccatctcatattaattaatcctgccagagagggctgcacaggccgaactgcctgagaatagcaaagaggttgtttcaggcttgggaactacagagacacctgtaatggggaagggatgctcttgccaagtgagccgtgggcactgctgggagccacacaggactttgcattaggtcatgcaaaccccacacagaagcaggagttggcaagggccaggcctgcagggccccagggaacccactaaggtacacaggctcacctgtaccgggaggtttgtgactccagagtattctctgccattcactggggcctgtggcacctgctttgcacacgtctctttaacctcaccgcaactacaccttgggagtaggcatttgggcccccacaccccgccccacccgagcagggggaggcctctgcacggggtcccttggttcgccacgaggctgacctggtggtctgcgtctttctccttcttgccacctcactcataccactggctctctcggggccctcctgctctaggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactg

SEQ ID NO: 38594 - DNA, 34339 bp, Homo sapiens
agccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggtgagcgccgggacaggtaggggacccaggtcgggacccaagcgtcagtcccgttctcgcccacagctggggcgccccgggaaggattcccgcgccaggccctgcccggaggggcgggtccctgggagtcccataacccgcagcgtcgctttcccgggccctccctcggcctgaggctcctttaaacccaaagttatacaaatgcacgttagaaagccctaaatctggaagggctttgctttgaacgtgggtgttcgaacgcccaggcctctccatccctgcgctcgtccgcggaggccaccatccaaaacccctgccaaacgctgcaaaccaacacgtgggcgcaacagcccggggaaggccaggccgctttttaccgttgctggattttctgtcttctggccgtcagtcccttcgcagaatctgtgaatcagaagccttggagggcggtttctcgatttagcaacttgggcacattatgtgtttcgctgcggccccaaccctcaatttaaattttgttctgccaagttacttttgcaatgttcagtgatatgttcgaaagctctgtatactgcctcttcaactttagacagcgtctatttactccatattttgaaagacaaatattatgggagtctagttgtaaaataaataatacttctttaaaaatgttccagtaatacacgacactcagacacgtaggacaggacagagctttgcatggaaaacaacacgcctttaaacaacaacctctccctcaccaccgcccccaacccctgtcggccaaatacatttttttgttaactacattacttttcaaaaatggcaagaagtaactcgtgatcgctggtgcctcgtttttaactttttccactttttattcctctggtatctatttccaaatctttacagcatatttttggattgttatttcttatttcatcaacttttagacaacgcgtccatggatcccttgctaaaaataggagacaactttgatcatctccgtggttttcctcctccctatataatcacctccctgtatagtcaggacattactttcggcttctctattggctacttttctaacataaaataatttttttaacttgtatttattgttccattaaatatacctagtatctgttgactctctttttgtaaggcttggctaaggagcttctttttaaaaaatatatttttaggccgggcgtgcgcggtggctcacgcttgtaatcccagcactctgggaggccgaggcgggcggatcacctgaggtcaggaattcaagaccagcctggccaacatgaaccccgtctctactaaaagtacaaaaattagccaggcgtggtggtaggcgcctgtaatcccagctactcaggaggctgaggaaggagaatcgcttgaaccctggaggtggaggttgcagtgagccaagattgtgccattgcactccagcctgggtgacaagagcaagactctgtctcaaaaaaaaaaaaactatatatgtacatatatatatgtgtgtatatatatgtgtatatatatatatgtatatatatatatacacatatatatttgagaccctgtctcaaatcaaatcaaatcaaatcaaaactgtgttgcccaggctggagtacagtgtcgtaatcatggctcactgcagcctcaacctcctgggctcaagagatcctcccacctcagcctcctgagtaactagggctacaggtgcacgcccccccaccaaaccccactaatttttttattttttgtggatacggggttttgccgtgttacccaggctggtctcgaactcctgggctcaagccatctgctcgtcttggccatcaaaagtcctgggattacaggtgtgagccaccggcgcccaaacaaaaagatatatttttaaaataacatttttgtatttatgtaaatattaatttcttcaattctaatcaaattctacatatggcttagaaatcaaatagaaaagtttgccttaattttttctataataaaagtatgtaatctcttttagaagaatggaaaacgaagtgttttagattaaaagagatgagtgagacctgccacccccactggtgtttgagcccccacggggatcttgttaggaggaaacagccacagaagacctgctagagacagcaggggaaattgttcacggagtgggtattgatggcagaatgaatttttgaggcagaatctctctctgtcgcccaggctggagtgcagtggcacaatctcggctcactgcaacctccacctcctgggttcaagcgattctcctgcctcagcctccctagtagctgggattacaagcatgtgccaccacgcctggctaatttttttgtatttttagtagagatggggtttcaccgtgttggtcagcctggtctcgaactcctgacctcgtgatccacccgcgttggcctcccaaagtgctggaattacaagcgtgagccaccacgcctggccaggttgcccttaatcttaggagattcattaggaagtactgaagagtagttcatcaaggccgccaggccggtgacttatgcctgtaatgccagcactttgggaggctgaggagttcgagaccagcctggccaacatgttgaaaccctgtctcgacaaaaataaaaatttagcagggcatgatggcgggtacctgtaatcccagctacttaggaggctgaggcgggagaatagcttgaacccaggaggtggagcttgcagtgagccgagatcgcgccattgcaccccagcctgggcgacaagagcaaaactctgtccaaaaagaaaagagagagtgcaaatatggcaaaatatggagcagatagtgatgttcatttgattactctttcaacttgtctatagaatgaaatttcatagtaaaaattgggagaaaataaagtaagattattttgaaacaaagaaagagacagaagacatgtatacagtagcacaaactatggagtccaatataccaagattcaaatcccagcaggttttttttttttttctttgagatggggtctcactctgtcgcccaggctgcagtgcagtggcacaatcacagctcactgcaaccttgacctcctgggttcaagcaattctcctgcctcagcttcctgagtagctgggattacaggtgcgtgccaccacacccagctaatttttatatttttagtagagatggggtttcatcatgttggccaggctggtctcgaactcctgacctcaggtgatccacctgccttggcctcccagagtgctggggataacaggtgtgagtgagccactgctcccggcctagtttttttgtttgtttttttctatcattcttttcccttggtcccagcttataaaacccaccattctcttactacccagtgggggtctcagtctgttttgtaaaatggaggctgccccattcaagaatcttgaataaaagcccattagatctataactaaatttgttgtaattttgtcttttgacatggctctgttgcttctttgttgggtgaccttgggcacgttgctgtcatcctccaagcctcagtttccccatgtgcctacttcatggggtggtttgaggcttctgtgagattttgtaaagcaattcccacatgcctagagcaaagtaagtgctcagttaacagtagctgttagtattctgtgaaggcatctccttaactattatagcctgttcacctatgactaacactgtcaacataactgctgcagctgggccctttttcttttcttctttttttttttttaattggcacagggtttcactctcacccaggctggagtgcagtggcacagtcttggctcactgcagcctcaacttcctgggctcaagtgatcctcccacttcagcctcccgagtagctgggaccacaagtgcacaccaccatgcctggctaattgttaaattttgtttgtagagacaggggtctcactatgttacccaagctggtcttaaactcttgggctcaagccatcctcctgccttggcctctcaaagtgctgggattacaagcgtgagccacagcacccagtcaccacccatttttctagggatagatttggaacttggtattttctttttccttttgcaaattcaacgaatgatcgtgccagaggttcagtttttgtcctgctgtgtttcgccttgttttttcctaagcgtgtctgtccttatcccacattcttctagtctctgatggcagcatatggaggtgcccacgtggactcctccaatcccatagctgggtgtttgctgctaatcatagtaactcctcacagtggcagcaaacatttgtcgagggccagaccctgatctcatgaaatttccctacaaccgtgaggggcaggggttattagaggtccatcatctctgatccaaagctcttggggccagatgcatttgggagtctagactttgaattttttttttttttttttgagatggactctcctttgtcacccaggctggagtgcagtgttgtgatcttggctgactgccacctccacctcccaggttcaagccattctcctgcctcagcctcccaagtagctgtgattataggcatgcaccaccacacccagctcatttttgtattttagtagagatgggtttcactatgttgaccaggctggtctcgaactcctgacctcaagtgatctgcctgccttgacctcccaaagtgctgggattataggcgtgagtcaccatgcccagcctagactttgaatattaagcaagtcatacggagcccatttggtatgttacataagtcccctagtagggctgaggagcatttgtgtaatcaaacactaataggccttcagtgaaatgcacgttcattctcaggggagtaactaaagactatacaaaacctcatgacagctcaagtcagctcctgccaccaaatgggtctgggaaaaactgttggttttctgagcttttgaacatgtagattgtggatgacagatgtggacctgcatatttcccatcttgcagaggggacatcctcacacacgaagagagaaagggccagccgtggtggctcacgcctataatcccagcactttgggaggctgaggtgggcagatcatttgaggtcaggagttctagaccagcctggccaacatggtgaaaccccatctctactaaaaacacaaaaattagccaggcatggtggtgtgtgcctgtggtcccaggtccagaagaggctgagtcaggaggatcgatttagtccagaaattggaggctgcagtgagctatgatcgtggccatgcactccagcctgggcaacacagtgagaccctgtctcaaaaaaaaatttttttttttttttgcttttgataatcattcatgttctgggtacttgtggcttattccttattttgtatttgtattatttataatatttgtatttgcaatatttgtattattgtgctatatagtagtccatcttatcttattaatgacttatttgtatgtgctacagtggacaggcatctgggacttttccaatctgaagctgttaggaacaccaccaccatgaatattcttgtatgtgttttctggctctggggtggagttgctgggtcatggggcaggcacattttcatttttacttcagtaaaaaatgtccagtgggccaggcacaatggctcatgcctataatcccagcacttcgggaagccaaggcaggaggatcacttgagctcaggaggttgagaccagcctggccaacgtggtgaaaccctgtctctactaaaaatacaaaaattagcagagcatggtggcagagtagctgtaatcccagctacctgggagtctgaggcacaagaatcacttgaacccagaaggtggaggttgcagtgagtcgagatcatgccactgcactccagcctgggcgatagagtgagattcagtctcaaaaaaaaaaaaaaaaaaaaaaaaaagcccagtggtttccaaagtgattccaaatggattccaccaggaatgtatgggagttctctttgatagtatttttagtgaattgcagtaacattgcactgttttgtgtttgctcattttcttttttcttttctttctttttttttttttttggagatggagtctctgtcacccaggctggagtgcagtggcgggatcttggctcactgtagcctcaacttctgggctcaagcgatcctcccacctcagcctctctaataactgggactacacacacacgccaccatgccctgctaatttttttgtagagacgggggtctcactatgttgcccaggctcgtcttgaactcgtgggctcaagcgatcatcccaccttagcctcccaaagtgctgggattacaggtgtgagccatcgcacccagctgtacatttgcttttacattgtcaaggtggaaacatctacagtctgttctgtttccatatttaagccctacatgctttaattgcaaagtttgctgtgtttttttaatcagcttttttgaggtgtaatttacataccaaaaaattcagccctgttaaagtggacaactttgtggcttttagtgactttacagagttgtgcaaccatcaccaccgtaacaaagcatgttcatcacccccaaaatatcccttgtgcctatttgtagtcactctgttcccagcctagcccaaggcaactactaatctactttctgatcaaaaagatttgtcttttctggtcatttcatagaagcacatcatataatatgtgtccttttgcatctggcctctttcatgtagcatattgctttggagtttattcatactatagcatgtttattcctttttactgcttaaaaatattctattttgtggacatggcacattttatatatccattcatcagctaatagacatttggagtgtttccaaatgtataaagctgctatgaacattagcatatgagagtttgcatggaggtagaaggtgtattttcatttctcttgggtagataatctagtcgtagaattgctaggtttcatataagtttatgtttaactttttttttaatttttttttttttttagagacaggctcttattctgtctcccaagctggagggtggtggcgcattcatagctcactgcagcctggaactcctggactcaggggatcctcctacctcggcctcccaaagtgctgacattacaggcatgagccactgcacccagccatgttcaacttttttttttggagacagagtcttgctctgttgcccaggctagagtgcagtggtacagtcttggctcactgcaacctccacctcccaggttcaagtgattctcctgccttagcctcccgagtatctgggattacaggcgcctaccaccatacccggctagtttttgtgtttttagtagagacagggtttcaccatgttggccaggctggtctcgaactcttgacctcaggactcccaaagtgctgggattacaggtatgagccaccgagcctggcctcaacttttaaagaaactgcctaatggttttccaggttagctgtacatcttacatccccaccagcgatgcctgagggttccagtttctttatatcctcgactacacctgtcagtatcgtcagtttgagtaatagccagggtagtgggtatgaagtggtgtctcattgtgaatttaattggcatttcccagctgggcatggtggctcatgcccataatcccagcactttgagaggtcaaggaaggaggatcccttgatcccaggagttcaagaccagcctgggcaatataggaagacccatctctatagaaaattcaacaattagctgaatgtggtggtgggtgcatctgtagtcccagctacttgggaggctgaaatgggagactcacttgagcccaggaggttgaggctgcagtgagccaagatcgtgccactgcactccagcctgagcaacagagaagaccatatctcaaaaaaaaaaaaaaattgcattttcctaatgactaatgaagtggagcatcatttcatgtgctcattactcatttgtatatgttctttggtgaaatgtctactcaaatcttttgtctttctttcttttttatttttatttttttgagatggagtttcactcttgttgcccaggctggagtgcgatggcgtgatctcagctcactgcaacctctgcctcccaggttcaagcgattctccggcctcagcctcttgtgtagctaggattacaggctaattttttgtatttttagtagagacagggtttcaccatgttggccaggctggtcttgaactcctgacctcaggtgatccacctgcctcagcctcccaaagtgctgggattacaggcgtgagccactgtgcccggccttttgtccattttttaactggtttatctcattgagttttatgagttatttatatattctatacacaagtgctttatcagatatataatgtgcaagtacaaaagttttaacttatgataatgtctaatttatccagtttttcttttatgaatcatagtttttggtgttggatctaaaaaatctctgcttaacacaagatcatgagattttctcctgttttcttctcaaagttttatagttttaactcttaaatttagatgtatgattaatttcatgttgattctggtatgaggtaatagtctaaattcatctttttgcatatagatttccagttgtcccagcaccatttgttgaaaagagtctttttcccaagaaaacccgtaagtaaagccaatgtaaagagaatgcccctagcctccaggtcaaaaggattccttttttgtgaactttatcaaatagctgtaacacagatacagttttatgtttttcctagaatttctcatagctttaatttttccattttgaaagaggcgtttttctgttagtaactcatccaatccatttctttggatttctttttcttcttgtagacattcttccttttatagtatcctgttcttactctgtttagaacatctttgcaaatctaagtgttcccaggactagctacataatttgcatggcccattgcaaaatgaaaatgcaaggtcccttgttcagaaataattaagaatgttgaggccaggctcggtggctgaggcctgtaatcctagcactttgggaggctgagacgggagaatcatttgaggccaggagtttgagaccaacctgggcaacatagtgagaccccatctccacacacacacacacacacacacacacaaaatttttaatttaagagaatgttggccgggcatggtggctcatgcctgtaatcccagcactttgggaagccgaggtgggtggatcacctgaggtcaggagttcgagaccagcctgactaacatggtgaaaccctgtctcaactaaaaatacaaaaattagccgggcgtggtagtgcgcacctgtagtcccagctactcggaaggctgagacaggagaatcgcttgaacccagaagtggaggttgcagtgagccaagatcacgccactgcactcctgcctgggtgacagagtaagactccatctcaaaaaataaataaataaataaaaataaataaataaaaagaatgttgaggctgggagcaacggctcatgcctgtaattccagcattttgagaggctgaggtgggcagattgcctggggtcaggagttcaagaccagcctgcccaacatggtgaaaccccgtctctactaaaaatataaaaattagctgggaatggtggctcatgcctgtaatcccagcactttgggaggctgaggtgggtggatcacctgaggtcaggagttcaagaccagcctggccaacatggcgaaacctcgtctctactaaaaatacaaaaattagcctggcttggtggttcgtgcctgtaatcccagctactcaggaggctgaggctggagaaccgcttgaacccaggaggtggagattgcagtgagctgagatcattctgttgcactccagcctgggcaacaagagcaaaactccatctcaaaaataaataaaaataaaaatactaaaattagccagatgtggtggtgggcgcctgtagtcccagttactcaggaggctgaggcacgagaatcacttgaacccaggaggcggaggttgcagtgagctgagattgtgtcatgcactccagcctgggcgacagagagagactccatctcaaaaaaaaaaaagaaaagaaaaagaatgttgagatggccacagtggagcattgaaaagagggtgggccacatgtgaacgcacaggttgcatgcccatgaagccagtcctgagtgtaccagttagggttttttcttttcctccatgttcttttggtcctgtgaattgtctgtttcctctggggtcagttcactttccttctgcttgtttacttaaatgtttctctttcaggctgctagttttcttaaacatctgatggtccttgctatcccgccactttttcaaacaagaggctgggtgactgtggttttttgtttgcttgtttttaagtcactggtatgacatttggggctgttataaatacagtcctttcccactggcctcttggtcaagttggatggatgactgtgaactctgtgttctgtggacagcacttgttcatgttagcagggacaaaaacagtctttgtgctgggagctcactcccggatgccagatggggagggctttactcagtaacaccagcagcatccacacttcccaggggctgcatgcaatttttttttcttttctttttttctttgaaatggggtctcactctgtcacccaggctggagcacagtggtgtgatcatagttcactgcagcctccacctcctgagctcaagcactcctcccacctcagcctcccgagtagctgggactacaggcgcttgcaaccatgtctggttaattttatattttgtagagatggaggtcttgctatgttgcccaggctggtctggaactcctggcctcaagcaatccccctgcctcattctcccaaaatgttgggattacaggcataagccaccatgcctggctaaaatagttaaaaattaataagggatgggaggctgaggcaggagaatcgcttgaacctgggaggcagaggttgcagtgagccgagatcacgccactgcactccagcctgggtgacagggtgagactccgtctcaaacaaacaaacaaaaattaataagggagaatcgggtagaggaaagtatcctgaaggtatgaaaaggaaaccattctgtgtaaactttttataagattgacaataccaataccaggtgctggcaactgcaatgcatatagaatttttgggaatgcagatggcacaatcatgctggaaaactgctgggcattttcttgtaacgttaaatatacacctgccatgtgactcaaaaattctactcctaagtatctactcaagagcaatgaaaatggctggacacgatggctcactcttacaatcccagcactttgggaagccgaggcaggcagatcacttgaggtcaggtgtttgagaccagcctggccaacatggtgaaaccctgtctctactaaaaatacaaaaattaactaggtgtggtggcgcacacctgtaatcccagctacttgggaggctgaggcaggagaactgcttgaacccgggaggtggatgttgcagtgagccgagattgcaccactgcactccagccttggtgatagaacaagactctgtctccaaaaaaaaaaagcaaagaaaacatatgtccacacaaacacttgtacatgaatattcatagcagccttattcataatacccctaagctggaaacaacccaaatgtccatcatactgagtggataaacaggttgtagattatgtgttcagtggactattacccagcaataaaaaggaatagactactgattgatacacaacaagtggatgggccaagcgcggtggctcatgcctgtaatcccagcaatttgggaggccaagctgggaagatcgctgagcccaggagttcaaggctagcctgggcaacatagcaagaccctgtctcaaaaaaaatttaaaaattagccaggcatggtggggtgcacctgtggtcccagctacttgggaggctgagatgggaggattgcttgagcctgggaggtcatggcagcagtgagctatgatggcgccactgccctccagcctgggcaacagagtgagaccctgcctcaaaaaaaaaaaaaaagtatgagtgaatcacacggacattatgctgaaggagaggacaaataaccctaagccatgcctacaactcaaggaatattacaggcatgagccactgtgcctggcccagatgacttcttcacaaggagacacatactgtgtgtatcagtcaggatccaaccaggagacaaaccacacagtaatttaaacagcgattgtttaatatacagaattgttaactatgataggggatttgagtaagaggaactggttactaagaaataaagagaatgctaacgaatgtagaaatagactgggcacaatggctcacacctgtaatcccagcactttgggaggcaaggcaggtggatcacgaggtcaagagatcgagaccatcctggccaacatggtgaaaccccgtccctactacaaaaagtagctgggcgtggtggcgtgtgcctgtagtcccagctactcaaggaggctgaggcaggagaatagtttgaacccaggaggcagaggttgcggtgagccgagatcttgccactgcactccagcctgggtgacagagagagactccatctcaaaaaaaaaaggaaagaaaaagaaaaaagaaagaaagaaatagcagatacaaggagcagccactcctcctaagtctaagatagcccgagaaagatgagagccccaggctgagaccccgaccttgctggagtagtcttggccatggctcaccgaaggacaaaggcatccctatggtgcggcaccagtagaatgcggcagaagtccattcagtaagatggtggggagagcagctgacagggaagtgtctcagctgaggtgggtgctgctgactgccatatttcaggagccatgtgccagagaaacttcctgacactaaagaaaccgcacgcatgtaggagtcagaggctggagaagcatgctcgctgcaggagtagctgccctgcaggagccaagtctggaaactggaagccaaaccctttcctcctacaacgtctctccagcgccctctactgaaaaaaacttagcatcatgtcagtcagcaaaggaagaagatttaaagggccaaactccaattattatttatttttttttattttttttttttgagacgaagtttcgctcttcttgtccaggcaggaggcaggcgtaagccaccgttcccggagcttttttttttttttttttttttaacagcgtccctgggtgggctagaaccaaactccagtttcgcagcttagaacaatgaggtcgtaggttgatagccgacactctatatgattccatttacgtgaaattatagaaaagaaaaattgaatttatagtaacagaaagaagccgggcacggtggctcacgcctgtaatcccagcactttgggaggccgacgcaggcggatcacttgagctcaggagttcaagaccagcctggccaacatggtgaaaccctgtctctactaaaaatacagaaattagccgggtgtggtggtgcgcacctgtaatcccagctactccggaggctgaagtagaaaaaatctcttgaacccggaaggcggaggttgcagtgagccgaaatcgcgcccctgcactccagcctggaggacagagcaatactacgtctcaaaaacaaaacaaaacaaaacagaatagtagttgactttgggtgggagtagggaggttggctgggaagggataaaccttttggggcaatagaaatgttccatatcggctgggagcggtggctcacacctgtaatcgcagcactttgggaggccgagttgggtggatcacctgaggtcaggagtttgagaccagcctagctaacatgtgaaatcccatcactactgaaaatataaaaattagctgggtgtggtggcgcacgcttgtaatctcagctacttgggaagctgaggcggaaggattgcttgaacttgggaggaagagattgcagtgagctgagatcatgctactgcactccagcctgggtgacagagtaagacgccatctcaaaaaaaaaaagatttaaaatcaattgaaataaaattgctacattttaaacagatacaattaataaaacttaactaataaagtaaaaataatactttataaaatgaacacagttaattgaggctgctgctgtgttagtaaaacccgttcaatacaatgaaccttgaagatgaaagtatattatctgggccatgcgcagtggctcacgcctgtaatcccaacactttaggaggccaaggcgggaggatcacttgaggtcaggagttcgagaccagactggccaacacagtgaaaccccgtctctactaaaaatacaaaaaatcagcctggcgtggtggtgcgcacctgtgatcccagttactcagaaggctgaggcaggagaattgcttgaacttgggaggcggaggttgcagtgagcggagatcatgccgttgcactccagcctgggcgacagagcaagactccatatcaaaaaaaaaaaaaaagtggccgggtgcaggggctcatgcctgtagtcccagcactttgggaggccgaggcaggtggttcacctgaggtcaggagttcaagaccagcctggccaacatgtgaaaccctgtcttcactaaaaatacaaaaattagccggtgtgggtggcacgcacctgtaatcccagctactcgagaggctgaggcaggagaatcccttgaatctgggaggcggaggttacagtgagccgagatcgtgccactgcactctagcctgggggacagagcgagactctgtctcaaaaaaaagatattatttggtttgtttccgaaagtagctggacagaccaggtgaaaatagagagaaatgtctaaggagcgccagctgttcgggtctcctcacttcagctgctagactaggatggaagaagcctcagatgacccagccccatccaccatctgacggcaaaggcacaagttccctaagtgaggaccgcatagctgatcccagtccccagagccataaaaaaaaaaaaggaataatggcttattataaatatactctggcaaaattatactctggacagaccaaaaacaaactggtatcatgattcacagaggtattttttgtgcagaattttccagtcagtataaaaaggtctctggcctcaaaaaaactatacaatttgagaatctgctgaggagatacttataagctaactcttaatcattttcacagattcttctattttaaaatagtaacatcttttgtttgatggctttgaggaaagtttttggacatctttttgttcctttccatggactgccatatctgtttttcttgttttcatcatttttagcaaacgttgagggttttgggtatgtgttctgttttggtagtggtggtggtgttttttatttgtttgtttttggagacagagtctcactctgtcacccaggctggaatgcagtagtgcaatcatagctcactgtacccttgaactcctggccacaagcaatcctctcacctcagcctcccgagtatgtggtactacaagtgtacaccaccaggtccagctaattttttaatgtttacttttttagagatggggtttcactgtgttgcccaggctggtctcgaacccccgggttcaagcgatcctcccacctcagcctcccaaagtgctgggatgacatgcataagccatggtacccagctcatttttagcaaaccttttatagaaagtgcacaaattgcacagcctaatgaatcccagcactttgggaggccaaggtgggctgatcacaaggtcaagagttcgagaccagcctggccaacatggtgaaatcccgtctctactaaaaaaaaaaaaatacaaaaattagctaggcatggtggcgtgtgcctgtaatcccagctactctggaggctgaggcaggacaattgcttgaatccaggaggtggagattgcagtgggccgagattgggccattgcactccagcctgggcaacagaggaagactctgtctcaaaaaaaaaaaaagaaagaaagaaagaaagaaagacaggcagaggctgcatactcttttatgatccagcctcagaaatcccttagcaggccgggcacagtggctcctacctataatcccagcactttgggaggccaaggcgacaggatcacttgagcccaggaagagaccagcctgggcaacatagggagacccctcacttctagaaaaaaaaaatataaaacaaacgaagctgggcatggtggcatgtgtctgcagtcccatctactcaggaggctgagttgggaggatcgcttgagcccaggagttcgaggcttcagtgagccataatcacgccactacactccaaccaggcgacagagtgagactttgtctcttaaaaagagagagaaagagagagagaatgaaatcccttagcaatgtcccttctgcagtgctctgaaagttgaggcagttgcaaaagcctgcacgtgcccaggggaggaatgtggaccccacagcttcacgagcagtggtgaactgaaaaagcgtgtcagataggaaatgttctcatagccacttttgaaaaatacagtctgctgtagtagcatcctgggtccctttgggtagctgagtaccaatagcattccccggtcactctgacagccagtaaccttcctccaaacacacactctcccaaaaaccctggaagcaggcaatactaggccctacttgtcctattgtgacccagctagtagttggcattcaatcttgcagtgggtacttttcaacctttcccaaaattggccagaagcccctctcaggcttattctccaaaataagcctgtctttgactgttgagccacttttcgtgtttctttcctctttccttttttttttttttttttttttgagacagtttcactcttgttgcccaggctagagtgcagtggcacaatctcagcttaccacaatctccacctcctgggttcaagggattctcccactagtctcccaagtagctgggactacaggagcatgccaccacacctggctaattttgtatttttagtagagacgggtttcaccatgttggctaggctgctctcaaacccctaacctcaggtgatccacccaccttggtctcccaaagtgctgagattacaggcatgagccactgtgactggccacaaacttttttttttttttttttgaggcaggatctcactctattgcctgggctggaatacagtggccccttcacgattcaccacagcctcaacctccctggctcaggtgatccttctcccctcagctcccaagtagctgggactacaggtgcatgacactatgcctgactaatttttttgtatttcttttgtagagagagggtttcgtcatgttgcctaggctggtcttggactcctgggctcaagcaatcctcccgcctccacctcccaaagtgctggaattacaggcgtaagccaccacactggggccccatacaagcatttaatatggtttgtgtggatagctgagggctcattcagtacatttcttgaacatctctgctccttggtgaagtctggctgcccttgttgggcgaggggcctacccctagccccagagatcctccttttgccagtgggaacacactcctaagaagaacaggaactgccgggcgcagtggctcaagtctgtaatcccagcactttgggaggcctaggcgggcggatcacaaggtcaggcattcaagaccagcctggccaacatggtgaaaccctgtctctactaaaaatacaaaagttagccaggcgtggtggcaggtgcctgtaatcccagctacccgggaggctgaggcagagaatcgcttgaacccgggaggcggaggttgcagtgagccgagatcatgcaactgcactccagcctgggcgacagagtgagactccgtctcaaaaaaacaaaaaagaagaagagtgggaactaagaactcctcctaagaagaactccaggaaactaaactctggtgcacatcacacccatgccaggcagactggtagacttgtttataaacctagggaatttatttatttatttttgagacagagtcgctctgtcacccaggctgaagtgcagtgagtgatgtgatctctgctcgctgcaacctccacctcgcgggttcaagcgccgggcctcagtgaactattaatgcaactcagaaccacctggagaaaagcacagcttggtctttgtaaagtctgtctccacagcttcattctttctgcggtaggaataaagatgatgtcagaggctgggcatggtggctcacacctgtgaaaattaatattaatattttaaaaattaatgtgaaacactaaattatgttagttgccattattatgacacatcatttttaaaaagtgacagcaactattttatttatttatttattttgaggcagagtctcgctgtgtgcagtggcatgatcttggctcactgcaacctccacctcccaggttcaagcgattctgctgcctcagcctcctgagtagctgggattacaggctcccaccaccatgcctggctaatttttgtatttttagtagagacaggtttcaccatgttggccaggctggtcttgaactcctgacctcaagtgatccacccacctccgcctcccaaaatgctgggattacaggcatgagccactgtgcctggctgacagcaactattttagctgtgacattttcatttagtggcatttattggcccttattaagccacggtgctgagcatttaagctggatcagctcatgaattctatcatcttgtttaatgggcaaaactctcctttgaggatgcccttggttaagaggctttaatgatctaatgcttgttatcttcatgtgcccaataagtgctcaattcatgtcagctattgtcatttttaaacaaattaaggttttacttaaaaaaaagaaataagcctgtgtcaggcaagtagtccatgaatgtagcaaaaattcctgacatcatcttttttttttttttttgagacagagtctcagtctatcgcccaggctggagtgcagaggcacgatctcagctcactgcaacctccacctcccgggttcaagtgattctcctgcctcagcctcctgagtagctgggattacaggtgcccaccaccacgctccgctactttttgtattttttgtagagatggggtttcgccatgttgcccaggctggtcttgaactcccgacctcaggtgatccgctcacctaagcctcccaaagtgctgggattacaggtgtgagccaccatgcctggactaatattaaattaatatcactcttatttaggagcctacaggggcttttcctaagtgctttaaaatactcatttcatcctcacaacagccctatgatggaggcaccgttagcagccccattttcagaaagggaaactgaggtataaagagattaagtgacttgccattggtcatataatttatagcaagaagtggagctggagccgagcacagtggctcacacctataatcccagcactttgggaggccaaggcagcaggatcctttgagcccaagagtttaagaccagcctgggcaacatggtgaaaccctgtctctactaacgatacaaaaataagcagggcctggtggcacgcacctgtagtcccagctaatcaggaggctgaggcacgagaatcacttgaacctgggagccagaggttgcagtgagctgagattgtgccactgcactccagtctgggtgacagagggagactctgtctcaaaaaaaaaaaaaaaaagaaagaaagaaaatgttttagaaagaatggaagcagaaaatactgggtagacagctcttttgagaagttttaccacaaagagaaacaaagacgctgcatgcggtgactcatgcctctaatcccagcagtttgggaggctgaggtgggaggatcacttgagcctgggaggttgaggctgcagtgagccatgatcacaccactgcactcccacccgagtgaagaagcaagaccctgtctcaaaaataaaaataaaaggccagttgcagtggctcacgcctgtgatcccagcactttgggaggccaaggcgggcggatcatgaggtcaggagatcgagaccatcctggctaacatggtgaaaccccgtctctactaaaaatacaaaaaaattagctgggcatggtggtgggcgcctgtagtctcagttacccgggaggctgaggcaggagaatggcgtgaacccaggaggcggagcttgcagtgagccgacatcgcaccactgcattccaggctgggcaacagagcaagactccgtctcaaaaataataataataataataataataataataataataataataataataaaataacacattgtcagggcaggcgcagtggctcacgcctgttaatcccaacaccttgggaggctgaggtgggcggatcacctgaggtcaggagtttgagaacagcctggccaacatggtgaaaccctgtctctactaaaaatataaaaattagccaggtgtggtggcgggcgcctataatcccagctactcaggaggctgaggcaggagaattgcttaaacctgggaggtgaaggctgcagtgagctgagatcgcgccactgcactccagcctgggcaacaagagtgaaactctgtctcaaaaaaaaaaaaaaaaaacacattctcggcccggcgcagtggctcacacctgtaatcctagcactttgggaggctgaggcaggtggattacctgagttcgggagttcgagaccagcctggccaacatggtgaaaccctgtctctactaaaaatataaaaattagccaggcgtggtggcagaggcctgtaatcccagctacttgggaggctgaggtaggagaatcgcttgaacccaggaggtggaggttgcagtgagctgaaatcgcgccactgcactccagcctaggccacagatcgagactccatctcaaaaaagtaaataaataaaaaataacacattctctgcacacacccttgcccactttggcttcctcctgcatgagaccctggttaaatccagccttcctctctgccgtgcctgcacccacacagcttgagtgagctaaaaaacaacacagccccctggccaggctaatttcaagtctgtgaacttgaccctcaggcggaccccaatgctgcctggcagccatatgacatttctctgatcccctccttcctcctgtcttctagacaactaattcacaccttttcccttctcctctaatcctttccaacacctcctccccccctttcactctcccttggcttcttattttgcagagaaaatgcaagagatgagaagtgaacttccacagccacccccgcctctaccacctacctgcacccttgcccacacccgttctcctgctgtgactgtcccatcacctgctcccaccttcccgcccacttccagccaccgtccctggttctcacctctctctgctgctcattcagtttcccccatgcactggatctcctgttagcccacacagcatcctgtctcccatctcaaaacaaaccctctctctttttttgtttttgtttttgttttgttttgagacagggtctcactttgccgcccaggctggagtgcagtggtgcgatctcagctcattgcaacctctgcctcctgggttcaagcaattctcctgccttggcctcccgagtagctgggattacaggtgcgccaccacacccagctaatttttgtatttttagtagagatggggtttcactatgttagccaggctggtctcaaactactgacctcaagtgatctgcccacctcagcctcccaaagtgctgggattacaggtgtgagctaccgtgcccagcccaaaccctctcttgacttcacctccccttctagctacagccccactttttttgctattctttttattttatttagagacagggtctcgctttgttgcccaggctggagtacagtggcataatcatagctcactgcagcctccaactcccgggctccagcgatcatcccaccttaacctctggagtaggtgggactacaggtgtgcaccaccacacccggctaattttttcattttattttttgtacaggtggagtatcgctgtgttgcccaggctgatctcaaactcctggcctcaagcagtcctcccaccttgccctcccaaagtgctggaattacaggcatgagccagcgtgccaggtcaagaatgtttttaatgattaaccatggaatttaagctggctaaggaagaaatgagggcatgggagggtgagggggagtaaaatatgaaagggacaacggatgggagatcacagtgggttggaaggatcatgcgagtggggcactggagggaatgaggtggaaagaaaaagtgatgggtggagagtgagtgtgagattgaggttctgaagaggctgctgttattcaaacaaggtctgggtttgaccacgagagggagatgttggggaaggaaaaagtcactagagagaggtcagggaacagagaggttggggctgcggaagaactatctggttatagaaatcactgagaatgatgctaagagcagcgggagcggccgtgagcccagagctaaaattagggagaagagaggagtcatgatctgggtcagcagatgacgcatgaagcaaggtagtgatgagattcatcgctgggggttttggggagggtggagggagaatggtcaggaagtagctcccaggagcacggagacctccccacttggaaggcccacaggagagctgggttccagttagagcaagaaggtggtaggaatgttcagagaagtaactgaggcaagaagagattttgttgaagatgggtcatgggttccaaaggtcacagtagctggcacacattggggtatggggtagaaatggtttcttccgcagtgggtttccttgtgggtctgtaacccgactgaggtttggccgctcaacactcaaaagccaaactcaggccaggcgtggtggctcacgcctgaaatcccagcattttgggaagctgagacaggtggatcacttgaggtcaggagtttgagaccagccggctaacatggtgaaaccccatctctactacagaaattactggctcggtgtggtggcacacatctgtaattccagctacttgggaggctgaggcaggagaatcgcttgaacccgggaggcggaggtcgcagtgagccaagattgtgccactgcactccagcctgggcaacagagtaagactcggtttcagaaaagaaagccaaactcgggccgagcgtggtggctcaagcctataatcccagcacttcgggaggccgaggtgggtggatcacctgaggtctggagttcgagactagcatggccaacatggtgaaactgtctctccttaaagatacaaaaattagccaggtgtggtggtgcattcctgtagtcccagctactcgggaggctgaggcaggagaatcacttgaacctgggagacagaggttgcagtgagccgagacgggccactgcattccagcctgggtgacagagtgaggctgcctcaaaaaaaaaaaaaaaaatagaaagccaaactcaagagagatgacagttggtgggaggaaaagcaagtttatttggagagccagcaaaccgagaacacagtggactatcatcctaaagtaccatcttaaatcagtacaattttttttttttttaggggcagagggaagagaagggcattgtgatcaagaggtgaccaacaggccaggcgcagtgactcataccaattccagcactttgggaggctgaggcaggaggatcacttgaacccaggaattcaagaccagccagggcaatgtagtgagaccccatctctacaaaacaataaataaaataaaaaactagctgggcatagtggcatgcacctatagtcccagctacttgggaggctgaggcaggaggatcactcgagcccaggaggtagaggctatagtcctggtttctagctccataaaaaagtaataataataaaaataaggaggtgaccactgcagacatctgagtgccagctagggtccgaggaggttgatgacttctttgtccttggttgggtcacaatgcccctataaatctttgaaaaaacaggctgggcgtggtggctcacacctgtaatcccagcactttgagaggccgaagtgggtggatcacgaagtcaggagttcgagaccagcctggccaagatggtgaaaccccgtctctactaaaaatacaaaaattagccgggcgtggtggcgggcgcctgtagttccagctactcgggaggctgaggcaggagaatcgcttgaacccaggaagcggaggttgcaatgtgccaagatcgtgccactgcacactctagcctgggcaacagagcaagactgtgtctcaaaaaaaaaaaatctttgacaaaacatagttgtttacatacttctttaatcccagagttagttttaaaaactacatgattgctgtttttgcatattatctcagcggtctaaaattaacctagccatgtgcaggaatgggtaaagtccccttaaacaaaaatggggttagttatgttagttcttttgccatttcactggtcatatacctgaagcgcttagcctgacacaattgaacgccagacggaagccgtgatcagcggtcctgacgggggtcagagtcagaccaggggtcttttacccaagtggggaagattgggaaaggcctaggatcagagagggaaatgggtccctggttgcccatggacctaatggggtctctcgagcagcaggggccttgcgccctgggggacaaggtagggagggggtggcctggctgcgctgacccgcctaccgacccctctcgacctgcaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcgtgggtgacgggggcggggcccaggaggctgaggggggccgcgcgagcgaggcgggggcggggccgggacagagtctgagagatgtagccaatgggcgagaccgctggaggagccagggggcggggctgagggacgcagtgcctgggcggtaggcccggtgggcggggctggagaaggtgaagccgggaatccgaacgagtgggcggggcaaggcaggaagaccctggctgggccgggggagaaagcaagtagtttggtatgcagaggggatgcagaacaggacaggggccaggcgcggtgggaatggcaacgctttgggaggccaaggcaggaggatcgcttaagcccaaggagttcaaggctgcagtgagctatgatcgtgccattgcactacagcctgcgtgacagagaccttgtctcaaaaaaaaaaaaaaatggtggggtgcagtagctcacgcctgtaatcccagcattttgggagtctatggtgggaggatcgcttgaggccaggagtttgagaccagcctgaacaacaaagtgagactctgtctctaaaaaatttaaaaattagtccaggcgcagtggctcacgcctgtaatcccagcactttgggaggcccgagggggcagatcacttgaggtcaggagttcaagaccagcctgaccaacatggtgaaaccccatctctactaaaatacaaaattagccaggtgtggtggtgcacgcctgtaatcccagctacttgggaggctgaggcaggaaaattgcttgaacctgggaggcggaggttacagtgggctgagatcatgccattgcactccagcctgggcagcaagattgaaactccatctcaaaaaaaaattaaaaaattaaattagccaggcgtggtggcatgcacctgtggtcctagctactctggaggctgatgtgggaggatcgcttgagcccaggagtttgaggctgcagtgagctatgatggagccactgcactccagcctgggcgacagagtgagaccctgtctctcacacacacaatgaagagcaggactgaaggagaaagagcaagtaagggtggctgaagagaagctgagtggatgggcaccgctgagagtcacagttgtggggtaggaccaggaatacagaataatgggaggaggagtcggtaggagaaaccagggaggattggagcacaagagggagaggctggtggacagcacaagctggctggttgcggggtctcttctgggcaggctggcaggtgaaccatatgttcaactcttgttttcccacagagggcttcagaggctgggaggtggagcatggcgggaacggctgggccatagaaaagaacctaacaccggtgcctggggctccttcgcagacctgcttcgtgacctctttcgagtgagtggcccaagtgagaggccccgatccctggggcaaaggccccaaagaaagggaccctaccccccacactgtcctcatcgtcaccttcaccctctccttcccccatttatttattcattgattcattccatcaatcaacaaatacttgttgagggtactgtttcatatgccagggatacaaggaaagatcaggaaggttagcaaccacaggcagcaatgctctgtgcatcatcgcctgcagtttgtgagacaacagcaagacagctttgatctaaagacagggttttgggccgggcacggtggctctcgcctgtaatcccagcactttgagagcccgaggtgggcagatcactttaggtcaggagtgcgagaccagcctggccaacagggggaaaccccgtctctactaaaaagacaaaaattagctggacgtggaggctgaggcaggagaatcgcttgaacccaggaggcaaatgttgcagtgagccgagattgcaccactgcactccagcctgggcgacagaatgagactctgtctcaaaaaaaaaaaaaaagggaacatggcagattagcacccaagatggagtcgcttttgcctccacaaggagttactctatactagacactttacatataattctggcaacaaccctgtgacatagatactattattgcccccactttataacaggaaactgaaggccgggcacggtggctcatagctgtaatcccagcactttgggaggccgaagtgggaggatctcttgagcccaggagtttgaggttgcagtgagcctaggatcatgccactgcactccagcctggcaacagaataagaccttgactcaaaagaaaagaaaaaatgagaatctgttctccatggaatgatggtgccacctctacagtttatgaagtttctgtgtatacctacgtctgtccctggcactctgttttttttgtttttgtttttgttttttgagatagagtctcattttgttgcccagtctagagtgcagtggcgcaatcttggctcactgcagcctctgcctccctgggttccaatgattctcctgcctcagcctcccgaatagctgtgactacagaggtgcgccaccatgcctggctaatttttgtattttttgtagagaagaggtttcaccatattgaccaggctcgtctctaactcccgacctccggtgatccgcctgcctcgggctctcaaagtgctgggattacaggtctaagccaccgcgctcagccggttcctggcactttgttctattccattgctcaacttacccatccttccaccaatactgcacaatttatgttattatggcacattctagtttgaggagaaggactgtttacaaagttgtaggcaggagcccctgagctagtaacagttaggaaaggaacgttaccacccctagactgctagaggtgaggggaggaaacagttactggaaaatgaggagagagtgccatggagatttgctttttccttgggggacaaggcagtcccttgagaaggacctaagaggataaataccctgattttagtcacctctttcacttccatcccctgccggagcatcccattggctgatccaacaggaagcaatgggtgacagagacaaggctgtccagctttagacccggggccctcacactttaggaggccacagagctccccgctcacatgtctagtatgtggccttcatttgtagtcatgtcctgtcccacaaagatgagggtcaggctttcatagaggtcagctgcctggagcccgcagcagggtggagaatggcaaagggactccaagaggccaaggagagatgtatagcccatcatgcatcttcaggtctgctagagcaaaccctgagggctgctttagagagggttatcaagggagacttcttggaggaggtggcttctgactgtgacttgaatgccaggactgtttgccctgccccctgccatctctccttcccagatggtgctccaagaggcagcttgtggacctggtgatggaaggggtgtggcaggagctgctggacagcgcccagattgagatctgtgtggctgactggtgagtgaggagcggcaccctgccccagagcagcagcaggcttggcagcggctctgcaacaggggctcatttcccgccccatcaaccccacgggtagcggctgtcactgtgcaccctttgtgatgaggctgagaggggaagtgatgcagagccggggaaggtagagctttggagaagccagagcccccactctgcactcctgcccaccctcatcccagcaggctggggtggtccacagggggccactgactggcttgatacccctctgaaacgagacacctcccctgaccaccttgtggatgcccagggtctctgaaggggtgggagcatggtgccctgtgagctgaggctcagggagcatagttgggacaggactggcttcagagcctacaggcttaggatgaatgccttcttcccaaaacacccaggttctgccccaaagcattccagctcctccttcaggctgtggctcttccatagaaaatctggtctcttccctggggctctggctcttccctgaagtcatcaggcacctgccctgcattgtggttcttccccagagcatcctttcccgtcccccaactacctacccaaaagcctccagaatcaaccgcaggaccacccaggctcctcccccaggaccacccaggctcctcccctgctctggctccaccccaggaccacccagactcctcccccaggctctggctccaccccagggtcacccaggcttctcctccaggttctggttccaccccaggaccacccaggctcctcccccaggaccacccaggcccctcccccaggctctggttccaccccaggaccacccaggctcctcccccaggaccacccaggctcctcccctgctctggctccaccccaggaccacccagactcctcccccaggaccacccaggcccctccccgaggctctggctccaccccaggaccacccagattcctcccccaggaccacccaggcccctcccccaggctctggctccactccaggaccacccagactcctcccccaggaccacccaggaccctcccccaggctctggctccaccccagggtcacccaggctcctcccccaggctctggctccaccccaggaccacccaggctcctcccccaggctctggctcctccccaggaccacccaggctcctccgccaggctctggttccaccccagaaccaccaaggctcctcccctagaggttcccaggccaggacgtctccaaatgtggtccagatgtgcaggaccttcatcaagatggagccagccctcagcctcccgccccgaaacccagagagctggctgggtgacgggggcatagaggctgactgctgcctggcaggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtgggtccagactagcttccagctccccccgacccgctaaaggcacacacgcccagcctctcgtctgctcggtttcccttctgtcactcctggatatctataatcataacagctaagaagtatcgagcccttcttacatcccaagccctgtgtcaagacgcttacatatcgattcatttcattagcaaaaccccttaatgttcaacaaacactgattgagcacctactgtgtgctgggcaccactctatgtgctggaaatgcagcagtgaagcaaaatcctatctccattctagagttgaggaaacagaggcacagacagggaggttatgtgactggtccagtgcagagctggactcaagcccaatctggcaccaagactatgctgtcttgatcctcacacctcagttaccaaagtaaatgtttcggctgggcacagtggctcatacctgtaatcccaccactttaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgctaactaaaaataataataataataataataataatgagtcagatcagaagtctcactgcttgtaatgctcctgtggctacatctcacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttgggccgggtgtggtggctcatgcctgtaatctcagcactttgggaggtcaaggcggacagatcacttgagggcaggagttcaacaccagcctgccaacacagtgaaaccctgtctctactaaaaatacacaaattagccaggcacggtgatgggcgtctgtaatcccagcttctggggagactgaggcgggagaatttattgaaccgggggaggtggaggttgcagtgagctgagatcatgccactgcactccagcctgggcgatggagcgagtcttggcctcaaaataaataaataaaataaaatggtaaattttggctgggcgcagtggctcacacctgtaatcccagcactttggaagaccatggcgggtggatcacctgaggtcaggagttcaagaccagcctgaccaacatggcaaaacccccgtctctactaaaaatacaaaaattagccgggcatggtggtgcgcgcctgtaatcccagctactcgggaggctgagacaggagaatcgcttgaacctgcgaggtggaggttgcattgagccaaaatcatgccactgtactccagcctgggcgacagagtgagactccatctcaaaaataaataaataaataaaaagtttgttttacgaaaattttatctcaacttttttaaattggaaaaaaaaaaaaagccaaagtcctcctgtggcccacaaggccatgatctgcccatgacctccctgacccctctcttacctctcccctcactcagctccaggcattctcccacctcagggcctttgcgcgggccgttcctgctgcctgggacaccctccagagcccctcccggctccctctcctccttcaggtgtcacctctgtggggcctttgctaactcactctactcacattcctgccaccttcctggcagaatgcccctggcccctcacccccacctatctccagtgtctgggccccctgctagaatggcactgacaccagggcggggtccttttccggttttattcactgctccgtccccagcaaactagcgcaggactggcacctcctcagtcctttgggcctatctgttgaagtggaggaagagaaggggcccgcaggccctcaccctctcactccccttccccctgcaggtctcccacgtcttcaccaactttggcaagggcatccgctacgtatcttttgagcagtacgggagagacgtgagttcctgggtggggcactatggcgcccttgtgacccactccagtgtgagggtcaggatccgtctgtcctagcgactggactactgcctgacgttgtcagtcaagaccagccttgcagccaggtgcagtggctcacacctgtggaatcccagcacttcaggaggccgaggtgggaggatcactggagctcgggagttcaagaccagcctgggcaacatagtgaaaccgtctccacaaataatttttaaaaaattagccaggcatggtggtgccgcctgtagtcccagctactcaggaggcttgggtgggaggattgcctgagaccaggaggttgaggctgcagtgagccgtgatttcaccaccactccagcctgggtgagaaagcaagaccctatatcaatgaaaaaaaaaaaaaaaaagaccagctttgcagccagaagccagaggatacccagggacagtagggctcccaggtggctggttctcagcacaccttccatgaatctgcttgctgctgcttcagtgtggtggccatcatgctgtgtgacaaaccaggctgttcacagcttcctcagccccccagaaggggagtgtcaggaagagacatttagttcatttgcctgcaaattttcttctcctgcaaggatctcggtggactcagtcacaaaacaaaggctaaaccaggatttataagagagggcttataaatccctctgccgacgcagggagcagagacttgccggcatgttttgggggtaatgatcgtgggcagggagcagaggtccgctgaggcagtctgtccttgagactaacaaagtcatctgctgtttggggaaatctctggtgttgggaacaggcccccaaatctggccataaactggccccaaaactggccataaacaaaatatctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctctgaaggccgtgagacccctgatttcccactccacaccct

SEQ ID NO: 38595 - DNA, 11897 bp, Homo sapiens
aagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgcccgagtccggggcggccccggtgtcccctccgagcctgctgcactccacgtccccctaccagggctccagcccccagggaaatctccgaccaggcccgcccaggaggtgccttggatgggggtggcttcgggaggccctaatggggagtggcggggagagacccaaggctaccgacttggcttatttcttcccaactagctgtttctcacaaagtctttattattattgtattttgagacggggtttcgctcttgtttcccaggctgtagtgcagtggcgcgatctcggcttactgcaccctccgcctcccggattcaagcaattctgcctcagcctccccagtagcttggattacaggcatgcgccatcacgcccagctaattttttttgtatttagtagagacggatttcaccatgttggtcaggctggtctcgaactcctgacctcaggtgttctacccgcctcggcctcccaaagtgctgggattataggcgtgagccaccgcgcccggcctcttttattgtttttagagatggggtccagctctatggcccaggctggaaggcagtggcacgatcacagctcactgcagcctcgacctcctgggctcaagccatccttccacctcagcctcccaagtagctgggaccacaggcgcgggccaccacgccccactgatttttaaatttttatgtagggacagtgatctcactgtgttgcccaggctggtctcgaactcttaacctcaagctatcctcctgcctgggcctcccaaagatttgggagcaggcctaagcaacttagtctgggccatttctcccaaagtcttacccattcatgctgggggtgctgaaaatcccctacttccaaatccttttccacaggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatgtaggctgggtaccctgaatcaccccgtgagaattgctgctgtttgtttactctcacctatcatgtcatgaatagcttcttgtttggttatctcacttggcattacagcccagaatcttatctgctaaggtcaaaagtgaccagttccggtatcttttttggtttgtttttgagacagggtctcatgctgtcgcccaggcttgaactcctgtgctcaagcaatcctcccgcctcagcctccacaggcatgcgcaaccacacttggctaatttttgtattttttgtagagatgggggtctcgctttgttgcccaggctggtcttgaactcctgggttcaagtgatcctcccacctcagccttccaaagtgctgggagtacaggcacgagccactacggccggccaattccagtaccttttttttcttctttttttttcttaaaccgctacactatggaaaagagttccagtatccagtgtcttttctttttttttttttgaaacggagtctcgctctgttgcccaggctggagtgcagtggcgcgatctcggctcactgcaacctccgcttcctgggttcaagagattctcctgcctccaccccctgagtcgctgggattacaggcatgtgccaccacgcccggttaatttttgtgtttttagtatagatggggattacaccatgttggccagactggtctcgaactcctgacctcgtgatccgcctgcctcgacatgccaaagtgttgggattacaggcatgagccaccacgctcggcctcagtatccagtattttaacgcaggcctgtgtgttgactctggttccagagggtaattcctgatggttgtggccagtgtcctggagggatgcttcttaggacaggatgcctgattctgggtgcagggctcctgactgcctctaggagatgcttgttctcaaggcattgtcagcagattctttggggacacatcttgtatctttgtgaatatttaaggaagtaaaagaatgattcatgcctgggggcaaggaaggaggatgcatgttctttcttggtttattttggatttgcaagttggagatgcttcaaaggcaggccacagtcttagggtgttagattcaaagtttttatcttgggcaggtgcagtggctcacgcctgtactcccagcactttgggaggccgaggcaggtggatcacctgagttcaagagttcgagaccagcctggccaacatggtgaaacctcatctctactaaaaatacaaaaattagccaggcatggggtgcgtgcctataatcccagctactcaggaggctgaggcaggagaattgcttgaacctgggaggcggaggttgcagtgagccaagatcacgccaccgcactgcaacctgggtaacaagagtgaaactctgtctcaaaaaaaaaaagtttatctttctttttttattttttattttattaaattgagacagggcctcactatgttgcccaggctggtctcgaactcctgagctcaagcgatccacccacctctgcttcccagagtgctgggattacaggcatgagccactgcacctggcccagaatttttatcttgattgagggagctcaggaccattttggaggccccactgagaggcagcaggcctctgttatgtgtgcctaagaattggtgaattctgttctgtttgtctttctgctttttgctttgagatgtcattaaagtctagatgaattctgttttggtagccatttgggagttgatgtctgagaatgtgtgccatggaagaaacctttcagtagcagatagtcacactctttctgttcctttgtagctgcaggatggactttctggtcctcttcttgttctacctggcttcggtgctgatgggtcttgttcttatctgcgtctgctcgaaaacccatagcttgaaaggcctggccaggggaggagcacaggtaaggatgatccttggatggcactggaatttgaatactgtgttagtctaagagactcacaggttttgctacaggacaaaaaagagatgccaggccgggtgcagtgcctcacacctgtaatcccgctactcaggaagctgaggcaggaggatcccttgagccaggagtctgaagttgccatgagctatgatcacgccactgcactccagcctggactacagagtgagaccctgtctcaacaacaacaaaaaagatgccacttaacatcattgatggatttagttcgttgatggcagttgtgggatattccacagcctctgtctgtgtgggttttgtgttcctgctgaaagtcctcttgcggtggtgctttgagagaagaggttgctgttttcctctggattagatgcctgtgattgggcatggatgtgagcagggtccgcctggggcacttaatgggtgactctgggggccagcagaaagctcagcattggctggcccccctccttcagggatcaaagtgagcaaaacggggcaagcagcctatgggaaggcattgagttgggagggacctgggccaatgcccagtgatctgggtgtggatgctggaacctgggattgaacccaggctggggaaggagcggccttcacattgacattccccgacccatcccctctgctcacctctctttccctgaagacactgacaggtgccttcgtcagaatcagactagaaatggagttggcgtgaaaggaaagaccagtagaaagaattcccctctttattctctgctaaatcacttcttcacccatatagggaaacaaaacttactatcacccagattgccagctgtatgtggagtgtctgatttgtttgggagtggaggaagtgagaaatgaaattgagtctttctctttccttttgtttcagatattttcctgtataattccagaatgtcttcagagagccgtgcatggattgcttcattaccttttccatacgaggtatttctctttcagagtttaaatattctcctcttttctgctttgattattaattgttgagatcctctagcttcaggaagctccttgtggtttccagcatggtgagggaaagaaggccggaaagaatcacgagtcctgagttgggagcctctactcgtagttaatctgccttttgagatggaggttttaacttgcctacttttaaaaagcgatatttacagattgtgaatttctgttaaatacatgcaaaatgtttcacatagttttctatgtaattcttactattatctcaagcccaaaggaagtggttggccgttggttactttctttagtatcatacaatttcttcaagaagaaacccccatgaacaagccatgcctgttttctttcagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggtaagttgaggctcttagcatacagcatggtgacagctccactgtcttactaatagtgctgcaaacaaggagaggccccccctgaggactttgtaaaagatttgatgtgtagcattttcattacctttcagttttgagtgttttctaattttttttttcttcttcaacccatgggttatttaaaaccacttaaaatttttagtttatctttttaatgctttcacttcgttttgtcatatatagagcatgtgatcggtatggtactgttcctttttttgtttcttaagacggagtcacgctttgtcgcccaggctgcagtgcagtgaggcgatctcagctcgctgcaacctccgcctcccgggttcaagggattctcttgcctcagactcccgagtagctaggactacaggcgtgcgccaccacacccagctgatttttgtatttttagtagagatggggtttcgccatgttgtccaggctggtctcgaactcctgacctcgtgatccacccacctcagcctcccaaagtgctgagactacaggcgtgagccaccgcactggcagaattgtacactttaaatgagtgaattaggtttgtgtgttatatctcaataaagccattattaaaaatgaattgcgtggctgggcgcggtggctcacacaatctcagcctgtttgggaggtctaggtgggaggatcacctgaggtccggagttccagaccagcctggccaaaatggtgaaaccccatctgtattaacaaaaaaaatacaaaaattagccacgcgtgcattagcacgcctgtaatcccagctactactcaggaggcttacgtgggagaatcacctgaacctgagaggcagaggttgcagtgagccaagatcatgccactgcattccagcctggatgacaaagtaagactgtctcaaaaaaaaaaaaagaattacttacgatattaaagatagcagtttcagttgtgttttatcaggacgggttttgtgactatccagtccaaagtattgcacgaaactgacatatgtccttacttttcccaggcattataacaaaagcaaatgaattattatttcttcatgtttatgaatttgatgaagtgatgtttccaaagaacgtgaggtgctctacttgtgatttaaggaaaccagctcgatccaagcactgcagtgagtgtggctctcgtgactccagcggcacctccaacagcacatgtgtgggcttcgtctgtgagggaatgtttcctgaatccgaaagcagagccagttcacccccagatatggtgtggccactacttgtagagttgagataatggtttctttcagatgagtgagggtcaggtcttgtgttcctgtgtagtagacagtcctcatctctgggcataacagcccttccctcgccacgtggcaggacatgctccccacaagttgtttctgcggatgttgtgtttgcagatttcagtcctacaaagcctagtcttctggggagggcccaagattctagacccgtgctgtctaacaaaaatagaatgtggctgggcgcagcggttcatgccaggaattccagtactttgggaggcaggcagatctcttgagcctaggagttcaagaccagcttgggcaccatggggaaaccccacctctacaaaaaatacaaaagatgtagtcctggctactcaggaggctgaggcgggaggatcacttgagcccaggagatcgaggctgcagtaagctatgattaaaccactgcactccagcctcagcaacagagcaagaccctgtctcagaaaaaaaaaaaaaggccatgaatagaaagtttttaaaaatgtttttcaaaatgtggctgtgcttggagacagttttaatcaggatgttatttaacctacatatgtaaaatatcattttaacatgtaatcaatgtaaaaaattcttcatgagatagtttatattctttttttcatactaagcctttgaaatctggtgtgtatcttacatttatagcacatcttgatttggacactaaattttcatgtggaaatgcttgtgtatttagatttaataaaatgtacagttgaaaaagtaggcttacatgtgcaagctatatccagatattcttaaaagttttccaatatctgaattcggtaccaaaaaaataattttccttcaccatccatgtctacattgacataatgattcatcttaatcagaagaattgactttaaagcaggaacaccagttttaaaactatgtctatccaagtcaagtaaattaactaactcttgtgttgcctccatattcacactgaattcaaaggagtattgtagtaaaaagacaactgtaaatttgtcagtattgacaaaatgtcctctctgttttttggtttgttttttgagatagggtctcactccattacccaggctggagtgctgtgacgtgatcatagctcactgcagcgttgacctcctgtgctcaagtgatcctcccgcctagcctctgagtagctgggaccatgggtgcatgccgccaccacctcagatttgtcttgtagtcagattgcaagtgctcaatacccacatttggctggttgctcctgtactggacaccacagttccaaaagcttagtttggaactaagcagctgccattttcctctgatgacacatccagtggacagattatgaaaatctcagcaggtgtgcggtgtccttgtctcgtcaagcaccatcccagcacgtgcccccttgtttctgtgcaggtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcaggtaattatgctgtaggtttctgacttcaagtttcagaatcgcaaaaaagacatttatttttccagtaaaagcatgaagttaggtggggtgtggtggctcacgcctataatcccagcacttttggaggccgaggtgggaggatcgcatgaggctaggagttcaggaccagcctgggcaacacccaaatgtccatcaactgatgattgaataactggtctcctgtagagaccttgtctctacaaaaaatacaaaaatgagccagggccgggtgcagtggctcatgcctgtaatcctagcactttgagaagctaagacaagcagattgcctgagctcaggagcttgagaccagcctgggcaacatggtgaaaccccatctctactaaaatacaaaaaaattagctgggtgtggtggcacatgcccattgttctagctacttgggaggctgaggcacaaaaattgcttgaacccgggagggagaggttgcagtgagctgagattgcaccactgcactccagcctgggtgacagagcaagaccctgtctcagaaactaacaaacaaacgtgaagtttttcctttttctaaactgatataaaattcacatattgggccaggcatggtggctcacagctgtaatcccagcactttgggaggccaaggtgggtggatcacctgaggtcaggagttcaagaccagcctggccaatgtggtaaaacctcgtctctactaaaaatacaaaaaagttagccaggcatggtggccagcatctgtagtcccagctactcgggaggccgaggcaggagaatcacttgaacctgggaggcggaggttgcagtgagccaagatcgtgccattgcactccagcctgggcaacaagagcgaaagagagaaactccatctcaaaaaaaaaaaaaattcacatatcataaaattcaccctttaaagtatcccacagtggtataagtatattcacagacttgttcagccctcactactatctaatttcagaacatttcatcatccccaaaaggaaacactccccattccctcctcccccagacccaggtaatcactaatctactttctgtctttcgggataggccttttctggacacttcatataaatggaatcatgcaatatatggtcttttccactggcttctttcttgtggcacaaggttttcagggttaattcatgtagcacgaatctacttcattccttttgtttatttgggatggagtctcgctcttgttgcccaggctggagtgcaatggtgtgatcttggctcactgcaacctctgcctctcaggttcaagcaattctcctgcctcagtctcccgtgtagctgggattacaggcatgagccaccacgcctggctaatttttgtaattttagcagagaaggggttttaccatgttggccaggctggtcttgaactcctgacctcaagtgatccacccgcctcggcctcccaaagtgctgggattacaggcatgaaaccccgtgcccggccttacttcattcttttttatggctgaatagtattccgctgtatggatagactgaattttaattatttgttcatcagttgatggacattttggtgttttcacttttggctatttttgagtaatactgctgtgaacattcatgtacaagttttttgtgtggacataggtttttatgtttataaaacatgttttatgtttatgtttttatgttttatgtttatatttctcttgggtacattccacctagaagtggcactgctgggtcatatggtaacttttttttttttttgagacagagtctcactctgtcacctaggctggagtgcagtggtaccatcacagctcactatgacctggacctcctgggctcaaatgctcccaccttggcctcccaaagtgctgggattacaggtgtgagccaccatgactggcccagaatcacttttgatttgaggtctttatataataatgacggttaatcttttgttatactgtttttttgtttgtggatcttttggatcttgggaatggggttttgggttttttggggttttttggtatagaaaagttcagacattctttctcatcaaatttcttttctttgtaacttcaacaagaaagtctcctccatcaggagttttgttaaatgttctcttttcttgtgactttcaaaaatattaaactttctaaattcttcattttgcttattacaaaaataacttacaaaactttaagcagcgcagttcctatggtcatataccatttacggagtcagttttgtttttacccaaacaagatgacagtgtaatccttacatcttgcctttctcattagtcaatatattaagtcttttcacaatcagtacatagaaattgacatcatttttcatggctcctcgttttcccattgtgtgaccatcccagagtttacccttcctgacggatggacatttaacttgtttcttggccaggcacagtggctcacgcctgtaatcccaacaatttgggaggtcaaggcaggaggatcactcaaggccaggagtttgaaagcagcctgggcaacatagcaagaccctgtttctattgatttatttatttatttatttatttttagatggagtcttgctctgtcgcctaggctggagtgcagttgcacaatctcagctcactgtaaccttcaccgcccgggttgaagcaattcttctgcctcagcctcttgagtagctgggattacaggcttgtgccaccacacccggctaacttttgtatttttagtagagaagggtttcaccatgttggccaggctggtgtcaaactcctgacctcaagtgatctgcccgcctcggcctcccaaaatgctgggattataggcgtgagccattgcgcccggcccctgtttctatttattaagaaaaggaaaaaaacttcggaagaggggctgataaaatcaatgatacaacgaatatccttgtacatctatttttggggttgtattgttttaagaaagacattgatctcttttgtccatctggattttatattgatgaatgaagtctgcatttattttataaatagctaactggaatagcacatttcctaagtaaactttcccttttccttcagtgtgaacacttcattcatcccacaggaaactcttgtatgtactgggattattctgggctgcttctcagtgctgtttatgttcagtttgtcacatctggacacaagtaggtgggctgaggaagcagcgctggtggctgtggcaggcccagggttggccagtgttcactctcatggatgtcacagtccagctgcctaaagcactaccttttctctgctcctagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaatgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtg

SEQ ID NO: 38596 - DNA, 6279 bp, Homo sapiens
agcgattttcctgcctcagccttccgagtagctgggattacaggcgcgcaccaccacgcctggctaatttctgtatttttaatagagacgggtttcaccatgttggccaggctggtctcgaactcctgacctcaggtgatccgcccgcctcagcctcccaaagtgctggaattataggcgtgagcccaccgagcttggctgggtccttgtcttgaaatgtgtctctgagccattagccagaagggggcaaagaggcctggagggcagctttcccccactccccctccgttactctctgaatctgagctccaggtttgggcagttgaggtttagcctgaggccaaggacgaacgtgatggggtacaggagaagacttggcggtggagggggttttgtgtgcacatttacagagtcaggggcattcccagtccagaaaggattctcagaggcagtcacaaaaaggaatggggtggaagggctgagacttgagggagggaagggtggtgggggtagggccggggtgtggttgggtggatcgggttgatatttatatagggataggttgatcttggaaggctggagacggcaacgtggacaggaagaagcggagggcgaggaggagcagaggagcacacagatgaagcaggtgatgaaggctttacaagcggggaggcgtgggctggtgacaggcggagggcggggagcgattgcctgcgtgtgcatagatctatatgagaagcgtgatgagcggcggacaagcgaaggcagggctggggcgtgggccgcggagcgctggtcgggaaagtgggcatgggagatgagagaataacggggttgcgctcctttggcttaatagtttgctcccattgagactcctaagatttcctcctctcttggaaggaagctgggttcggggcgttgggtagccgcggagggccggggccccggggcgcgccgggtgctaggtgtgcgccgtgcgtcgcggggggggggatgggggtgggggcgggctccgcccctggcagggggcctgagcgcgcgcgaggagcagccgctgccgccgctcggggtcgcctggagccccagattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgaggactgcggggacagggcgcggtggggattccaggccccgcgccgccgccgaacccagcgcggcggagatagaaaggggacgtgggagagagtggtggtggcgggggggggggctgtcggagctgtggggcggagactgctcgctgccgggaaccgtccttccctccggcccccgcgtcccctccgtgctcgaggccgcctctcggcgctgtccccatcccgcggacccctccgtcctgactacgatcccaaccccagccattcccgcgcctggcctcgctccgcgatgcccatctttcccctccttgcagaccccgctcccgggttcctgtcttcgctctcctcgctctcttcgcctgctcaacccttccctgcccccatcctcccgctacccccatccccttcttctgtcccggcgcccctctccctcgtcggctcctgtcacttggaacccgtatccgtgccgctatctccgcgtccggccgcctcccaaccggtgccgtcccacaggtgtccacgcgtccggccgtccatccgtccgtccctcctggggccggcgctgaccatgcccagcggctgccgctgcctgcatctcgtgtgcctgttgtgcattctgggggctcccggtcagcctgtccgaggtgagcgcgcccgctgggctccagtcgcggccctgtccagccgtcctcgcttgcacgttgacctctgccggccggaggcggcactgcagtcgctccgacccgcggggcaagcaagaccgaggttgcctttttggaatgggatgagtttctgtgttatgtcctgccctagggttgagtccgctcagttactggaaccccaatcctctcctgagtcccgcatcccagcgagctgtgccctgactcagactcacccctcccacatcaatctcttgcagccgatgactgcagctcccactgtgacctggcccacggctgctgtgcacctgacggctcctgcaggtacctgtcctgagcacgtgcccccaaaccctttggtacccatttctaagcccttcacgtgcacaacagtgtctaggggcttcagactctactcttcatgcctcatcactcctatggctgactggccagtccccctttcccctttacctcacctctcttgcttcttctagtttttatctccccacttctttaatctcccaagtctgatccagggattgtctgaactcctgacagggagagagacctaaagcttgagagagcttggggattgggtgccatgaggaaatggaaagataaaggaaaaagggaaagagaaatggtttagcctggaaaagaaatgctgcagggagagttgctggggagaaacacttacaatgaaagaggatctttcttgatgagtttgagtagttgactcactgggagattgggcaaattctgtagcaggaggaaagtggacataaggaaatgagttgatgaggcaggtagttcaattggctgggggtctttgagactcttcacccctggagggcttttaaaatatgggtcaagtgtttgccctggaatcatggtgggaggatagtcctgatgaccttttttgtttttatttttattttttgtttttgagacagagtctcgctttgttgccaaggctggagtgcagtggcgcgatctcagctcactgcagcctctgcctcttgtgttcaagttcccctgcctcagcctcctcaataatggattacagatgcacaccaccatgcccgggtaattttttgtattttttgtagagacggggtttcacccagttggccaggctggtcttgaactcctgacctcaagtgatccacctgcctcgacctcccaaagtgctgggattacaggcgtgagcaaccacgccccggccctgatggcctttcaaggtcattcttctttaaatgtttgtgagcacctcagacatgccaggaggggtactggaggcatttacagacatcttatttcttcctctactcaaccctgcaaggtgtatccccaatttacaggtgagaaaactgaggctcaggttaaagtacagaaccagggtttgagtgctggtgtctgatggtctgattccgtatatgtgtcctatgaccctgcacagtcctacacctacctgggacaggtctgctttcccttaggggctgtcatatgtcctcttggtttctagaagctctggttctgtctcctccatttcttcacatccatgacccagagccctgaccctgtgcttctccccgtcaggtgtgacccgggctgggaggggctgcactgtgagcgctgtgtgaggatgcctggctgccagcacggtacctgccaccagccatggcagtgcatctgccacagtggctgggcaggcaagttctgtgacaaaggtaggggggaggaagggtagcttttggttgggaaccccatgttcttaggggaacagccatcagtatttattgagtgcctattttgtccttgtcaaaccctcaaatacatggtattttatcatttttttaaatcttagactttttatatgttgtctgaattgatcctcaacataaccccatggggcaggaaacacagctgctaaaaattgtactcattttacagatgaggaaactaaggcccacagaagagctataacctgctcaaagtcaggtttttttgtttgttttgttttgagatggagtctcactctgtcacccaggctggagtgcagtggtgcgatctcggctcactgtaacctccgcctcctgggttcaagtgattctcgtgcctcagcctccccagtagctggaattacaggcacccgccacttcagctaatttttgtatttttagtagagatagggtttcaccatgttggccaggctggtctcgaactcctgacctcaagtgatccacccgccttggcctcccaaagtgctggaattataggcatgagccactgtaccggcctaatgtttgtatttttagtagagatggggttttgccatgttggccaggctggtcttgaactcctgacctcaagtcatctgcccaccttggtcttccaaagtgctgggattacaggcatgagccacagtacccagcccaaggtcagtttgagacagactgagagccagggccaggagcctcctgactccaaattcagtgttgttgtctctccctagcataccacgccagcctgggctgggtttgtagtatagccacacctacagaacctggggcctggaaggcgtggacaagtctggtctggggaccagatgggaggggttatcccagagcctttcctgtcccctctccagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcagggtgagtgctgggccctcagggtgagtggaaggttagaccagaacctggtgatgggatgagaaaagaggcaggactgttgggagggtgggggactgagagtcagacccacacggggacactcagataaaacccctgcatgccaaagtgttcctagttcagggtttctcaacttttttttttgtaccttctgagccatttcttcaacaatctataggagctagaggggtaacaaacgtgtgactgttctggttggggagggtgggtgtggggagactgaagggcctgggtctctcctcatcctctcctgaacgctggcttgcacccttctgtgtcacagtagggatgaggaaacagcctgcagggctggacttgtcctcatttctgcatcaggcccaggagcctgtgaggataataatagcacacttaccctgagccctgccttctggctgggccctgtgctaatggcttgacattgattatttcactcaaccctcacaattagggaagctgggtactatttttattctcatttttaaaatgaggtatttgaggctcggagtgtgtagcccaagatgacatggcgggcagtggtcaggatactgacctgggctgccctacaggtgttggtaagttggttatcatgtcctctctcacccctaccacagctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgc

SEQ ID NO: 38597 - DNA, 454267 bp, Homo sapiens
acttgacaaccagcatgccgagatggtaagaagtttccaccctccttcctcttttattctagacttcctcagaaatgacccccgcgcccgagcgccaccggggccgcccgggggccgtgtccgccctccggcccgcggcgtgaggggcaaggggcgctgaggagggcgggccggggaccagaaccccggtccgacctgatccccgctgcgctcccagtggcctcccctaaacttggccccaagtttctgaggcgagctctaggtgggagggtgcacgtgagagggggcttctcaaggtcggccccgctcgcggcttccgcgcgaaggtgagcggctggctaggggaggctccagggcgttggggacgggctggggggacgaggtggaggggagtgggggatgaatggagcgctggcaggagctcggggaagagaggaaggcggctgggacctacgggaacttttacaacttgccgccgagtgagggaccggcggctgggcgtgggtgccgggtgcgctggggcgcagccgcccgggcccggcacgttgactcttcctctccccttgtcttcacattcggaatcttcccgtggtaaatggagatgggaggaaatgctcccgcaggctttacggagaaggtgcagaacgcagggcaggaaaatcaaccttgcagagacggctcttttcgaagtgcaattctataggagccgatttgttttacttgcacgttgactggagggtgggatttggggcctggggagggagcagaataaaaaattatatatgctgaaaaaccctaggtgaaatctcctgtgaagtgagtttaaggttgaaaaaaagttccaagtgcaagtggtggaggagatgggctggctttgccaagcgagactccagcacagcccctctacgagaagcgacttctttgcagcgaggaagcgtgcaattagttcgcctggtgatgagccgctctgtccgctttcggggaagtgatttgttagaaatggggcttgaccactcccttctttttagtttgcttcctcccagcgtcgctattgttacccccacttggggatctgacatggtgtattccgtatatagagggaacatatgagaatacaggtgagatagcgggttggcattttttcctcttccctgctccctaatgtgacatctcttgtttcagtgatcaaagtcacaactggagtgtaggagatgggactgtcaaatgcaggggcgcgtacacacacacacacacacaaaagcaagagcccaggactgtggttacagtaacgctgacagaaattaaagtggttttgaaagcagcgtgcgatttatgatggttcccatttaccctagagtcaagctgttgtaaaactgacgtacaaaagacatcataaaataatcctgtgtacccaggattaaagtggcaaaaagtggcctgttttatttttatatacttcgtggacacttggaattgttgaaagccgtgtttaagtgagacatcacaacaatattaaatatatctgtttagagcttgagagtttttcttctaacgggcgttttacacaagaacactgtaaaagccggtggcaggtattatttttcttccctttaccctagcctatgttaactatttgtctacacatgtattcctatatcctaatgactttgaactgtggctaagcctgtctgccttccactgctttgtattctgcaatttcacgtgttactgtccacacgcatacatgctttaaatgggaggaatttatttctggcacgttacttagtgtgtctgatctgaagatgtaccctagtagtgagaccttgtacaagttaacagaacatttactttttggacaaacacacacacacacacaatcccttgtgagcctttagagagtatctgtgttttatatttgtagccgtttcatgtaaactgttcagtcttaatgaagttcttagttcccagagtgcgctgtattaaaagtccagattgctaatcactttaccaaagtacaggagtatctttacctgagggaagtaataacgagcttgaacctgaactttgttttgagtatcttttgagaaaggtctgaaactttttttcctcttgagaatattaagttgggtggtgtttgcatgtaagactttgaataagaataaactgtgcattatattttacaattaatattaggaaaatgttaatagcagtacattcctactacctgattttttcttctatttgagatgtaagatatctgtcagatagagatatgtgattacaaaaagaagcagacaaaagcagagctgactattgctatattaaaatgtaagtgttacagtttgaattttcaagtgagagttcttgagttcagtgctttacataacattttgtcctaatcttgcttgctgtcagggatgtttcatggttgtgcaattgctgcagtcaagaatgccaatttgcattccaggagtgtcatttgattacttttatctgcacagctccaagaccggcccagacctctcgtttcatcttgccatgtcacgagtcaatgctgtgtcgtcttttcaaaaatctgcctgatttagacaagaaagaaaagtactttcatgttgcagccgcagtcccctgctaacttgtcagcagcaggatatgattcacttgggcccagaagaatggaacagagaggcgggttaggcggttcaataaagcccacggacaggtagtgtgtgacatccccagagagccgcagttaatgaagaacaggtctgcttagttctccacacgctgacctggtgctgtccccacagttttctcatttgatctttcccagcaaattgatcttttcttgtatttttttgccttccaagttagtccttgtgggactgaaattagcagagcaacttaagttggataatacagctgttcagaaaagaagaaattggacactggctcaaaaaggggtgggggtgggggggtagagggagctattctttttgttgttgttcctgggaatatttcttatattaagggagtccaaaatagatgatgacttgaagttagtggtttcctttacttttaattttacagttaagggttcagcacggttttaaatattccttaagtatttgaaagatggccttagtgaatatgaggagttcaatttagtactgttcacattcacttgtttgagatgatttgccagttgacaatgtggcttttatggttattgtaagatggcatacttcaactgtattatttatagtcttctaaacaacctacgatccccaaatatccaatactaaattgcaggtaagattaaacaataaaaaagtcattatactagtattgtgtataaatactatggtacatgaaaatgttttctatactattagcatctttgttttatataaaccccacagatacagttcatgaagtgtttttttcctgaatttttgagattctgcatttaaatgtagatttttaaaactgagaccagaccacaagtttgaatttctgtggatgttcatacatgttgttgttttttgacattaaaattaattttagacaggatgggtaaatttatgtcgtatggtttaatctgattaaagtttcactatagaattctgtacataaagcttaggttggaagcagtttatagattcttaacttgataaatatataaggagcaacgctttctgatttactcagcagatggtctcatttaccatctacatccttacaagaaacagagtggaaaacatttcttgtggaaggggaggtagcctcctcaaatctttcctgttggatgggaattatatagtatcattggttagtaaaatcccctctgaagagctagagggagcctcatgattttattagatatacttaaggtttaaaaaacactctggccatcagaatgttgcacaaaaagagtaggtaatgaatactggctcagtgttgaggctgggaggtgctattatggttttttttttttttttttttttaaaagtgacagaagcaaaagaactttctacaagaacagtcaaggcgtcagctaagctttctaggcttttgcctttcaggtgatttgaagatcaggcaaaatgcaaccagatactatattttaaatgttttggtttgactaactactgtttgtagtttttgtcaactgagggagttactctcgttttaggaggccagtcttcagagttctattaaaagtagcttcctacgaaatcaccgagaagtgggttaacttcttttagtttatgaaggacaaccccttttctgtaaatgatggttttggagtagttctacatacaacttctgtattccagagagaaattttctttaaaataaatgcttcctgttataagcataaatgttaaactatttataaacctgacttattatggatcaaaaaataagttaaagaaataggatttaaatgatattacattcaataattgtcatttaatttcatatttaccactttccattaacatttgtgatacagttatgttaaagagtcattgatcataattgcactttaatatttatatactagtttttaggagcattactttagacaaacatatttatcatttaagtaaataatataatccagtgagataaactacccagatttgtccttcttaaaatcttttgcacagtagctctcattatgttgctagccaataaaagtctttatttgttgcttattagaaccctcagtacactcaagagttcagctataatttaatttggctgttcaaagagcctcccttgttttgaaatatattctcagtatgcttttaccatttgttacgaacccatattctaactcaatgcgtaagaacctatattctaactcaatatgcgtaagaatgatattacagatatatcattctttaagtttttgctatcgtcataacttttttcctttaaaaatatccgtacataacaatatcagttttgttctttttgctctattttctctttgacattctagagtatttttctcttggtgatttaaattgttttgctgttataatttaaaataaacttcctaaggaatacaaccttcccttgaggtatagtgagaagggcaccaaaaaataataggttcgataattaagaattctagctgaggccatttcacagttgcaatcacttacaattacaaaaagtttgcctggtacttcacaaattgctagtaactgctgtgaagtttttcaatgagtagaaggtggctttgagagttttggttgtatttgtaacaaattacgttcactaaagactagaacttgactataaaactctaataagatgagtatcaggaattcttccataaggaaggcagaatgtgaaactcctaaatgactcactgtgtatgtatcttaccagtgggaatagcatcaagccagccttctagatacagtatttaatagttgtcaaaatgtacagtattgtcttggaacttgtggttcatgagttcatagtccctgcttttttgtgtttattacaaagatgtaacaacctacacaaaacatttttctcttataatgaccttacatttgccaaagtgccccatgctgaaattccttttcagtgtctttttttttttttttttcagtccaaagccagacgtgtacccagacacaaaagcctctgtgtatagcaagctgttttaaatattgtgactcgacgatgtgctgtcctttctctgcttgagccaaggatctctgctcagtgtctgtggattaccaagctccttctttattgtacctcttgtcaactattcctattcatttaacctttcattagtgtctgtgcagcttcactgtctggaaaggcaaggaaaaaccgaaaggccccactgtcacagttattagatttctcggttacatcccagcaaccgtaaagaagtaagcgtcgagactattgtcgtgcatgctgctgtcctggggtgcagctcttctgtgcatgtcaaggacatgtgccacatgttgatatgcatcccagggataaatgcacaacatgggggataggccgacgctggcagtaatgagctttgtaggagttattgcaaagaccaacagtttgtgaaggaattttgcttaacaggccaaggagatagacagagttgagggttgccaagatttgcctgtgcggggcttgtcagtcacattgttttcatccaaacttcatttgaggggaaaattgaatacatttgacagcaatggaaagtcttattttcttttttcaaatctttcagaggacaaaagcagtatttctggtgactaacataactatttttagtactgactaaatcatatatatgaatggatctattagcagtttatctttttccatatctagagaataattaaaagatatttcatagatgtcatatatatgttttaaaatctatgtaaaaataatgtagcctattaattttcctttgctcttttcctcctttgattttcctctagcatagcctggttctttagaaatacatttgcttaattggctagatgcagaggagaaaaaggatgataatgtggtcattttcaaatcataaataaaataagtatttgtaaattttgtattggaaaatattattttaaaatcttagagatgaagagaattacctttttaagaattctgaaaacacttgaatagaaaatggtacattataatacatttgtccctctttacccaaaagtttgtctttttttcttttttaaactaggagaaccgtttttactgagggtaaataaaatatttttgtctcctgatttcaacagattttgtcagttttccaaactcttttggggttctccaataacttttcaaatatgttaatgacttattgccaaatccctgtaaagttatttttaatttttcttgaccttacctcttttaggcaaggctttttaacagttgtactttctctgttaaggttttttttgaaacggaatctcgctctgtcgcccaaactagagtgcagtggcgtgattttggctcactgcaacctccatctcctgggttcaagagattctcctgcctcagcctcccgattagctgggactacaagcgtgcgccactgcgcttggctaatttttgtatttttagtagggacaaggtttcaccatgttgtccaggctggtcccgaactcctgacctcaggtgatccactggcctcggcctcccaaagtgctgggattacagtgtgatcccacagtgagccactgtgcccagccacctctattaagcttttcttagtgtcttgtgaaagtatgggctaagttatccttgttttagggagagagagttatttttcatagtctttcccccaggtgggatgctaaatgcccagctatcctatcctagggctatgccccagccttttggccagcgggcggaagtactgtgtagaatatattgagatggggcagggcgtggtggctcatgcctgtaatcccagcactttgggaggctcaggtgggtggatcacaaggtcaggagttcaagaccagcctggccaatatggtgaaaccccgtctttactaaaaatacaaaaattagctgggcgtggtggcgggcacctataatcccagctactcgggaggctgaggcaggagaatcacttgaacctgggaggcggaggttgcagtgagccaagatctcgccactgcactctagcctgagcgacagagcaagactttgtctcaaaaaaaaaaaaaaaaatctatctatatatagctatatatagatgaatctgccgtggtcatctaaggctggtgaccttcccacagaaaaagcatgagtgtcttaacattcctttttctaacagtttcatttccatttattatggtttgtgttgggagtagtagaagagaaaagagggacttgtgaagatgaaggccataattttaactcttcccctggcaatgaaaacccccaaattagaacaaaataggttagtgctgtgtggtaattaaagagagaggaatacatggcagtagctactctctgcaggtatcctgcacttgttctttatccagtcagtatctctacgcaggtgactggctgtttcttggaaggcagttgtactgttgcctgttagagactcagaacagcgctgggacggggtatctatagaggccctgttctattccacctacttttgatagcctgtgttctctcatttgtaagtcaagtgagtttggtaatttctaagtgcctttccaaatggtacatttcatattttatataacactatataatcatagcagtttgctgttattagctttattgagatataactcacccacttaaaatgtacattaatattccattttatggatgtactacctcttatatatccattcaatgaaagcacatttgggttgtttacactttttgagtaatgtggccctgaacattcatgtacaagtttttgtggacataatgttttcatttctcttgggtatatgctcaagagtagaattgttggatagtatggcctatctacttataactttttgaggaacttccaaattgttttccaacgcaactgcagcattttacttttcaaccaatagtgtataattcttccagtctctctacaccctcctcaacacttgttatgtgtcttttttttttttgtcttttgagatggagtctcgctctgtcgcccaggctggagtccagtggtgcaatctcggctcactgcaagctccacctcccaggttcacgccattctcctgcctcagccttctgagtagctgggactacaggcgcccgccaccatgactggctaattttttgtatttttagtagagacgttgtttcactgtgttagccaggatggtctcgatctcctgacctcgtcatcctcccgcctcggcctcccaaagtgttgggatttcaggcgtgagccaccgcgcctggcccttgttattgtctttttatttttacagatcttagtgggtgtgaagtagtatctttttatttgaatcatactagtgactatgaagtgatatctctgtggttttgatttgcatttgcctgatggctagtgatgttgagcatcttatgcactttattggccatttgtgtatcttttctggaaaacagagacatgtctccattggccatttttcacttgggttatttgtctttttattatgcagttttaagtgctgtttatatattctgagtacaagccctctgctaggtacaaggtttgcaaatactttatcctattctgtgggttgtctttatttatttatttatttttaaagagacagggtctttctagttctgttgtgcaggttggagtgcagtggtatgattatggctcactgcagccttgaactcctgggctcaagaaatcctcctgcttcagcctccgtagtaattgggactacaagtgcaagccacgatgcctggttaatttatatatatatatatatatattttgtagagatagggtattaccatgttgcccagcctggtttcaaactcctggcctcaagcgatcctgtttccttgaccccccaaaattctgggattacaggcataagccactgtgactgtgcgcagctgtctttttttttttttgagacagagtcttgctctggcgctcaggcagtggcgtgatctcagctcactgcaacctccacctcttgggtttaagccattgtcctgcctcagcgtcccgagtagctggcattacaggcatgtgccaacatgcccggctaatttttgtatttttagtggagatagggtttctctatgttggccaggctggtctctttaaactcctggcctcaggtgatctgctggtcttggcctcccaaagtgctgggattactggcatgagccaccacgcccagccccggctgtcttttgactttttgatggtgccttttcaagcacagaaatttttgatgaagtctaatttatcaatttttgttgttgttgatgtttctgtccttggtatgctatctaagaaactattgtctaacccaagatcatgaagatttacctctgtgttttttttgataagtgtcttacagtttgagctcccacagggtggattcatagatctttaatccatttggattaacttctgtaaatagtatgaggtaggggtacaactttattcttttgaatgtggatgtctgttgttcccagcactatttgttgaaaagacagtttttctccattgaggtgtctgggtacccttgtcaaaaattaattgaccatgatatataagggtttatttctggaatttctgttctattccattgatctttctgtctgtccttgtgccagtaccacactgtcttgactactgtagctttgtattaagttttgcaattgagaagtgtgagtcctacaacttcgttctgttcttctttttcaagattgttttagccattcttagttccttagaagttgactttttaaaaagcaatttggattgtggtagaaaacaacgtaaaatgtatcttgttaatccttttttttttttgagatggagtctcactctgtcgtccatgctggagtgcagtggtgtgatctcggctcactgcagcctccacctccctggttcaagcaattcccctgcctgagtctcccaagtagctgggattacaggcacatggcaccatgactggctaatttttttgtatttttagtagagatggggtttcaccatgttggccagactgttctccaactcttgacctcagcattctgcccgccttggcctcccaaagtgctgggataacaggcgtgagccgccgtgcctggcccatgttaaccatttttaagtgtacagttcagtagtgttttctgtaacttaacgtacagcagatctctagaacattttcattctgcaaagctgaaattttttaacctttgaataacaactcccgtttaccttttcctcccagccctgggaaaccactattctagcttctatttctaagagtttgcctactttagatgcctcatagaagtggaatcatgcagtacatatttgtctttttgttccggcttatttcacttagctagaaacttaatgttcttaaggttcatttatgttgtagcatacaacagaattgtcttcatttttaaggctaaataatatttcatcatatgtatataccacattttctttatccattcatctgtagatagacatttagtttgctttccacctcttggctcttgtgaattatgctgttgtgaatataagtatgcaaatagctgtaaaagatactgctttcaatctttggacatatatgtagaagtgggatagctggatcatacagtagttcttaattttttgaggaacctccatactgttttctataagggcagcatcgtttacattcctgccaacagtgcacaagggttccaatttctctacaacctcacagcttattatttcctgttttttttttttgatggtaaccattcaaaaatggttgaggtgatatctcagtgtggttttgatttgcctttccttgattcctgatgttaagcatattttcacgtgctttttgggcatttgtatatgtcctctttgtggacatatctattcaagtccttcacctatttttaaatcaggctttttttgttgttgttgagttttaagagttgtctatatgtctataccccttatcagaaatatgatttacacattttttctcactttctatagtttatctcttcactctgctgattgtttcctttgcttttgcagcacagaagtttcttttttctttttttcttttttttttgagatggagtctccctctttcgcccaggctggagtgcagtggtgcaatcttggctcactgcaaactccgcctcccgggttcacgccattctcctgcctcagcctcccgagtagctgggactacaggcacccgccaccatgcctggctaatttttttgtatttttcatagagacggggttttaccatgttagccaggatggtcttgatcctcctgacctcgtgatccacccgcctcggcctcccaaagtgctgggattacaggcgtgagccaccgcgcctggccagaagtttctaagtttgattcagttccatttgtctattcttgcttttgttgcctttagcagtttacttttaaagctcagatatgtctgatcctcagaagagtaaaggctacattaaaaaagtacattctattgtttaggtaaaaaagtcttggtagtactccaggggacaagaaatatgtcatttggtagccaaaaaatgatagctcctggttccctgtgaaacaccctggttttactttgatgtttcttaattatcattgagtttaaaagcattctaggtgttccgtatgataagagacacacttcatgccctgaagggtggaattaagtacccagaaataattgtttttggttttataaatacctcaaaaggaaagggggaagaaaaccattattgagaaaatttgtcttcctagacatcccgtcatgactagaaaaacaccaacagagataaaactaaaaattattgtatgatctccaaacccaaaataactggtccagtgaagttttatataaataaccatgttcaaatctggtatagcatatttggaaacatgagcttgctttacagtttacctggcaaattttgtaattaaaatacctcatcgttgaattagagaaacttgagagcaaatgaaaggtaacttaatttagaggcagctatattgcttcattgttgaattaaaagaaatattcattcccttacagttctaattttctctttattcatgctaataaaggctgatatttattttcatctaagtaattgcttttctagtattctgatggaccattcttcactgcattgtctgtttctggccttttgccagttattttagacaaaagtttcattatttagtcagcatcaactattaattagatatgtaactgttcaaatttatacaaagcgagtgtgcattttttcatcataagtgtttacgtacataaagagtaattatccaatttaaaatgatatgatgtattttaaggataattttttttttccctaggggaaacaattctgtgaaaattctgtagaggatttaaaatcacttctttttttttttttttttttttttttatttgagacagagtctcactctgttgcccaggctggtgtgcagtggcacaatgtcggctcactgcaacctccgccggccgatttcaagtgattctcctgccttagcctcccgagtagctgggattacaggtgcctgccaacccgcccggctaattttgttttgtatgtttagacggggtttcaccacgctggacaggctgatctcgaactcctgacctctggtgatctgcccacctcaacctcccaaagtgctgggattacatgcgtgagccactgtgcctggcctgaaatcacttctaaaaattgttacagtaaaaattttatgtttaccagacgtaaattttggttacatatacatttatcccaattgacacattttattcatactgaataaaacattaatgttacttttctattttttatgatgtattttgacatgtgtttagatgtatgttttatatgtatggactgacaaaatcatatatgctattatttggcatcttatgtggttggaggtcataaagaatgtaagtaactgaaacaatacatttgctcaaagaaaggccactcaattctctgccctgtggtatctaatctccctgtaatacacatttcaccatctaggattggagaagttcattctatcaacacgaatgctaacaggtaggcttctggaagtacaatgtgatagttcagatctttctctgattcaaaatggtgatttaaaagaaaacatacttggctgaattggcttttgatagactaaaacattaatttgccttaatgtgcattaacgctaaaggatactaaaaaacaaaaatttttttaaacccagaaattctaccaggtctggagccatatttttcacccagtaaatgtcccttgtaagaaatatatttacacgaagggctgggtgcagtggtgcatgcctgtagtcccaactatttgggaggctgaggcaggagaatcattttgagtctagaagtacaagtccagcctgggcaagatagtgagatcctgtctctaaaaaaataaataagaaatattttcgcttcaagaatttatttatatctgtgcattggtctttgaagcttcccttttgtctgtaaacagcaaccagtcgctgacatgacatatttgtgtacaaaggacagtgataattagatatgctggaatttgtgtgtgtgtgtgtgtgtgtgtgtgagagagagagagagtgtgtgtgaagaaatatggatgagaaactggtagtttgctgcttccttatgggggagggtagaaggcagaatagaaggtagaatagtatagttgactgaaatttttttggaggggaagggcagggtttaccattaatgtactttcattttgcaatagataatacttgatacattgttttttgtggtttttaacatatatttatggatggcatggatgaatgttgagtgtcttacttactgttttactagtatgactgtcaaattgcattcctgaagtacggatatgctaaggtaataaatctgctagcagccagcaagtaaatgtttacttactatatatggaataacttgctgcagatttccatgaaacaacattagacaattgtgtactgatttggtaaaaataaaaaagatgtggccgggtgtggtggctcacgcctgtaatcccagcactttgggaggccgaggcaggcagatcatggggtcaggagatcgagaccatcctggctaacatggtgaaaccccgtctctacttaaaaaaaaaaaaaaatacaagaaatcagccgggcgtggtcgcgggcgcctgtagtcccagctacgtgggaggctgaggcaggagaatggcgtgaacccgggaggtggaggttgcagtgagccgagattgcgccgctgcactccagcctgggcgacagagcgagactccgtctcaaaaaacaaaaaaaagatgcttttaaaaattgttagattttgatgttcaagctgtacatttggcgtaggcatgggacttctaattgccttcatttgccaaagtataacaacctttttttattttagaatacaacaatttaacaagcgtttgaatttctatgatgtatgtgatactctattaggtgccataggtattacagatgaagtagaagctgtcatcctaagagagagcacaaaattcactggtaaagggatattcattatcttaaaagaattaaccatagtccatggtcttcctctggcatatgaagccttaggaacctaattttgttaacataccattgagaaagatcaccttttcatggatgcattcagtttgttcaccagctgaggagtggagatcacacacacacacacacacgccatgtgaacatgtatgtatctgtataccatatgaggtggaatactcatgtactcatattgaaatgattagtacgtcttctccttggcaggcaaatttaaatggggagtcagattataatccaaatgttgttcatctctttatggggttggaatttcagcagagaatattaagggtgggatgggggcctgagggtcttctcctcctatagagaaattctttccagtgacctgtgatgttcacggtgcacactttggactcctttcctgggctgtgcttgtaagagtattgacagtgtttacccctcttgctttttttctgctaccattgcccttgtgatagacaaatttctctttctttagatacgttaatattctcaagcagatattaggcaactgtcctgggagctagttgttaaggtgactttgcctctctttggttttttatggatctaatgcagatggcagtctcatttcactcgtttcaaattttcttgggggatacctcatgctactgccttacacataacatgttttgtatacggataagtggaaatggtggaaaaaaagatatatattgcaagaaaaaaaagacttagaaactagttattaaatacctggtagagaaagtttcttttgttaaatgccttatagagaaatatcttgatctgaaattgactttatatacaggtggaataaactgctctagaaatcaagagggagtatgtgtatttaatctctgtatctgttttctgtgtctcttttccatcctaaaataagggttaagattaggttttaaagattcttaataattctgtacattgtgtgatgcccaccatctatttgtggtattattttatggaccagaaagttaaagctgtacctttaatttcacattggttaattctagcagcttcccaattagtgtcatttttttacctttcaatctttccttccttttaaaacacttgaacatcaagaataatctgctatgggaagagaaagtagaaaggaaagacactgaacaaacatccacttgatgttaggcagcaggacagaagttggtggtccagggagcagcctgccggcctggtgtccttaggctccagtctgactttagaagtcccatgtctatgaacttacatccataagttcaggcgacatgtaagtttccgagcagtcatagtacaagcatgtaatgtgagaattttattatttaaacccgcagagcttaatgaactccaaattttattttattttatttttttgagacagagtctccctctattgctcaggctagagtgcagtggctcagtcttggctcactgcaacctctgtctcccaggttcaagcagttctcctgcctcaccctcccgagtagctgggattacagatatgcactaccacgtccagctaattttttgtagttttagtacagacagggtttcaccatgttggccaggctggtcttgaactcctgacctcaagagattgacccatctcagcctcctaaagtggtgggattgcaggcgcgagccacagcgcccagctgcaaattttaaatttgaaaatgtgtctgaaatgaaaataaagtgaggggaggtgttggagagaatggagaaattgcacaggaattgtagaacatggattaaaatgtaattagaaagttacgttgaaaatcaaagaactagttaaaatgagtgtcattatgctttttttttttttttttgagacaaggtctcactctcatcactcaggctggagtgcagtggcatgatcatggctcactgcagcctcgacctccctgggctcaggtgatcctccaccttagcctcctaactgggcctacagctgcatgccaccacggccagctagttttttgtagagatggagttttgccatgctggccaggctggtcatgaactcctgaccttaagtgatccgcctgcctgggcctcccaaagtgctgggattacaggcgtgagccactgtatcctgcccagaatactattgtatcttctaagtggcctagtacttctatgcttgcctctctcctcccactactcctagaagactatccacaggttgatcacttcttatctcacaaccttccagtgacttcttatcatacctgcagtgaaatcccaactccttaccatcactgaaaaggatatgtaatgtttgtgacccagcccaactctgacgccgtttcctgccactgctccctctaatccagccttgctgattttccacaggccatagaactttgctaagctggtacctacctcagccctttgcatggggtttttctctgcctgtgaggttcttttttttcacacttttgcagggcttcctccctcatttcactagagtctcctctggaatgtcagtcctttaaagagaccttcctgccaaccttccctcctgtgtccctatcagtgtatgtttctttggtctcttaccctgatttttttcttcacagcacactgccgcttgaaagtatatttaatttttttatttacatgtagtttatcttcccaccaccatgaagccccataagaacagggtcctttgtcttactaattctgcatttccattacctgtagcaacactcaacaaatatttattgaatgaatgaatggatgaatatctcacatatgattgtccttgtgaatatgaacggattctttatcaatagttatcaaaacttatttattataaccattgagagttctttggcatctgctgctgaacttttctgaactgcttatgcttagctcagttggaatagtggtttccaggatagatgtaaacacttcaaggggtatgcagaaatcatcctttacgatttgggggaaaatatattagaaatttgatttatcttgttcacctatttttgtgttttatagtgtgcatgatatatatataaggggaacattgtgctgtcaaaaaaactgagactggatagagcatgatctggacaggatggttaactttgtttaaagcaaaatgtatctctgtagtcaggctattttacagattttgtgcttttgtataataaggcggtgtgactgcgggtgagagtgtaaaatctgttcccactcttcaaaagatcacacatctcatgttgagttgaaagtgaaatattatatatgagattcagcatgaatgtgtatatctatatgttttatttaatattcatcctctggtggaatttacaagtctcttcagttcagggtatacctgttttggggtcctttgtacctgtgctaacatatgtgtgagaagtatgtgagctctttcagtgactgaaaaaattattacttgattggtctgttttggcgtgatctgggcttttgattaatctttgaataactttttccttcatttttaatagttcaggcttgttaatgatgcttcactggcttctttgggtatctgtgacttaagtttttaaaaacagttttattgagaaataatttgcataccatagaattcattgctatgaaaagttttacagtaccattttataattacatgtgattttcaagacacaggaaaataaagaaatggtatgcttagaatttggaagaaagtctagttatgttttcattttatttttatttttttgagacagggtctcaccctgtcacccaggctggagtgtagtggcatgatcatggctcactgcagccttgacctgctgggctccagcaatcctactgcctcagcctcctgagtagctgggactacacgcatgagccatcatgcctgggtaagtttttttttttgtagagacaaggtctcactatgctgcccaggctggtctcaaactcctgggatcaagcaatcctcctgccttggcctcccaaagtgctgggattataggcatgagccactgcacccagccgctgtactgattttaaatactttttaagtgaaatgagattttataacatttgaagaacttaaaatgtttgacaggattaataaatttgaatgaagcattgaaataattactatactaatgaatacactaaggaaatttgaaaaccacaaataagcagttacaaataagtattattatttataaaatagtcaccctagaagatgatgcagtgatggtgtcatagcttaaaatgctcttggaggtcttcattttacattgatttcagacagcctgtgtctagttcttctaagcgtctttggtgctagcaaatcttccatgacataagctttgattttctgaatcttcaaaagtcttttggtgttaacttacttggtgggtgttaaaacaagataattctatttttgatttttttttttatttactttttagaagcagagtctccctctgtcaccctgaccggagtgcagtgatgcaataataactcactgcagccttgaactcttggacttaagcgatccccctacctcagcttcctgaggtattgttcaggctagtctccaactcctggactcaagtgatccttccaccttcaccttccacagtggtggaattacaggcatgggctaccacccccagcctatttttgatttagaaaaaagacaacattgatttttcacatatagtttacaagttggccctagaagtatttacagatgatgagttctagaaatattttgagcaatggtagcattgttggaagaagtacagtgtcttaagctgacaattttgacattgattctttcctcccactagttatggagcttctttaaatctataaaaagccatttcactatataagaattggtatcatattttgtgcacttatagattcatgcgtaccatacatgcatgcttataaatatcattccactgaccaaagtgtgttattattttgtagccctttgtagccagctctatgttttaagtgcctgataaattctactgtagagtgaattttttctattctaagtaaaattttggagcctgagaaggcttctaaaggcaaaggatatcaagaaaagttttaactaagatgtgagactgcatgagtgcttcatgatacgaaatggttttatatataggtcttagataagaaattagagaggttgacagataacctacctagtctgtttttttagttgagcaaatctgtgtgtggggggcataaacaaatactagtgacattagaaatcagaaagctagtgaagtacaaatttgtgcacataacactgtttgtgggacagccttattcatactggtctttgacaaaagtcaaaggaaaaagtagttgccaaagaggaatatgacttttttttttgtactttagggtttgtttttgaatttcagcaagttatggtttgaggtaatactaatcagtttttttatgttgactttttggttatcaattaagaaaagcattagtgctttggaaaaatctgtgttgttgaacttcttccaatttgtatacaacctcttctccacagcgtaaaatgcaaattttgcatggggtcaggtgcggtggctcacgcctatagtcccagcactttgggaggcagaggcgagtaggtcacttgaagtcaggagttcgggaccagcctggccaacatggtgaaaccccatctctactaaaaatacaaaaattagtcgggcgtggtggcatgcgcctgtaatctcagctactttgggggctgaggcaggagacttgcttgaacttgggaggtggaggttgcagcgagccgagattgcgccactgtactccagcctgggcgacagagggagactccatctcaaaaaaaaaaaaaaaaaaaaaaaatcttttgcatggaatctgcagatctaggaatcattttattgttaaaaatataactagcaattttgaaaattcagtctgctttgtgaagtcagactctagaaaatttatagatttttttggtggggggaatgagagttcgggaaataaaaagaaatgaaataaatttgactccaggaaagctaattttacatttgtttcttcattcctccctggggctctctgaaactctggaattttctcatttaaaagaaagctagaacaacctgtgttggacatacaggttgagcctctggtatttgaaatgcttgggaccaaaattcagatttattcagattttggaatatttacatttacataatggggtatctcagggacaggacctaagtctaaacatgaaattcattaatttttcttatatattttatacacatagcctggaagtaattttgtatatttttacattttatgcctgaattaaagtttgtgtacgtggacatcagaaagcaatggtgtcaggtgtggaattttccacttaggacatgttggtactcaaaaagtgtgggattttagagcattttatgatttttggatttaggatgctcagcctgtaaacttgagggtcaaacttttcttgtgttagttgaaatctcctgggtgctttcttttaaccaaatcccaaagtcttttttataactaatatgctagatttcctacattgttttatgaaggtagagagggtccttagcaggccttgttttcaggtgtaaagttctgctggaccaaaacctgagggcgtaattaacagtgtctttggagggactgtttgtgctgtcttcatggaccatttggctcataagatgggatttggttcataattcattgtcatgtactgtaactcctgtgggagtataacgtctagctgttttgcattggataggttctgaatgctttatcttgttccagggtggattattatactcaagaatgcacttaattacaagctttatgtttccagcacccattcacaatacctcctcttcactacacctgacttcatcgatggaatttcatttgtagattgacttgggagatggaagctgtcagacttgaagtctgcctcctttttttggtgccttctctttactttgatattttgaacctttctaacttaaaatttgtttttaggttaattttctcagcaaaagaaatttatgtttgataagatactaagggaaaaggcagcatttattaatattggatgtttcctaattagaatatcttaagagtttgaattttgttgtgttttcataagctactgcatcataggtttcattgtctttgaacagagacttagaaaagggatgctttggaatatttcttgtttcagtcttttgagattgaacacacaggtttcttacaggatttgttttttatgtatttatgtaacctgtctctccagtttcctgaattcatgcttcatatgagcttaatcatactttattttaaataatcaactgtttacacatctaccgcacatgctgctccgtagattctcaggtgtatctttatggtcttttcatttttctgtctttatcaaggaataaatgatcctaactggatcatgatttacttgtggatttattcaatagttttgtgttttagtttttaaagccttgctcaatggttatggtttggggatatcttgatatatctcggacaagcttttaattgtcaaaattaagttatactaccttgtatattttagtcttagaatttaatgttctattcctgattgaaaaacctgtgactagcacttcaaaatttcctaaacgtgtttggtcaattcttttttcctttttaaccaaatgaattttataaagtcaacttccttaatttgtaatgtaggctcagtgaaagcttcagggttgttgcccgccgcccccccccccccgccccgagaaatcttcagagagatgtttaaacaaatcaaaatatacttaaagtgtaaaaaaggtaatttgatgtggcaagttttaaataaataaaaaaaataaacgcacacactccataacctttctttgagtcttggtttaagttctctgtcatatagtgccaaaaactttgttttgagctgcgtgtgtgttgaaacatgtatgcctgtcctagtgtcataactaattatatctcttatatgcttacttctagtaattggaaagtagacctaccgcagcatacatcttcacatttagttttatcttgaggacctgctacagagatcattttctaccatgcagcaacttgacattgtgaacagatattactattttaaatatattatctactttgtgttttgcagaaatagtgtactttcagggaagttaagtttcgggtgtttccaaagcacatctgtctttaccagtaattatacactaatactgcctttgcagttttgactgagatatttcatctgtgaattggaaattgatggcctagtgctgtgatagcaaaattttataggatttctttttactcaaagttttcaaaagattgtggctgatggaaaacctgctggtgctttggtcacttactcttcatggattggtctaaaataatttggggcttcttttgtaaaagtgtattgtagaattttcacaaacttagaaatcctgtcttagatatgcttatgactggggccgcaaactgtttctcatatgcaccagcttgtatgaaaatatgtggtccttgtccatgcctgctgaaagagaaaccctaccagtcttcagtttctgagctgcagccttgtcgaaattaaagtcttaggactgggagcagttaatgctggtgatagattgtggtatttagcgctgtgctgtgttgcgtggtggacttacacgattctagtcagaacttgggaaagaatataccacagaattggtgacaaatatttttcaaagagaaatacgatgacttttcttattaatgagcagaccttttgggctttgcttaaggaaatagtgaaaagattgtacagttctgttattgataatggtttagaatttaacactgaaaatgctggattttctttcctcttattaagttaatgtattactttgaagcatcttttctttttttacagttagaaattcaccaaaactatatttcaaacgtagctctttttaattttatactaaattaatttttttttttttttttgagacggtgtctcgctctgtctcccacgttggagtgcagtggcgcgatctggggtcagtgcaagctccgtctcctgggttcacgccattctcctgcgtcagcctccggactgcaggtgcccgccaccgcggccagctaatttttttgtatttttagtagagacggggtttcaccgtgttagccaggatggtctcaatctcctgacctcctgatccgcccgtctcggcctcccaaagtgctgggattacaggcgtgagccaccgcgcccgggccactaaattagtttttataaattctgcattgtttctgtcatatggtaacttaagtatgcagaggcattgaacttgaacattttgtgttctggaacgtggggtttggattcttggtataattttcctattttatttttattttattttgagacggagtcttgctttgtcgcccaggctggagtgcagaggtgcgatctcggctcactgcaagctccgcctctcaagttcacgccattctcctgcctcggcctcccaagtagctgggactacaggcccacgccgctacacccggctaattttttgtatttttagtagagatggggtttcactgtgttagccaggatggtctcgatctcctgaccttgtgatccgcccgccttggcctcccaaattgctgggattacaggtgtgagccaccgcgcccggccaattttcctattttgaaaacccaactaccgtggtttctttctaatgcgtatattatgacttgtagcatttgaaaagctccatggtctaggccatgtgacttctgaggactgtaactgtaaaaaagctggtgttgaataattaaaaactccctccattttaaaaaaatgcccatttctcttagaatttttatggtgtcagtcaaattaatgcaggtatgtttggttttaagaataacatgatagaaatccgaatttacactgataggctgcctaagagaaagttatttcaaaacatggggcatcctggcagtgcctgggaaggttggcccccagcccgactgataggaacttcctactcatcagttcgctgtgaagtactgacaggtggagggggtttaggcttctttgggttctgaacctggtgatgctactacctacacagtgtttggaaatcttgggcgatgttttgtttgtcacaaatgactcaactggggggctgcctcctgctatttagtgggtcagggacactgcagcatcaggattgcagaacaatttacatacagtgatgagttgttctgccccaaataccaataatacctttcccagaaatgactggatagttattgatataaaaaaatgaaaaatggctgggtgcggtggcgcatgcctgtaatcccagcactttggccaaggcaggtggatcacctgaggtaaggagtccgagaccagcctggccaacatggtgaaaacccgtctctactaaaaatacaaaaattagccgggcgtggtggcgggtgcctgtagtcccagctactcgggaggctgaggcaggaagaatcgcttgaacctggtaggcggaggttgcagtgagccgagatctcgccactgcactccagcctgggtgacagagcgagactccgtctcaaaaaaaaaaaaaaaaaaaaaagaaaagaaaaatattcgtaaaaatactactcttgctccccatccctagaattaccacctgacatcttttttttttaaaggaatgttgattttttttaaggtgtgtacttgattgaacactgaattctacttcttaacgtttttaagtaaacatgatttgtaaaggcatatggatattttatgcagttggtatattaatagtatttagtcgtaagcccccaactcaaacccagatatacccgtttttgcaaacacccatcagattttgtgtcagtgtttggtaaactagcacttaaaatgtgtgttgaaactcctgtctgtaatttttttttgtaacgtaaaaaaaaaaacttatgagaaattgctaaactcttataagatttattattattatttttgtagagatggtgactcactatgttgcccaggctggtcttgaactcctagccttgagctatcctcgtgcttcgtaggtgtgagcaaccgtgtctggccaaaagatttttaaatgaacaacaacaacaacaaaaaacctaagagtaaaaaccagaatttgataaaaacagatatttcacatactcgttgcatcctcatggcattatcagttctggcattttgacttggaagaaaaattctaacatgaatttctgcttgaattctaacatgaattctgcttgttttcaaatactattcaattgggagtaactgtttgatgaaaagcgtagtacctaaacctcttctccttccacacacatttgtagtcttacatggtaaacctaaagtagctcagaaacatttactaaaacccatttacttggtaatagatttttcatttataaaaaaggagcttaagaatatgtaggctgggcatggtggctcacgcctgtaatcccagtacttcaggaggccaaggcgggtggatcacttgaggtcaggagttggagaccagcctggccaacatggcaaaaccctgtctctactaaaaatacagaaattagctgggtgtggtagtgtgcacctgtaatcccagctactctgaggctgaggcagtggaggctgaggcttgagcccgggaggcggagcttgcagtaagctgagatttttgccactgcactccagcctaggcgacagagcaagactccgtctcacacacaaaaaaggaatgtatcttagtgtacacctttcgaacgaccataaatgacatctcagtactatctagtacaaacagaattataaccctgccctttttaaagagtattggctttggagttgtaaagacctgaatttgaatactgattctgctactgaatatggtagaatcttgggcaaattcatctatctctccatcagtcaattatctatctatcaaatctatttttaattatagtaaaaaacagataagatttaccctcaactttttaaagtgtacagttcagtaatgttaaatatattcatattgttgtttcattaaaaaactttgaattttgaaataagttcaggccttcacttgaggttatgagtttgactccagcctggccaacatggcgaaactgcgtctctactaaaaatacaaaaattagttgggtgtggtggtgcacacctgtaatcccagctacttgggaggctgatgcaggagaattgcttgaacccaagagacagagattgcagtgagccgagatggcactgcagcaagactgcacagagtgaaggagactccaaaaaacaaagtaaaacaaaacaaaaataaaataagttcaggcttacacaagagtcagaaaaaaaaaatacaatgaattcctatatatcctttaaccagatttcccaaatgttaatgtttgccatgattgttcagtttttaaaatggagataaaattcaccattttcaagtgtatagtcactggtttttagtatactcacaaggctgtggaaccatcaacactatttagttctagaacgctttcgtcactccacagagaaactctatcctcaacagtaaatcctccattctccctccccagcccttagcatcttttactttttgacccactgttttctataaaataggtataataatatttatgctggagtgtttctgagatgacatatgtgaaaattcctagcatggtatctgtgtaatgcaagtgccaaacacccattcgtttctttttcctatcacagaaacagaaagtatcatacttatatctacatgaactattttggaaattctaatgccagcatcttttctaagtgaatttctcttactagtttggtaggtcaacagtttgcaagatactaaaaatcatagtggaggttcatatgttaaaataacataaggcaaagcagcttcaaaactccaaaaaatatgtgcattaaataatgtcttgcaggccgggtgtgtggctcacgcctgtaataccagcactttgggaggccgaggcaggtggatcatctgaggtcaggagttcgagaccagcctgaccaaaagtggtgaaaccctgtctctactaaaaatagaaaattagatggacgtggtagtgcatgcctgtaatcccagctacttgggaggctgaggcaggagaatcacttgaactcgggaggtggaggttgcagtaagctgagattgtgccattgcactccagcctgggcaacaagagtgaaactctgtctcaaaaaaaaaaaacaaatttgataataatgtcttgcagacataggcttcggaaatacatcttttgcaatgggcagtcatcatgcatgcagctcttttcatggattaatcttttattttgaagtattttatcttttttttcacgttttaagtgtttaaacattttcaaactttgtatttttgattttataagaaggcatggtgaataccacagtgcagtgaaaccactcaaggatcataagggttccattgttaacttaaatgacccacacagaccttatgccctggtttgattagcttttgatgatatgatggtttgattatggacatacagtttagccaggatatctacattttgaggaataattagttacagttctgatggcctcacaacatttttacaaatgttttctaagtatttatagtgtagtggaagtagcataggcagtgtaggtatagaaagcgtcggagtcctgagtttgaatcccaactatgctgtgggaagtttgacaagggacagaatttctttaagcctggatttcctcatttttaaatatggagggtaataactgtcattgcttagggttggaatgagaattcaataagacatagtttgggtaaggatcagcacagtgcctgacaaacaaaaactcattaaaacggtggatatctttcagatttgcttatgtgttgtttaaagaaaggactcttttgcccattaatttgtgacctttttatctgcctagaacattgcccatgaggtcatttctgcccgtgaagtagagaactacagtgttcaaatgtggaatcggaagaacaacgaaaatactaattaccctagctgagaggttatagtggtggaactggtgggatttcagtcaaaaaagctgattttgttagatacaatattatctacagttaggcctgtttattgtggagtggccaaaatatgttatggtatttaaagagtagtgaagatattttccaatctgagtgcatacatgtggtaacccttctctgatgagcagttgtaggctcatttgacattagaactgctgaaataactatgattgaaatgtttatttggtgtcaggtttataaacattgtacttggtttctgtggcaggtaacaagcataggaataccaattttacccagtcccttgacctggtaattcttttttgcttttggtatatcttaccatctaagttcttgagtcttagtgacaaaactgtatagtgtttgtcacagatgtgcgtatttggaaaggcatacaaccactgcagtatttttgccatcatgacattaaaggaaaaacacttgtgatagggtgaataaatacttctgagcagaagcaaaggtcaagctttagagtgaacttttgagtgacagctagtggcttaagggggagacgccatgttaactatgggcattcattaactgcgtggatatgaaatggcagtaagttctctccccttttatgccaggggcattggattctgtaaaagcaaaagggagaggagcgtatgtggctgccaaaatgagatggtaagaagttaaatgatcaggacacagagaaattaaggaatagtaaggtttagtgggtatgtgataaacattgcagataggctctgtggtatggaccagaaggcacaaggtctggatttttttctaacccagactctgtcactgactgcctgtttgatctttgtaacttctttggtacttctttagacctccttatctgaagttaaagatgtaaaacagtaaagatgtaaagagtaagttaaagatggaaaacaggtttcaactcttatcaatattgatagattggtaaaggctattgagaagagaatcctgcagctgtgtcttgcttgggtcattggaaggagttctgggattagtttagcagtttctggtgactgtcatggggtggtggtgggtgtgtgcttgcaggcatgcatgtttgtacgtaggtacatgcaccacaccgcattggttgactaatcatttgtaaaaatccttttcaattcagtctatatattggaaattacgtttttcttggctgtaaggttgagaggatcttctaatcagcctttaatttttctgactgaaagccagtgtacttctagttttgggagagaattacgtgctatagagctggatgcctaataggcatatagtgatggcgcctaagaaggaatgaaatcgttggtccgagagctagagagtgcgcagcgtgctttagacttgcatggggttctcttctaacctgcatatctgtgtgagtcaaacatagtaggtcctttcagataggtaatcatctaatgagccacagttaattaaatgtttatcattgcttaatatttggtatagggcattttatttctattctaggatagctttcaaaactagtaatttgggcagtattttagtactacatagaaggaagactggtacaaaatgggtgatggcgtgtaacttttaccgtattgatacatagcataatataaacatggcattaaaagatgcatagccttagcaacgagtgctagttatgattggttgagcagtattgaaagcaactaagattactttcagatatgtatattatatacaaactgttgcagaattattgcttcacttttaaggaaaagaatccttaagtttctagtgtcttttatctgagaaaattatccagaattgttaacagtttaatccactatgttggaaactctgttagaaacttttatgtatcagctctttctgcaaggaggaattattaagagctaacttctgttagctcacctctactgactagtgaaattagtagttttctttcacgtgtgttccttaagaaactgtatgtagcaaccacatttgtggcacacatagaccaatacaatagcctttttgtatttctttgtatctttctcaagtactattaatgttgtccttactgtgggtcaggagtcatgttttactcatgttggaatcacccaacctagcataagccacgcatacaataagtacactataaataatgttgaatccatagttgaaatacaattttacctaagagcaactgtgagctaccaggtgaagatcatgtctactttgaagtctaagttggggaatctgaaaacactggatttaccattatgcagttcatatgtggtagtgtgatgtgattctgtggtgatcagtttttacagtgacatccacagaactaaaacatttgaggtaacaactcgcatttcttttttttaacacggagtttcgctcttgttgtccaggctggagtgcaatggagtgctcttggctcactgcaacctccgcttctggggttcaagcgattctcctgcctcagcctcccgagtagctggaattataggcatgcgccaccacacccagctgattttgtattttttctttttagtagagatggggtttctccatgttggccaggctgatcttgaactcctgacctcaggtgatccgcccgccttggcctcccaaagtgctgggattgcaggtgtgagccaccatgcctggcctgctttgtttttcctgtaaaagtctatctagaattaaactgtcagtatgtatttgtacatggaaaaaaattccaaagaaacatttttggttaaaaatatgtggtaggttgaaacttgtgtacagtgtaaatatcgcattatgtatgccttatttaagtagacctaaatacctggtagcctgagccatcagacttgcatagctccaaagggcagtagtgatcttgttagggtttggcatctgaatgatctggttgccttttccttttggcgtttttataccaggtatcataaaatacagaaagcagagcaaaagtgaaagagtagaaaccctttgtttttttttttagacagagtttcactcttgttgcccaagctggagtgcaatggtatgatctcggctcactgcaacctccacctcctggaaaccctgagctttttaaatgttgaggcagagttgatagtaatagaaaagcagtagcttaggagccctaagaccaggctaatttgatagctctgaagttagggctcctcatctttgaaatggttcaagaatacctgtcttatataccttcagaggatcacagtgtgataacatgtttgaaagtacttcagataattctgaggttttatttatctcattctacaaatataatttgagaacctcctcttcaccagacatcgacttcgaggctggagatggaagaacttggcagtctaccaaggacttcccagtctggtagaattatggttttctttcttttttcttttcgggatggagtctcgcactgtcgcccaggctggagtgcagtggcgcgacctcagctctctgcaacctctgcctgcaaggttcaagtgattctcctgcctcagcgtcctgagtagctgggattacaggcgcctgccaccacgctcggctaatttttgtatttttagtagagacgggatttcactatgttggccaggctggtctcgaatgcctgacctggtgatccacctgccttggcctcccaaagtgctgggattacaggcatgagccaccaagcctggccagaattatggttttctaagattatgtttcatagtgtttcaggtttatattactgagatctttgttgtgggtccattttttgggttcaaaaacatgaaaagatagcattttgaaagtgttttgttacttctctatgcttataaaaatttgactcttagaacttacctatgtagtcccccacctgagataccaggacagtggggagagaatttatgatgtggtaaattttttttttggcagagccaaaatattgtaacatatgttgaaccaggtgtgtaagttgaataccttttagacatgtagttgtcactgttaatataagtggcctgctatcactcaatgctgtggacagcccaagggccttttctgaatcttttataagcaggaagtttaatttgcctatatatttttctttcttttttatttttttgaggttggttcttctaccaaaaactgaaaaaaaaagtattattagataatttttactttatgggatttgttagtcccagtctttgtagcaatttcactttaaaattcgtgattagcagaatgtcctcttcatttctgatgactttctgtggtgaggagggttcacttagaacctgggacaaatgagagttggttgagtaggatcaaacttaataagaatcaaggagacattaaatatattcttgaactggttttctaggattcttttttttttttttctcctgaaaggaagagctgggccaaagttttaaaaatcaagacaaactagaggtttcttcacattcatggccatattattgtttgggattctatttaattttcatatacccctttatgtttctaagaatatgtttctgatggtctactttatatatgcattcgtttgactccagctatagtaataattgattataccctaaaaaaacgacctctgattcttcatttaaatcagaacaaattgtttttgaaagcagcgccatgagaattaccttgaatgaccatagacttggcccacaaaggaaaggaaattatgaagaggaggaagccatgccgttggtcttcccaaatcctaatctgggaaccattagcaggaccgtcttgctgtgaggcacattcatagcgtgagaggcaatttctaaaactgctaaaatcaatccctgtaggcctttagagattaaactcactacctcgtgttataaccagatgaaaataattatgtactgcagcctgctgagtggggtgaaatagatttctagtgccaggattcttaactaggtgggatgggtgctgtgttttactgaagactccctgcagttgaaagatttatcctattagagcaagtctcaaactggtaagtctgggaaaaaacaattcaactttagacgccaattcttctaaaacctctttaacttaaatctgtttttcttggcaagagagttaaacctcatatttaaaataggataccagaactgtgccttgcacacaatagttttctgctagatagatattaagtacacgattttttattttttctgaaatgggagtcttgctctgttgcccaggctggagtgcagtggcgctatctctgctcactgcaacctccgcctcccaggttcaagtgattctccttgcctcagtctcccaagtagctgggactaaaggcatgtgccaccatgcctggctaatttttttgtatttttagtagggacagggtttcaccatgttggtcaggctggcctcgaactcctgacctcaaatgatctgcctgcctcggcctcccaaagtgctgggattacaggcatgagccaccatgcctggccaagtacacaatttttataaccacaaatgcagtgaggtttccttctctatcaaataaggataataatggtacctaactcatggggttgtagtggtgagaattagatgagtttactacatgtaaaatgattataaacatacttaacaaagaaaaatcaatgctattgattgaagatcaatcagttgttaaagtattaaactattttgacatgcagaaaagacgaataatgtttgctattatatgaagttgctgttcttaacatctcatctgtatgaattgtttctctatttgtgtggaaggacagtgttgatatttgcacaacactctgtaactcagttcttcttttgaacaatttgtgatactagaggaatgaagccactataagtgaatgaaactcgctgactagacttttcttaagtacccgtggatatccatgaccgactggatcccagtgaacactgaattctatgaaagaatagtaactagtcatacacaggggagactgctgaagatgtattaccctttgtagaattattaacatctcacttaaaaaaaaaagcaaaactaatatgcggagatgggggaatctgttttcatactgcactatctcttaatccatttatttaaaaactctttgttgagtgcttactatatataggacagacattatactagactctggggattcagtgatagagaaaaaagactaaaaatcacttacttgtagggagttcacaaatgggtgaggagaccggtattattagataatcaggcaaaaatgtaaaatgctaattgtggaaggcaaacattggcttcaagatgcatgtctcctgagtactctaaggaagtagcattgttttcttctttctacagaagagtgactgggcatagagaaggtagtggatttagctatggtcaggcagctggtaatagcaaggtctgacttatagtctgactctaagcctggtgcattttttgcttttctgcaactgtctgtcattgctaccaacacagggaaaggaggagtattaagtggctacagttttcaaaagtattgatctgtttttggagtgtttgaaataaatgaacattgaccccaacaagtggatttggggtttgcttccaaaaatctgtaacactgaattttttattagtatagttaagagtagaaattaaatactacaaatatcagaattattttgcttaagggattttttttttgactggccagtgatggtcaaagtttttttgagctttgagaccactcttcatttttcagatagaatattactcagaatccaaaaatacaaagcagtgaccaccaactggagtttgtggggtcagagaagatttctctgaagggttgtttgagctgagatctgaaggatgcagagaaattaactaggttgtctgagggcaaggtagagggtgctgagtattgcaaaaggactgaaggcctgagattagagagagcttgcttgggacattggaggtgtggacaggccattgtaattggttccgagagaacctagtagagtaatgctggtgagctggtatcagactgaagggaaggaaggggctaggaggccatgttaaggaccaagagttactactctaaatgaaatgaggaggttttaagcagggtttgagttcacatgattttcttgaagggcttgcttagccacccgtcattccctttggagtggtcttccttctggagtcagggacaccatttgtcttaagtgcagtagtaataattccttatggcaagtggccaaataaccagcaattcccagcatgtgaggcccccataatgggcctgcaaggacagtaacacttgaaaaacatcagagagaaaaaaaaattgctctttgcccttagtgaagtaaggctaaaggaaccataaaggaatatagtcaaccattactgctctgaggctaatgacctcgaagctcttggcttcccaagctagttttttttctcttccttcttggcatttcattgcttgagaaaactgttccaggaaatggaaaaagaatggagttcagactcaaagtgggtctttactttttgacgatcctggtaaaatgcttacagggacagaaggttgaaattgtcaagaagagtgtttttggatttgttaatcttggtcctctttgaaggcagagtgcttctaagagaagatcttattcatcgtctgatgaataggtcagttgtcacttgggaggagggagcgaaattggtggtggcaagagaagggtggatttgtaggaagcatatcactttcctgagggttttgttctaattcttctccagatacaaataaacgcaacattgggtgaattgatttacttctgtaagactgattcctggactgtaataagaaggaatttgggtagggcgggggggcttacacctgtaatcccagcactttgggaggtcaaggcaggcggatcaccaggtcaagagattgagactatcctggccaacatggtgaaacctcgtctctactaaaaatagaaaaattagctggttatggtggtgcgtgcctgtagtcccagctactcggcaggctgaggcaggagaatcgcttgaacccagtgggcgggggttgcagtaagccgagatcgcgccactgcactccggcctggtgacagagcgagactccatctcaaaaaaagaaaaaaaaaaggaatttggattcagggacttttctcaggttttgttcagctcttaccactttgttctccttctacctctaaatgctatatggaaaaatatgtattttgggaattaacgtgctgtatgttttgtcttgaggatttcacagacccttgagagaatattctgtgtttattatagaacttgggttcggattcgttgattcacttgttttacagtcaggacacgagtggggtggaggtcttcagaaattaatgtcatctattgcctacactgatgacatgatagtaagcagatcaagtcttgtagctatgttcttgaaaggaactcttctaggcctctaaaactgggcaaaacatattgtgttctctgttctgtttcacagattgcctggttttctctggaattctgtgcttcatggcttcttttcccttgataacatgacacatgactgatgacgtcaaagaaccttctagattttctcttctactggtatttaactacatgtaatagtttcatatttttcctttgaagactaccttgtagttttaataagggcgcatgaatgaaacctactaaatggaccgttgaaatatcctacatccaggaagctgcattgcagtattttactcatagccagctggaattctaatagattggcttgctgattgtcctattagtttttgttttgttttgcttgaggattcaacttttctggctttctttaacttcatagttatggctggtctgtaaacctgtagataaggtcaaaaaattatgggtaaactcttcaaagtttcctagatcttggttgataggagtgcaaatctaatagcctgtgcatgttataaccattgccattatttgctcagtggagtaaaacagaaaagcattagggagagtctctatggagcttgatgcaattggtgtgacattgtctaagaaaagttggtggcttgaggaaccataacccaggagcacttgattgagtttttaaaacacacagtagattaaggacagaagtgtgtcgagttcaaccaccaaatctgttcatatgggtatcttataactcttggaacttgaatacttcctatgctgactccaggtttaatttcattctaaccttgtgatgctgttaataaccaacattgcaccacccccaaaaagcccaaaaaacaaacaagaaaacctctcactgaaaaaccattattttgaatttgacatgagagtcaacgcattatttgccatttttctcataaaagttagctgcaagttctgtttaagaaattttaaataagtaaatgtcacacaagtgaatacagatatattccagttctttgaatatacgtgaactctttacttattggttgaatgccaagatcaaggtgaatgaaaatggtcattgaagctcatccatcttttagacatttggcacttcattgtgcaaatgtgcacattgataattttggcttaaatgtttggcattttatttggaaatctgttagcccctttgaagtcttttaatttgggagtggaggtagattagactggaataataataaagtaggctctgcaaataattgcaaatacacagattatttcttttttgtaggttgccaacagattttatatattggaccttgacactgattgttttaggttgtctaacttgtcaggaagtacagtttctgttacgaggaaataatgacgttttcgttgagaggatgaaacattttccacgaccatgaatctgttactggcttcattcagccagctgccagtggaatccaatttctagaaggcagaagcagtgccattcacccttgctattctttcattcctcaaattttaagtctttcagcctccaagaatccttagggtattcctctgccaggttaaatgtgtgaattacagagtaaagagtaagttgaagatttcttccatttcctgctctcaaataataatttttcatgtttttcttttttctgtttccctttggtgatctactttcagaatctgagtcactaaatgagttttatcaaaggagaaaaatgtacttagatacttagaaatggaaacaagatttgtaagttggcaatcaccttgaatgaaaatacagttggccttctgtatccatggtttctgcgcccgcagattcaaccaaccgtggatcaaaaataatgcgaaaaaatccagaaaatgttacatcgttgctgatgtttcagtatagaatattttcttgtcattactgcctacacagtatagtatatcaaatatttacgtagcatttacattgtattagtaatctagggatgatttcaagtataagaggatgtgtgtaggttatatgcaaatgctacaccaatttttaagggatttgagcgttcgaagattttgctatcctcagagggacctgcaaccattccgtaccaccctgatactgagggacagctatactaggtgaatactgccttgccttagccaagctgataactgtgtatgttatagagataattgccctccaatgcagttttgttttttgtttataccatgttggaaaaccgttagatattttattgaaatataattgtgtggagtttttgaaagaaaatatggaatatgttgtttcaaaagcttttcacatagattgtaaatttctttacagaccttctaggcttttcacagatataagcatttatagcagaaatgtagtgaatatttttatacatagtctctaaaacttaagtaaggcccattctacaaatgattggagtagaaataggcattaaaatgtggtggattcatgcacaagtaggtggtttgtgtcctatagtgtgaatatagtgttttctattttctttaggggggcatttctgttcccctggggaaataaacttcctatttatttttcttaagtatttttaagcttggttacttatttttttaagtaatccctgccactgtttatatgtagaacccaagtagcatttgtagttgaattttgtacattaaaaatattttgatcagcaaatatttaacaagtgcctactgtgcgttaagatgtttgtagaattgccgttttgtttgtgaatgttagcactgggcatagatctaaatcctcctctttgcaaacacccctgagaataggaactaaggtgagaatgtgttttggcctatatcgtgttttctagtcatttctatgtattttattagaaaaatatttttaaaaaatgttttgggttagggaaccaacccacttgtccaacttgtgaaagtctgcggaacaccaccaccatcaaaaaagacaacatattcggatcaggaatgtaatcacccagtcacctaataaaaagagtgcttgagtatgcatatggaacaaaaaagcaaaaccattcatttggtaaagggtgagtaggggccaggagacagccctaccctgaagatagaatgctttaaaaacatgttgccattaatatttaagacagaaagcgttttgagcccgctcctctcttctacccttcctcagcattcatgttgtagtttgctccctaatgctcacaagtccgtgccagacggaaattcgcagaggccgctgcagtcccgcagaggccactcaggggagggacgcgggcggaacagtcgcgctcagtcctcccaggccgccccaggccccaggtcccctggtgcctcgtgccggctcctggctcgcctcccttctgctctgcccagcccaccccgccgcccccctgctcacacatgcggcctctcccccgcgccccagcctctggagtcgcttcggggccatctagtcatacgctgtccatcagatgtgtttacttttttcctgacagccgacacatctggagcacatattcaggttattccagtgccactagacacattccacaagatcatttcagcggttgttatggcgatcttcctccctccagtgattttcaagttgcatgacagaaatagctggagctaaccagggggacaaaagtcaacgggatcaggaagggcttctttcacagaatgaactaattagtgaccctgctttcttcacagggcaatgagcatatggtttaataaagtgagtctgtgacactttttttttctctgtaggcaaagctgtcactggctgaaaactttcctgtttttactggtgggaccgtagtctgctgtctttcaacagagtttacttcacaagtagaaaatgtttgctcctgagagttaagcttcagaacgtattcttggcttcatactacctaactatagcaggtcctgtaacttaaagagacagtattaattttatattcatttcatgggaagggtttatgcttactcaagactaagcattttcagttagggttttgtaagtattatgaattgatacctggaagttcaggtaaatataatgtgttgtttgctgtggtttttctataaaatataatcagtatttctcactggattagttacaaatttatttgaacctgtgatttttttttgggcacagttatagaatattttggtattaaaagatttgattaagctactccatttttatcacattttaagtagcatgcagatgtctggttatgtctgtcaatttttttcctgaggtactttttacattttgtgtaggattttggatgactttatagtgtgaacatatcattgcagacatggaaatttagacctgagatcatttagtgttagtagtagaaatactgctttcagtttataatggatatataaggtaattctataaagcactgccatctttgatcactttatgaagaatacagacatgcctcaataaatgttttttggatgaatgggcatatcatatggattcaaacaaaatacatgttgccattaatcatgagtctgagatttataaattataggggcccattttcttttttgtttttgtattcctgtactgtaattcagtcttgaaaaatgtagccagctatacatgtttcacacttcttcccatatgtaccatgatactcttttacacacgtgtgcacatagaatctcttaatctccttttcttgttctttcaccagtactcacaaattccactcctttgcacgcaccccatttttaggttgagacccaatgcacttaagtcaccatgaacaacaaagtttatagttttcctttttgatcgaattactcatgtgttgactgagttctccggattctaggaatatgacaatgagtgacaagtaggagaatcagagctggactcacccaagcaattgtcttcatctttctccatcagtacaatacctctttcctccactctcagtcaaattcctgttcagtgggtcccactgaggctggtcgcagctgctctggagtacctgctctcaggaagactagaagaacactgaaaggtcacataattacatgtgaatttaattcacagagacctgcttgtcgcttttccatgtgtttctcctagttacacattattaactgtggtgccttgtagggcttcaattacttgggcaaatatgtatcgtgcagagactgagcacaagttagaatgctgagagtggttataaaattatgttttcctctccagatgtaactttacagtaattaaacctaatgcaatgtaagcattatagtcagtgctgtggtagctatctccaagtctaattggtaacatcgcttaaatcatagcacttattgctggttatctgggaactggaataaaccaaaaaagttacatacattaacctttggtttttctgcatcaggtgaagtggatagcttgtcccttcatcaaaatctgtcatctgtattatatggaattttgatagcatttagaaaatttttttcttatttagatagctctgtgtattcatccatccatcgatcatccatccatccatctatccatccatcatttcatctgtctttaggctattttccatagtttgttgccctggatttggagacttgatccagcacagagctattgtccacttgggttattggggtttccctttctaagtagatgatcaaaatccatggtgaaaacatgcttgccttccataaagggctacttgtttactatatttcagtcatttttctgccaaaagtaaaaagtaaaagagtccaaaagatagaaaagaatctcaagtttaaaattttcttttgcatttattatacccaagaatatggcaagcagcttaatttaatcaagcagcaagagtgccagacagttttcctgcatgtgagagctaaataaatagtggacctccgtatggcagtgataatcgcaacttagagggttttctcagttgtgaaatgtttgtgttaaggatgacttttttgttgtttttgttacagtctgacagctgaagatgcttttaaaaccttctagttacttagagcagagctatatggcacaggcttggtggttctaaaaggcaggtcctatccatcacagaaacagcaagtctctgggttatgggggaagattgagcgggggggagtgaagtaaggagaaaggggggctgttgtgtccagtttacatttgtcaccagtgactagcttttaaaaaatgtgttagctgtgcatggtggtaagtaagatccagctgcaggggattatggctttgagtgggtcggggagcttggaatgcattcagttccatcaggggatttgtgtccctcgtcatcagccttaacattgctaacacagtaaagattaggaacagaccagtgtcacctgccctgaactttgaaaaaccctggaaccattaaacaaaggggtttgctagtttagaaagtgtcccttctctctgtccaaagtgtttttcaaatgacacatgcaaaaaaaaaatacagttatgctcaggtgaaagactgtctgtggttgaactattttcacaatttaatgaacatgtcacaatcataatttctaatgaaaaacaccttccacaaataacgttcagttaatgaacatttttgtgaagtgatttccaaatcaaaatgaagagccagtagttaggagggaatgtttctgagctttagtctcactccataggagaaaaagattttgcttggtttgggtgaccctcccctcctcctcctccccaggaagaaagttaagagaacaccacaaaggtttacttttttcagggattttgaaattcagcatacatgccagcaagcagtttagaggcaggaagtcttttctagtagtgcagtcatgaactggtaaactagaagcatctgtaaaaatttagagggaatatcagctttctcaaagctccagcccaagtgtaatgaggtgcaaatgatagcactgcataacccttccccaccccaattgtggaatgagatattgagacaaaaataaagaggagaatagggatttcagaactctactgtactgaaataaattttgattttcagatgaaatggcttttgggtgactaaggatagccccaactttgacggttgatgagtagaaaataaatgattttcagctcagcatctctaggtaccatctttgaaaagtggttgcatttgggctgtgagtgcataaatgacatacctcctcattcggctgagtaaattaacgagaatttttagtataaagtaaacttccactgattcgtatctttggcaggcacctctctctttacagaaagaaaaaaaaaagaggggtaagaaaaaagatgtgatttgtttgaaggaacacatctggggtgtgatctgctatatcttaacaccagatggcaggtttaggctgacaactaaacccagtttagcctggtcaaaccgtatcttcgtatgtccttttccccctcccctcccaaacaatctatgcacaggaagtagaacaattatttgcactccaggctaacagtcctcttgtatctgtggctttgggttctctttcactgtgcctctgctgtttatagacaagtttggcttcccttggcaacccctgaaacaggttccctctgtggctcatacttttttcagaggtatgttttgtcgaggcagaggtgtggtgcctttaggtggctggtgcttgtcatgacaggcatggcattagctgggcctagcagtgactagaagtgacagcattggttcgaggtgcctgggggcctctcagtcatcactcctgctggagcattgagaatatgaaagcacctgagagcaccactgcttatcaaggagataacagtttgggagaacagggccaggaggtgactgaggacaggcaagtgcctttccctccctttattttcttgtagtagattttacttgaaagagtgtcatatatgtggcctttagaaagaaggcatacaaacaagctttgtccagggccacaaaagaagggacctttgaatttccagaagtttcaagtcttttaatttctgtcattagacttacagtttctttgtgtgttgtatcataaaatgaccaaacattaaaaaaccaaccaaaaaaaaccctttaacacttcagggaaaagagtcaataaatagtatattatcctcctcactgtcgttagacacattacctccttagtgataatggtagcggtcacagcctatttttatgactgattatcaaaggaccatgtcagaagtttcttatcactcctaaccattgggttcctttgtagattttccaggaattagttttagattctcactactgattaatggacatatgtgtaatctatgcaaagagctacaaaatgtattcattaatccattctacaaactaagattaattataattgtctgtaggcatcttataaggtcacaattctaatataatttgataggagctgttagggatttgaatgaaatttcaaaatcacctccacagagaaggaaaaagacctttagagaaagtcagtgaatgtttttattgggcagagcttgaagttacttcctgagatttctcttctttcatagttctgctttctgggtagtcaaagatcacctgtttaaaaaagaaataattcctggataccaaatgttactatagttatcaacatgaaggcaatcaaaatttttctgagtagattttaaattgtttttgttaagttacacatttcagttgtaattcttttttttttttttgaaacaggatctcactctgttgcccaggctagagtgcagtggtgtgatctcagctcactgcaacctctgcctcccaggctcaagcgatcctcctatctcagcctctcaggtagctgggaacacagggacatgccaccacacctggctaattttttaattttttttttttttttttgtagagacaggatctcactatgttactcaggctggtcttgaactcctgagctcaagtgatcctcccaccttggcctcccaaagtacatgagccactgtgcttggcctggcaggtgtaattcttacatgtcactatagaactattttatatataatgtttgacctataaacttttctacttgctattttagaaaaagaatttgttggttagaaagtcactgaagagagtttaataagagtactgtttgttttttaataaactatttactgtggttcttgtaaataaaacaaagcaacttagttaattctattcaggaaacttagctcaatttcctagtatgaagaagactgatttgatagcttggagtagtagagacctaatatggtttcaatcattgtgtggaggaggacattacattgatgagacaaaaccattttctaggttcttgaaactacttgaccaattacagtaatttgaagggggcacttcctaaataatattaagttcaattcatagtatgaacttttgagttcaaggcttctgtaatttttcttggcttaaaaaaatattcaaatttatagaatagtaatgatgttggaacgtttgattagattttagtgttccacatagttgactataataatttctgaactacaatagtttcagctagaatatttccatttattcaacaccacattaatctttacttacttgtcacacagcttttaaaaaaatctgatgtgaatttgctttattgcatttgacacgtttgggcaaatgacaacaactttggtgtttttaaaatgttccagttccagaaatcagccttcaataagcttcaggcagtttcccagtaagttgttaatggattgccatctttctgcctctcttttaaattttttccttaaaggccatactgggggaaactaactagttcactctagatggctgtactaaccctactttaaataccactgagagtttaaaaggctgcgtttttgcatctagactcacttggatttgaataactgatctctgaccgtgggcaagtctcttaacttctgtgtcttgatttcttctatttaaaaagaaaggcctattttaggtatgtattagggtaataggaggtaatgttagaaaacagagtctagtatgaagcctaatatatagtagaggagggtacaatacttaataattactgttgttataacctcttcctccccgcagcctgcgcctcccaggctcaaacaattctcctgcctcagcttcctgagtagctgggattacgggcatgtcactactaccccagctttttttttttttttttttttttttgagatggagtctggctctgtcgcccagggtggagtgcagtggcgcgatctcggctcactgcaggctccgctttccgggttcatgccattctcctgcttcagcctcccgagtagctgggactccaggcgcccgccaccgcacctggctaactttttgtatttttagtagagacagggtttcaccgtgttagccaggatggtctcgatctcctgacctcgtgatccgtccgccttggccttccagaatgctgggattacaggcattacccaccgtgcccagccccacctggctaatttttgtatttttagtagagatgaggtttcaccatgttggcccagctggtcttgaactcctgacctcaaatgatccatctgcctcagcctccccaaagtgctgggattacaggcatgagccaccacgccctgctgggttcttcttaattataatactctttcccaagctccttgcaacttctacagtttagcctgatatgttgtaacctcttgctgtttacactgtccactcttgtggaggtagctaagacactgactgccagggcatgttttatagtcatataaaatctgtacaaaagaaagttaattttcattcaagaagccaatagcttctggatcattgccttgcattggaaataatttttttttctctgtagataaaaggtaagcattattaagttattaaagcaaacaaataactgtagtcatcctgccactccaagaacaacaggatctagagtataaaagtaatatcaaaatttcagaggcctgcagaccctgttgctgtttatcactttatcattctatttcctccttgaatcctttttttttctttttttttttttgagacggagttttgttcttgttgcccaggccgtattgcaatggcgtgatcttggctcactgcaacctccgcctcctgggttgaagtgattctcctgcctcagcctcccgagtagctgggattacaggtgcgtgccaccacacctggctaatttttgtatttttagtagagatggggtttcaccatgttggccaggctggtctcgaattcctggcctcaagtgatccacccgcctcggcctcccaacgttctgggattacagtgctcctgcctcggcctcccaaagttctgggattacactgcgcctggcctacttgaatccttttaagccatcattgccctggttaggggttttcccattgctgtttgattttcagattcattaattgaatactaatccactttaaacttttagtgttttttttttttccctttatacacttggcctgtttcattttaatgttgaacagttgtttgtcaacttcaaaaaagaccacttgtttatataacatgatctctatttgtgagaaatatttttcctctaggaccgtagtaaccttactgagtcttaatattcagatatcatcagtatggaataaaatatgacatgctctgagagtaacaagcttcccacttgggaagtaccttttcctggtggcttttaatgagaggaaaggcatagttatttaagcctggttgtggagctgaataaacctatcatttgaatcttggttcttctgcttcctagcaatataacctttggcaaaaccttttacttctctgggccttattattgctttttttttttggaacgaaattttgctcttgttgcccaggctggagcgcaatggtgcgatctcggctcactgcaacctctgcctccttggttcaagagattcttctgcctcagcctcctgagtagctgggattacaggcacctgccaccacgcccagctaatttttgtatatttggtagagacggggtttcaccatgttgaccagggtggtcttgaacttctgaccttaggtgatccacctgcctcggcctcccaaagtgctgagattacagatgtgagcgaccacgcccagcccttttttttttttttttttttgagacagtctcactctgttgcccaggctagagtgcagtggcatgatctcggctcactgcagcctctgcctcctgggcacaagcgattctcctgcctcagcctcctgagtagctgggattacaggcacccaccatcacgcctagctaatttttgtatttttagtagagctggggtttcaccatgttggccaggctggacttgaactcctgacctgaagtgatcctcctgccttgccctcccagagtactggaattgtaggcatgagccactacacctggcctattgccatttttagagataaaaaaaaaatacatatctcacagagttgtggaaattaaatgagatgatattttcagagtgcttggtatgggtacctactggcatgaaacataaaggtagtcttaatagtatatgatcttttgaatttctgtggatattggtttggactgcatatttctttttttttgagaaggaatcttgctctgtcacccagtctggagtgcagtggcatgatctcagctcactgcaacctccacctcctgggttgaagtgattctgctgcctcctgagtagctggaattacaggcacacaccaccacacctggctaatttttgtatttttagtagagacgtggtttcaccatgttggccaggctggtctcgaactccagacctcaggtgatccacccagcttggccttccagtgtgctgggattacaggcatgagccattgtgcccagcctggactgcatatttcttattaatgattccttttatgcttgctgacattagggcatcatttctgctgctatggtagactttattaaaaacgatgacacatttccaactagtattttttaaatagaaatggatacaccataatcttatacctgaattaataaaatctgtcaaataccatctctactatttgcttttttctttgaccgtttgttgtacagacagcttataggttttgtttgtttgtttaaatacagatgcagagggttgacttcacctcacttcttaattcatgactcagttttgtcattggttcatgcaatgtccctcttttgttcactaatttttgttagattacttgtttgattttctgatggggataagagatgaagggacttttttttattgccaaggttctgaggtccagtgaagccagagtatattgttaagataggatgtaagaaatggaagagatctgcagtattctctagctaaagtacttcttaaccgctttaaaaaatgcctcactcctttaaatgaattttttttaaaaattcattccaggcactgtggcacgtgcctgtaacctcagctacttgggtggttgaggtgggaggctcacttgattccaggagtttgagaccagcctgggcaacttagtgagacctcatctcaaaacaacaacagtaaaaactagttcagactcttctccattaaaattcatagatctagtctgaacttttttgatgcttgagaaaactgagactcagataaaagacacagtaataatcaccataataatggccatcactttttgaccatttattatgaatcatgagctccttgcctgtgatcgaaatgtcatctctagagacacttaagctcatgcagctcattgtggacttccattttggtattctctttaaacttccaaaccggttctctctcccttcccttcgtttttgggtttaatttttttttgagacggagtctcgctttgttgcccaggctggagtgcagtggcgccatgtcggctcactacaagctccgcctccaaggttcacgccattctcctgcctcagcctcccaagtagctgggactacaggcgcccgccaactcgcccggctaattttttgtatttttagtagagacggggtttcaccgtgttacccaggatggtcttgatttcctgacctcgtgatctgcccacctccgcctcccaaagtgctgggattacaggcgtgagccaccgtgcccggcctaaattttttttaatttttattttatagttgcagttgcaggcttgccatttttgcttgcaatttcacattgtattaattttggtccatctccagcctcttccccagtcctgccttttctatgacattttagcttggcattagactaacaacacaaacaatgcttatgaaccatgcttgcatcaaatgaatgagatgagtacattgtcatattgcttcctttttgagaaaatttgctttcaatccctgaccctaaaacataaaagtaaatcaaatttcaagacggcagacattaaagaaaatatatgccaagtgtcccaagcagtgcctggcacacactgaaaactcagtaaatgcttattgagtgactaaaagtctccagtatgagcaaaagctgtaaatcctggatctacttctgttgctggcctagttctttctgatttgtttaaggcacgttaaaccatactctggcaagggagaggaatgaaggagtatttgagaaacaccttcagtgtgccagatgctttcatcaatactgctcagtttatctccacatcagccttgtgggtttatgcctcttcaccttttttattttttgaatgaagaaatgggaactcagtttaaacagattgtccaagatgtttgaatttgaattgggatctttctgactctagacccttatattttccagacatccatagcagtataagaaatgattaattgctgttactatttttaattgccatcatgatcatcatcattatcacctttagattttacaaagttgtcctcaaatggcagcctgttgcctctaaaaagggtgggacattactttgcgaggagaggagaacattaatggttcaggcagcagtgtttctagatcctcttattccttacagcacaaatctacaccagtctcttgtgtgtgtatgcaaatggctacctgagtaagggtgtttgttacctgagatcccttccagctactcaagtcaaagagatttttaagttggaatcagagtgttctgcctatgtaattttgatattttagatggaaaagtgagctggaatgcaggaaggttttcctaaatggaaaggcggctgcctcttcaccctctccactttctttttctttgtcagttgctggagagagatggccagtgacacaaaagtccttctaaactttggggagtcctagatggctggcagatgagatcacttgattccagtgaaacctaccagctgccttaaattcactcttccagagcaccatactttttattactagattgaattataggataagaaaagtgctttgagcatctttagaccgcacatgtaagactacatacttgggcctgagcctcccagtttggagtagggcctcttaaggaaaaaagaaaaagcacacgttatccatgtttgtgtgtgtgtattgtgtcctgtttgcccttgagattaattttttaacaagtgccgtgatttcccagtttttcttagattatatttctaattgctttaatattagatttgccatttatttcacctatccttgttttcccttgactttttaaaatctgctgtcattgttatactttgtatatcttttttatggaaggcagcagaaaaatttggaggtttgtctagaacaaactcagttcagtcaagggaaggctgcccagcttggtatttaacagcgcagaactggcctgtgtttgtattctctactgaagagagcgtgcacacctacatgcccctgcattgagcttcgtttccttcatcttgaagtggtggtgtgaagaacactcagatttcccacataaatcaggaaagagggttcatcagaatcaacactggttaaaaagaggtcttaatggaagtgcctaagtattgtccaaacacgggggataaatgtgttctgctttacttggccagaacaatgtctcaagctagtgattaggctttactccagctttaacctcaggcaaaatttatgcagctctgctaccgtttgtcaggtaattaaagggaaaaaagggaaatgtttgcttaaagtagaagtgttttttaattaaacatgaaaaataataaataaacacaaggggcaaataggcagttgggaaattgtttttaactttccagttaaaacatgaagaacttcaagcaaaagaccaatattttaggcatggctggtagtttattccttacagagcattattcagctgtgctagaaatccaaatttgagattgttccatctttgtgtcgaagaatgtaaggcatagttactctgtcttacttgaaagataatgccccttaccagtttttgctaaccactaactatttacttggtaggagaagagttcttcaaagtcagaacctgatagaaagccaataaatagtagtacaaatcttgatgtgggaagcacagatatagcaggaagtttaggctaaaaagaaagggggaaataacctcttccctattatggttaaccagagtattagttggattgtgttatgtccaaaatttatgttaatggatccgccactcatcaccaaaggctgaactctatcatcattgacttatctttagatcccagatcttagggattctgcatctatataccctcattcttacctgctatattaaagttgactgtgaccattgcagttgcctgcctcaactctttgaatagtagtatccttacaaacattccatatctaatctctcctactgctgtccatccttcctgttgctgccagggagattttacctaaagctcagttttgatcatgctactaatcttttcaaactttgcacagcgtttgagttttccatgccatggtccttagacagcttaccatatctgatctatgtttaccctacactccagctgtacttaatctagtttagctgttctttcaacacaatgcagggctcttttcctctatctccttgactttgcttttggagtgctttattctacacttcttaattaagtcctttaatttgggcagctgcttttcaaaggctggtcaaacgagtgtaagtcttgctgattatatatcattattatataatttcctagggtcttccttataatttcttttcatggtagcttattccttacactgaatatttatactttgagggtttgggggtggcaagttagagataatcatctgaagtgtttgtttccttggagatcataaggtaaagtgaataacattatctctcttgagtgtcttagaactaatagggaagaaaaaagcacttgtcaatcccaatggacagatgtgatttatcttggtatgtctttgagaggtagaatcaccataatgtataggagcccccctagatatttggtgggtgtggcatttggcacattatgttgaatttccctgcttctcttcccaacagtaatccttgagccattttttgttgtttgaacagtatctagctgatatctgttatctcaaacattgccatttagtggtggtcatctgtttacccataaggtgaaatgttactgaggacacttccaaaggtagtttaactgtgatctctttgtttgggtttgcatgcatttctgaatatataaatacaaacttggataatttaggggtaattacctatattagcaaatagtggtttatgaaaggagtaaaatttcttttaaatagtaaggcttctctaggccctttgaatatttgagttgcaaaatactgatcacaacctgaaggaaaacgtctgttgtataaagctaaacatatctatatatctatgccaataaagacatattgagtgcctagatatatgaaagggagagtgtgtgtgtatgtgtgtgtccctgtgtgcactcacgtgctggcccaccaactatataaatatgtaccctcctgtattctttaccttatagacaaggcaaaaacatttatcattgctcttgcctggagttatgtccaccttcatcttactgcaagtgtcagagcaacctacaaaatagtagatgaggagatgaaacaagtagggccagaaaacattgtccacagcccagtggtccgtgtcaccattcttctgcttctagcatatattgcataatcaggacagacgagacaagccaaatccttttagtacaccgtgtctggggaggttatggagtctcagagattagttgtcattttaacagtctcgattgtgacaagatcttggaagtcatctgagaatgtcatgaaaaccatattcccattgcttttatttctgctggacacttactgggtggggaacatgtttgatatatataaaacaaaaacaaaaaaacaaaaaaccaaccaagtgaaaaacctatgttctttgcattgaggtcacattaagaatacctcctcttctacaattcaaccaaagctcttgcaagaaaatgagtttgctttatttgtatttataatgaatcattgtaattgcagctagaagctttgtagttatgattattcatcccctctttccattctcacagaaatgtcaggttcaggatagatttttaagactctaaaaataatggttttttggctgggcgcggtggctcacgcctgtaatcccggcactttgggaggctgaggtgggcggatcatgaggtcaggcgatcgagtccatcctggctaacacggtgaaaccccgtctctactaaaaatacaaaaaattagccgggcgtagtggcgggcgcctgtagtcccagctactcgggaggctgaggcaggagaatggcgtgaacccgggaggtggagcttgcagtgagccgagatcgcaccactgcactccagcctgggcgacagagccagactccgtctcaaaacaaaaaaaaaaaatggtttttctgcttgcttccgttatggtaatgttgtgggtatatagacctttaggagtttttcttctttttgagacggagtctcgctctgtccgaggctggagtgcagtggcgccatctcagctcactgcaacctcggcctacagggttccagtgattctcctgcctcagccttccaagtagctggggcgtcaccacgcccggctaatttttgtatttttagtagagacagggtttcaccatgttggccaggctggtctccaactcttgacctcaggtaatccgcccacctcggcctcctaaagtgctgggattacagacgtgagccaccgcgcccggccaggaatttttctattttgaaaatttatattgtttttcttgaggtaaccagagacactaaaatatactactaagtgtgtgttttgttagtattgtttttgtcctgttaattagcagttttatttttattttatttttgttgcttaacatttttcagaagttatagctaaacgtattttgaatgaatccaactggaatgttagtttttaaaaataaattttgtttcaacctgtgcagctgtagtttactttccaggcatgagaaatatctattttattaagtcctatgaggaatatgtgtcacacacatttaagaaaaaactgtttaagatgaaacactccaaaaatgacttccccctggtgtgaagtaaaacaaaagcctcaattgcatctctgcctgtggtaatgacacgaggtgacaaactgcaggcaggtgaggtttgtggggatgatctcacacctgcacctcgagcttggggaacagatgggtttggagctggcgtctggccttgctttctttttgatacgagaccagctctcaggctgggagcccccacatttgcacagaagactcccaagtgttttaacataggcagatgggactgctggtggataatattccctggttttgtgaatctttttcttgggatggagaggtgaagaagccccagcgcaagcaccaccaacctccaagcccagagcccttacatcaagccagagctttgcctgccaggcaggtttcacttcagaaacccagagactgaggatctgtgccctcttcagtcttagttctgtagccaggcaggtagcaaaaggtgaacccagttgaagggttccttccctgccagtccctgcttcattcccctgcagctgatcagcagaactctggaagcagttaaggctggaaaaccttgtgggcaggcagagctctttctgcagtagcactcagagatgacttctgattaattctttttcacacctccctaaagaaatcaggtatgtatacctctgaagggaaggtcaaggtagatttctgtttgagacctccgctgcatcatctaacccaactcaagacagctttgtagaaaccatcaggcccaccaatgttttactgctttgcccccttcactaaggccattcactaggggctcttcttttcctttcaacactagtgttgtcttggcaaatgcgtttttggagtgcctccacatgcatagcttcccagggacattttgcagaaaggtttgcactcctttcttaagagcagttctgctgcctcatttctgtttacatatgtactgaatagtcagtccatgtctagccttcacatgggtttgattttccctgtacactgtttttttttttttttttttttttgagatggagtttcactcttgttgcccaggctggagtgcaatggctcgatctcggctcaccgcaacctccgtctccctggttcaagtgattctcctgcctcagcctcctgagtagctggcattacaggtgcccgccactatgcctggccaatttttggtatttttagtagagatggggtttcaccatgttggccaggcttgtcttgaactcctgacctcacatgatccacccgcgttggcctcccaaagttctgggattacaggcgtgagccaccgtgcctggccccctatacactgtggtttttttggttttttttttttttggtcttttgagacgaagtctcgctctgttgcccaggctggagtgcagtggcacgatcttggctcactgcaagctccgcctcccgggttcatgccattctcctgcctcagcctcagtcccagagtagctgggactacaggcgcccgccaccatgcctggctaattttttgtatttttagtagagacggggtttcactgtgttagccaggatggtcttgatctcctgaccttgagatctgcccgcctcagcctcccaaattgctgggattacaggcgtgagccactgcgctggcccctgtacactgttttaaaagagttcgagccccttttaaaaaaaatttggggagatttcatatgacagctcagagttctggtttctcttgaaaaagagaaggatgatctagcaactggagggtctagcaacaccttgtctacattcccatggaactctgaggtagggtatctggctagcggcttttctctttggatcactggctttaagcatttttgacatagacatgtgcatgaacttatccttactatgtgtgatgcattttgttcagtttcatttaagcacaaatggttaagagccactaaaatgattttcaccatccaccaatgcctgtgacctgcagtttgagaagcagtgcttgggatttggctgcagggtctgcttgccagggccttccccatgaatgtgcatcactgcttaactcctggcctgcagcggcagcatctggtttcacagactcattgtcattgtcattcacatgaggtaaacaaacagctctgtgggacgcctagcctgtagcccctatttaggctgtgggtatccaggtgaggactggtcttttcacgactccttggttttgcaaggctgaagacaaaggcagagtgaatgcctgtcttgtgtctcacctcagcttctagccccacccctgccaaggtaaatgaacggggagaaaatatgctgtcttgtggaagactacactaagcctgtcctatggattgcataacagtgggccctagtagacaggtcagggacaattcatattataatgatattctttttataaagcaaagcaagtttttaaccataagttaccttagtggctttacatttgcattacagatttttaagtactgtcattaattgagatgggtcagtaggcagggggcagaaaaagactaaagagcttctttaatcatacctttgcattttatcatcctagaggggaggcagagaagcctcttactcatcaggaccatcaatggaccatggccatcaaagcattgattaggaaagatgaagcatctttttatacaatttaaataatacattcttattcagccattcaaattttattcctttatcatatagaaagaactcagaattttgagtcagaagatgtggcttcttgttctgggcacactgttttctttttttgtgtttttgagacagagtcttgcactgtcgccaggctggagtgcagtggtgtgctctcagctcactgcatcctctgcttgcagagttcaagcaatcctgctgcctcagcctcccgagtagctgggactacaggcacgcgccaccacacccagctaatactcagtacattacaacgcattcggtcttggttcaggagactcctgaattgctgtgcattgagtttttaggaagggaattcagcaggtacaccctcgtttgacctattgaaagctggtgtggaaataaaagtatcacatatttatttgcataagtctgtgacagaagcaaaaactggaccgagagagttcttgctcctcatcccagggctcttatcctaacactgaagttattggatttctgcaatcgaaggcatttttttttccataaaaaaaaattgagctttctgatgttttcaaatctctcctagccctaatgtgttgagtgataacacactgtagaccactgaaaaggtcatcagagagtgatccaggagggggcttgtttttggctcttatctcattgtcaacagttcttcctctagcggcagctcccatcacatgcagcgctgagacaaggcccttgttctgacaaagggcacttagacccaggccatttaagcctcagccgaaacaactgatctactttagaatttgatatgaaacaattctggtatctaagaagttgcctgggaaccagtgttgtgcctggttccaagtctgtgaatgagctgttgtcagatggcagagatgagcctctcttctcagtatggctggtgaaagaggaggtggagctctcttctttaggggacagccaagtacattagtacctctgttttttggtctgggaagtaggagatttatgttcttttcctgtcccagtcaccagcttgcttgccttgggctagttgctttcagagtctctgggcctcaaagcaattcacagaccttacagtgtttattttgctacccaggttttagatctttattgtagctactcttatttttttctattttataaataggaaaattgaagttgaaataaaaaaaaaagcttgggcaacatagcaaaaccccatctctacaaaaaaacattggtcagttgtggtcacatacgcctgtagtcccagttactcaggaggccgaggtgggaggatcacttgagcctgggaagttgaggctccagtgagccgtggtcacaccactgcagtacagccatggtgacagaatgagactctgtctcaaaaaaaaaaaaaaaaaaaaaaaaaaagttgcccaagatcacacaactaggatattgatagattcaggcctggggctcaggttggtgtgattccagggcctgacagctgttagcctctacctctaacttttaatttgagggatccttctaatgggaatagcacaggattctaggctctgctgtttgtcaaataaattttaatgaaataaaccgagagaataataatgaaaatggtgggtaattagcctaacaaaagataatttgctgtcagtattctattagtgtgtatttcttattgttcatttattcttcctgtgtttaaaaaattttaaggttgaatattgaaatacgtctaacacttgtagctatcagaaacatactctgaaattttgttattctttaaataggtgagttacacatttttaatactcatataattaacatatatggcccacctcctttttgccaggttctgtgccatgtattattattcttattttacagacaaggaaacttaagctcagaaagttaattatcttgtctgactgccacataggtagccatgctaggatttgcctatgttcttttattctacaaagtatatttataaaattctatttttggatattatgagtttatctgttaggaaatttttaagttcatttctcactccagagtgagaaaaaaggcattctagacagaaagataattttcaggtgtcagaaatcactttctaactggaattttttatattttagataacaatagctttatgttaatcaatgaattagttacaggtctttatcctcaatgggttcaattaaacaatttagtaatgtaagcaggaattaagtgtcttctgtcactcttttacttccttcccacagatagtgtttagaacgttttaggtccctctcttcatggagcatttccctgttgacctcccctccctccacctccttctcattttctttcttcattttgctgtaaccttctccccagtaaaacttccatcttttttaattgcatgaagagacaattggtgcatattgcaaaacaggatatattttgtagactgatgtaataatatggtatcttatttctttttgtgatcatgggaagatttagaagaagatttgggttaataaaatgatagtttctgtcctataaaccttgttttcatggaaattgatactatgttgtgttctgatacttaaaaataactttctgtagataacatttaatgcatttgccattattcttattcattctagtcataaagagatctgtggtgttgacactgactttttattgtcccagaatggtaagttgtcaggtggtttcaaacaagaaggatactaaaacttaaaaacacttgcataggaaagagaaatataactttgcctaatggaaattgttagtcatagataataatcatgatattagtcaagaaagtataatctgcttaacattacattgggtctaacctgaaaaaaagagaagaaagtagactatttcttatcaaagttaaatttatagcacacctctactataaagcctagtgagtgctgcactgacaaagacagattctggatggtctctttctggtcagcatgcagagctggcaatctggggagagagtttctattctcagtttaattcaaggatagtttctgacacctgttaacttcctccacctatgccaaaccaggttttcagtctgattaggggacaatttagaatcttaaaacatgttttgaacccatagggagactgtagtttcttgttgagaactgtaagataggaagaactaatatgaagaagttacattaaggctgttacttaagcagagatgttataaactgtccttatttttctgggtctttctctgatttctccaacaccccttcagacaaacatatacaactttgcctgggtaattagaaaataaaaagcaacactttacttatggcgtaatttcccaggattattgggtattgacaacaagttttaatcaagctaaactttgcttaaattccttcttatcattatgttccaagtgaaccttcaaaatagcactccgttcctctgcattatttccttccttctttcttttcttttcttttttcttttttagaaagaaactaagcctcactctgtcacccaggcaggggtgcagtggcactatcactgctcactgcagtgatcccaccatgttgcccaggctggtcttgaacccttgggctcaagtgatcctcctgcttttgcctcccagaacgctgggattataggcatgagctactgtgcctggcctattttctttaaatatttgagtatttttatatcaccccctgttaaagctttagccaaggtcatttacaaaaaactgatttaatatctgtttaatcttcagtattctccccttttaaatcattttgggactggtttgagactttccctcagtttggtcacacctttccttctttaagggcattgcttctctctgcttcattggggaagcaaatcatttgtactgtttgcttcacaaactatttcacattagaatcaaaatatactgttacactaaaaatttgtaatcagttaccaatataggtaaaatatatcttaatgtatcagtatttaatgcctgagcatcaaacttttcacattcccatctgtgttttacatttaagtgaattttatttttaagccattaggtttttttgcccctccctactaaagcagaattcagaagggacactgtgtttgcgtgtgtgtgtgtgtgtgtgtgtgcatgtatgcaaattatacatgtaagtactttaatttgttcattgcagtttctcatgcagtttccatgtagtttaaaatgaatttcctgccaggcacagtggctcacgcctgtaatcccagcactgtgggaggctgaggcaggcggatcacctgaggtcaggagttcgagaccagcctgaccaatatgatgaaaccccgtctgtactaaaaatacaaaaattagccaggctgtggtggcacgcgcctgtaatcccagctactcgggaggctaagacaggagaatcacttgaaccgaggaggcggaggttgcggtgagctgagatcgtgccattgtactccagcctggggaacaagagctaaaccctgtctcaaaaaaaaaccaacaaaaaaataatgaatttcctttgaatgaaacaatagccagggaattcatgtgtttggctacattcacatagaaatttgactgtgcttatgtagccttgcagacctttgcataaagtcttccagattctaaagatggcatgtgttctctgacaaaccctactatgtccatggattatttataatgctcatttgaagattcgagatagttttatattgatccagtggtgttacctaccaaacagatccccacaccacttttttttcttttgagacggaatctcagtctgtcacccaggctggagtgcaatggcgtggtctcggctcactgcaacctccacctcccgagttcaagagattctcccacctcagcctcccgagtagctgggactacaggcgcatgccaccacacccggctaatttttgtatttttagtagagacggggtttcactgtattggccaggctggtctcaaactcctgaccttgtgatccgcctgcctcggcctcccaaagtgctgggattacaggcgtgagccactgcacccggcctctccacaccacttttaaaccacaccaggatctcccccaagcagtgaaaatacattttctgacatgtgaaataaatgcaccatttgcttgcaaatactaatatttgagtggctgttcattctgtgcgtatcatactccacttcgtgttccagttggtttttaaggaattggagagatcctctaaaaacaacctatctccaggacatgcagttttattttgaaaaattgaaagggaaataacctctgttttcatgagcggtcatgtgctgaggcatatatctcatgtccagcatatgtgcttgtgagcatctgcatgtatatgcatgcatagagtatagcatactaagacagtggagtctagatttggacttgatactgcagctttctagctgtgaccacgaggaagtcagttaacttccatgtgtttcaatgccctcatctgtaatttggagacaatgatagtacttacatcaaaacgttctggggattgtgtatttgcatgtgaaatatttagaacagttagccgataatgagtgtttaatcattgtgcattacttttagaataaaattattttatgatgctttattgacaagaataataactcatatgcaaatctttcctcaaagagttaaattttatagctagcggcaaactactgtgacatttcattttgtaagtatagttctgtacatcattttctttagcgtggagcaggcagaagcctgaaagagttaaaagtatttccttgtttttcaggctttaatttaggctcattgttatacaaaaactgttagcctgggtaaagctgcaccttgagcactgatgtaaactgagtttttcaaagtacattaaaatttgccatagtcttcccttgacgattgagagatttgcatctggtagcgattcactcagccgaatgcaagatcgcactccttagagtgctgataagcggacacatgacatttgcaaagagcagtttgcccactcgagtgccagggcaaactggagaaaattctgtgcttccaatttcatcagaaacgtagggaatattgcaaatgacactaccaaatcaactgtaaatagatgataatttgattgacatctggaaagctgtcaccggctgagtagcccataacaggaacatttactgagtgcaaaggcagctttcaagtaaatcactttttgtccagtggggcccagccagattataattgcatgtccttcccttcattgcaaattccccattaccgttaccagcagtgtctcatttaaaggaaggttgtcttccaaatattcacaatgtctcatgttaactcgtcacttccctccttgaaggcttgctatgtgctggataatccagcccttgcctcccttcgttgtaataaaactcattaactttgctctttttggggcagaggtacgtattataaattagctgttaggtgaaatatagcatgactaaagttgagggctaaaacatttccagcaggatttcagcactgtcctcagaattgtctccactgtcacttttgaataaatgttttggcactgatgatttttgaaatggcagcatttcacaattgagccaaggagtggtgccttcctgctttgttggaaacacacaggatacatctagagctggtgttcattctgggtccttctgcaagtccaaatgtttaggaatataggaaaactacaatcactaaaacagatggccatttagaggttcacttgtagatagattatgaagtgagagacacttggggagaatattaagtcaatgtctgtgtgatggtctactctattttaccaaccaaatatttgctacctggttttaaaaatgcaatagcttatgaataagtttgccaagtagtacaaagttgcgtgtctttattccccaaagttagtgaccctccatttggtcaagaaaatgaagggaaaacatcatacttgctttgcctatttccaaatccagagaacattctctggtcccagcagaatctctaggtctgaaaatgcttcacatgtggagcacatagaacccaccatgatctcagtcttggaatttcaaatagtgtgttcttacaaaaacccttcggtccttgtctatgggcttgaaaagtgtcttgctagagatggacaaagaatgggagagatgagtaatgtgaagcaagttgtctctactctaggagttgtctctcttgtataaacataagacctgaagcttctgttgctgaagcaagaccaatgcacatttgccttgcaggaagggctttagatctctgtgtcacaaacaatcaagaaatcatttcttgctgtacaaatgtagcagcttattgtagcaccagtgaatgggcacgggagtgaaggatattgctaattgtactgagcctggctgcattgcaagtgtcagatgatttgataggactgacatgcagctaaatggaataggaaaagacactgcagtggactgttggtccattagtttgctcgggcatcttgttttactaaggagccctctaatggtttctcggcaataattactatctctcttcttcatgctattcaacatgacaggcacttgctgaagtcgcagctaatatatttgcactcttaactggccccaatgccgcgtatccttgagcatgtttggctaagaaatgaatgatagctatgtttttttctttgagaaaatgtttctaatgtggaagacagtcgttttattttggatacgaagcaggcgtgtggcataacatgagtgcttgtgaaaaaaattgatgcattagctgtggactgccccattgcatgtctcctgtatactagttgatgatactgaaacgggaaaaacttttatgggctgttttacttatataatgataacttcagacttgagccagaaccacagagaaggagaagtttacatagaaatgaaccttcacacagctgttttgaagctatacagtaagggattatccctttgtttcaattaattaacttacagttgagaggcagttttattttttctgtgtgtgtgtgtttttttttttttaatttaagggggtgtcttagaataaaatatttcagcttcttttggcatggctttctcactcctttgtaaagtatggtcagttttgcttatagctgtattgctttttaaaagtaacttgaaacttctaggttaagtacttgaggtttagttgaatgagcttgtttgctaaagtacagcatttaaaggtgaggaatggggctggccacggtggctcacgcctgtaatcccagcactttgggaggctgaggtgggtagatcacgaggtcacgagttcaagaccagcctggccaagatggtgaaaccccatctctactaagaaaaaaaaaaatagaaaaattaaccgggcacgtcccagctactcggcaggctgaaacaggagaatcacttgaacccagggggcagaggttgcagtgagcaatatcacgccactgtactccagcctgggtgacagagtgagactctgtctcaaaataaataaaaataaaggtgatgaatgtattatcaatagtactatcattattatttttgctaaagtctttgggagatttgaaggtcacaaaaagacttacatgtgaaaaaggaggaagaaatcagaaatacggagaattgtgtaggggatatactttggattttgaagtcttgtttagaagtgtatatacttgtggggcaataattacaatcattttgggttcttttttcatctagtcaggttgaagatgtctattttgtgtaatctttcttttgggaggaatgaaaaaacattagcaacaacttaatttttggttattatttttcccttttgcttctaaaacacgtagttgcctgatagaatagcttcccttttttttctacatcagaaaggagagaaagacaactatcttagaaacatatttaaagcacatgatgaaaaagaagaggtttttaaaaactgttgaaaatacattttctttgtaccaggtaccagatgttgatgttggcagtgcctcagagggtcacagggcatttaaaatcactaggctgtagggagtaaaattccagatctcttgcactgaaaattatttaaaaattatctttacttagcgataagtagtacaagagtactttttctatgaattcctcttaaataggtaccttagaaatacatgatcaatgaaattgccagaaaaaaaaaagagttccagtgcctcttcgcattacaaaagtagtgcttttactggttaagtaactggttgcatttaagtctctattttttttgatatgaaaagaatatcccctcaactttattagacaggatttgccttacttttgagctatccatttcaaattagagaggacagacgctgtgctccttggttatatactatgcaaaaagacatgtatatggtacttagatagtatttcgtttcttctagaagtgtaattttgagaaggaaataagactgtttttccatccacctgccatcccatgccacccctttctacatagtttcttttcttttttttttttgagatggagtcttgctttgtcacccaggctggcgtgcagtggtgcaatctcggctcactgcaatgtctgcctcccaagctcaagtgattctcctgccttagcctcccgagtagctgggactacaggcgcctgctaccatgcctggctaatttttgtatttttagtagagatggggtttccccatgttgtccaggctggtctcgaactcctgatctcaggtgatctgcccacctgtgcctgtcaaagtgctgggattacaggcatgagccaccgcgcccggcctctacatagtttcttctctgtgtgagccaaagttccttttgtcactgataagataattagggttaatagtttcagtgcaaaaataggattttggaaggtaaaaaagttctgaaaaaacaaaatctgacaaggttaccgcttatattcactatagattattgtttcttctggttttgtgggtgttccagtagaaggacttgggtgattaccttactgggcttttccagaggattttcatgcattttttatgtagttagcatcaagattttactggggaaatttgagttagttctgtaaatacaatgggattaatttttttttgggctattttgcccttcttgttattgcctgaagaaagtaaatgctttctgatgccaaggtgggcagattacttgaggtcaggagttcgagaccagcctggccaacatagtgaaaccctgtctctactaaaaatacaaaaattagccaggtgttgtggcaggtgctggtaatcccagctacttgggaggctgaggcaggagaatggcttgaatctgggaggtggaggttgcagtgagctgaggtcctgccactgcactccagtttgggtgagagagtgagactccatatcaaaaataaataaataaataaaatagaaagtaaatactttctgcagaaaaggaaacaatgtttttcaggaaaaaaaatgactggaaggaaataggtcaatattatcagttgttgcctctggagttatgactaatttctgcttctttatactttgttacattttttatattttctacagctagagtgtattacttgtagaatcggaaaaaaaaaggaaaataatgtgcattataactgattttgacatgcctaaggagacaagcactggccattcaaattgcagatcccagaaccttggttctgagccataaaaactacaggcttgttgatgtttgtatgactctcagagccccctgacatttggatagatagaaagtggtgtatttagctgtgggccaccttcccatggggtttgctggtgaccaaagtcagcaattgtgtttacagcttaagtggcagaaagggctcaccattgttgccattacttgtgcgtgattgtttaccttctgctctctgtgggcatatgtttattatatttatattgcccattcagtgtagttgtgcaatggaaatggacttacagggtggtggggagcataggggaataatttcagtatttcctctataatttctacgtagtttagtggagaatgaaaaatttacctgcctgctgtctgaatggcacttggtaaagtccttaatgtagttttgaatgttaattctggttggaggaactcctttaaatcataagatactaccatacttgaaaaaattacttagaagtctagtgtttggagtcaagagactgctttgtcactttgatcttagggttagtacttttaacctctgaactttgtcatacttgtctgcaaaatggggatacaaataatattttcctttagggtagttgtggggatatgtgaaaatcttttgtaaatccatatatatttaatttattgactaagctaatcttgccaaattacctaaattagaatggtggtgatttggataaagtccctgagttcacagcctagagccaaattgcatttgtccattctacttggaaggtgggacatcaaagatatatggttttaatcttatttttgtgagaggctgtgcctattcgaatctgcatagcttccattaaaaaacttgaaaatagttcattttctcttcctaattacttggcagaaatttagaatagaaagacagaagctagtaacaaccaacttttccttcacacttccagatcaacaaaagggattcttgggtcctagagaccaaagaaagaatcagcaggaatgcccagggtgaactgatggattgcagagcctagctggtaattactttcactgagctaaaacattaacttaatacatgggatcagagccagatgaaaatcagaatttggatctcttcctttcctgtggatatcccatactttccttctgaaggcagtcttctcttggtgggataggcctgcttcctttcctaggacatggcataaattttcatgccacactggtagactggagttgtatcatttgttgccctgggcaacttttggtggggatatgtgactacttaggtctgctggtttctagggtggcaagaaaccccagtttcttttaagacttttcagctggataccagatattgacagactcaatctcatcttggtgttcaaattttaagttgccaaactttagcttttggacttgtgtgacactcttactagatgcatacctagcctccagctaggtgatattgtgtcatccttaagaggccaacgaggtttcattttaaaagctagctcatgttgattgttagtaacttcctagtgtgttgtgctgtgaaagatggtgaagtcataatgagattcactggcatgattgtttagtgatgtgtgtttgccatggattgggaggggcatatatgtattttcagagggatgtcaaatctatagtacagaggagctcatttaatctacagtgcccccaacctcatcctttccattgtatagtggagaagttgggtatctagaaagatgaagctatttccagcttattagagccaagtgtggacttgaactcaagttttctgagttcaacttgcttgttactttttggggataatagtagtagctaccttatgggatttagagaaggttaagtaaaaaaaaatctatattaagctttaggaatagtgacagacactgagaaagatatagtaaatgaaagctgccattattgtcatcatcatcatttttacttttatcattcctgttgcactttattactaccaacaccatattttgtgaggtagtcaggtagctaccttaacaaaagctacctcttgttttgtgccatatcgtagaagccccacttttgctaacagactgaagcaagtgttcaacttgcgacaatttaaggaaaatttgacagtatttgaccttgtacagagacccacaaaaggcattagttgaagataaataaatggtagttagcaatcctaatttgaatttttgtacacttgtgtgtgtgtttatagataatgtttcccatttataaagatttgtcaaatacgattctactcaagtacattctcttgaaacagcaggaattctatggaataaggatttctttctttctttcttttctcttcttttctttctttttttttctctttcctttcctttccctttcccttccctttccctttcccttcccttcccttcctttccttttctttcttttttttttgagacggagtctcactctgtcacccaggctggagtgcattgacgtgatctcggcttactgcaagctccgcctcctgggttcacaccattctcctgcctttcatgatttcttattaagcagtctcctatacttccttgcttcctgagacttcttcattaaatatgtactatttcaaatgttttaaatttcctagtcctgtcagcacagggctttaagttagaagacatcagttatgaaatctatcagggtgtagttatttaaaggactagacttttgtgaaatttttaattatatgggattatacttatgctatattaattgaaaagaaatggatgtaaaactatataaagtacttacgaaagaagccaagttaattgtgccttggttagatagtgaatggttaatgccattttgtgtcatactggctttgtctctgttttatgtacctgctgtctcactaacagtgttgcttagtagaaggagtgtgggctttgaagtgagatgggtttggggcttcactccattgtcttcatttaagagctttgagactgcgtaaattgtctctctgagccttagttctggttagacttggatgctctctcctttgcaaggtttctttatcctgaaagtggcttgctcttggaggtgcttagtaaatgttagctctttttctcttcctaaccatgacctttacctcccatcctctttccctggcattctgcaaggattagttcagggattaaagcaacttggaaacgttttagtttcatactgtcatttttagtggtttgccttttaaatcatctctttactgtaaaagtcttggttcctataaatctcacacccttgggaaccaaactcatgacaatcatgaagtgtcttacttcaaaggataagaaaaccaagcaaaccaaaatcatgatatcctctctggagcagtgtgtgtgagcctgggatcagcctgggaatgttggttaatggtgtcaccatcctcctctcgctggcagtgatgtggagggtgtggagaggacatgggctgagctagggtttataattgcatggccgtctggccttccttgagcattctttcccttccaggattcctgtaattgtcatcagatggctcagtctcccaatgtttccggtattgcaatgacttctggagtgtgtttaaaaaaaaaaaaaaaagccagaattagcagttagcagtcatcatttgtttgtgtcagttctgttgtgtgtagaggcgtgcagattgggcgtctctggactgtagaaagaccggtcacatgtggagttcgccttactatcttgtgttgaaccttcctacttcctttgcttattcttttccgcctacactgctttaaaggactccctgaaaaaaaaagtgagaaaagatgcaggcagtgttcctgttttcaactctagtcagccttctttttattctcattgttctggaaacttgagaggattgcatctttcttggatctgctaaaggcctagggaggttgagagttggactggatagtgagtgaaccctgtgaagaatgattccaagtcttgggctgttcgtgggcatggaggaggagagagtatttgtattttcctttatcatgaacttatcactaaaggcccaaatataggaatatatcttgcatgggttttttttttcccccatcagataagctgttgtaatttgagcctgacacttcttcttgaggaaggggaaaattgtgtaaatgaaaaaggacagctaattttttgaaaaacaaatctggagtgattgagaggtctaaacccccaaaagtgtaaaattgaagagaactaatatggttaattttgcttcatggtgttagctgaggaattgtgttttttaaaagccctttgatttactggctcttactcacctaatgggtaaagtattatagttcattgcattctggtgcctttgtttgtctaatggtggagtgtttttcttaagttacagggacccaggcctagatgatgataatgactatagtgcatctttacaaaaaacagcccttttacagttgtcatacggatcttttagaataattgaggtgaattttaatgccaaccctgttaatgatgtctatcccacctctctcttcccaggtggctgggggtggcggttggaaacaggagagccttggtcttaatgaacagacaggagatatctcaagattaatgtgaaaaaagctcagtcatgataattgcattcccctcggcagtgattggtttacgagcagtcatgtgattaagttctgaccaatactttgtaagaggaagtctgctgggggacggtagtgagagtttcccatctggaataaaaaacacatcactgcttgaaatgtggctgagatgcttacagaggagatggaccttcttggccagcctgaggacaataccttgcagtgagaaaggcagagccatgtcactgatacccagcactgggtgctacctctcacttgttttataacctataactaagtcacacaatccaatgtatatcatttaaataattttctgtttcaagatgtgaaaggcaaggcccggcgcggtggctcacgcctgtaatcccagcactttgggaggccgagatgggaggatcacgaggtcaggagatcgagaccatcctggctaacacggtgaaactccgtctctactaaaaaaaaaaaaaaacaaaaaaacaaaaaccacaaaaaacaaaaactagctgggcatggtggcgggcacctgcagtcccagtcccagctactcgggaggctgaggcaggagaatggcgtgaacccgggaggcggagcttgcaatgagcccagatcacgccactgcactcaagcctgggggacagagtgagactccctctcaaaaaaaaaaaaaaaaaaaaaaaaaaaaaaaaaaagatgtggaaggcaagtacccctttgggtgggatcgaaatctagaattggccaggcatagtggcacccacctgtaatcccagccacttgggaggctgcagcaggagaatcccttgaggccagcctgggtaatgatgtagtgagaccctgtcaaaaaaaataaaaaggacaaaagaaaactagaattgatccttcccaaagaaaatgttcactggcttgttaagtcatatcctaaccatgtcattttcaccactggcagaaccttgatgaaaggtgtgatggggtaaatacattcgtgtttggtttgtatggtttatattaatttaatttgtttctgctgtttatagttggattttctttgcttaggtaactgatttcggctttggattgttatgattgataataagagaaaaaagaatgtaaagtgttgagaaatagtctaaaaaaacattgtattgttggagcagttattcagttttcacagtattcctttgggcaattggatttgttttggtgtctgactttgttgacaatcctgttgttatattaaagctgtttcttgcagtatgttttcccttttagttaagaaaactcactttatttcctaagatgaattataattaggactatttggtattgagaatcttttctcacttaatacccctaatgagatacaaatgttctaaatgtatccttatgagtagattatatttagagaggaatccacttattttagttaactaatccctttgcttttgtatcatacatccttattaggctcccacgttcctattccatatggaattccttgtgaaatcagacctcagcaaacaatgttattaactttcagggtcagtgttactgaaaatgtcaatgaagtttgttggttttacataccttgtttttatagcactctagcttttttatacgcttatgataaatacgaattctttccctcttcttgcaaagtaaactttatttcttagttggttccccccgctggtatttatgcttctactcactagaattgaaggaattgaatgtatttgaactattcttttggccccttctgcagactgggaatggtctttctagcttctcagatctctgcatattgtgcatccttgttcttttgccagaaacctgaaaatttcccagcagaactaactggcaatgatctttgaattatatgaatcaggtttgcctggcttctaggagtcaatattatacccttctcaatgactgtatccttctttctgaggaaagcagataagttagtgatgaagttttgaagaacttcacttacggagttacacttcctgagttcaaatcctgacttcactgcttacaggttgcatgcttttggacaagttatttgacttctttatgctttggtattctgaatgggggttataatgcaactgatcacgtaggttgtcatgaggattgtaagtgaaaatttgtaaaatgttcttaaaatagttcctggtgcatactgagtgtatagttggtatgatggtatctagttgattttttttttttttttggagggtcaaggtcttgttctatcacccaggctggagtacagtggcatgatcttggctccttgcaacttccgtctcctgggctaaagggatccctccaccttcacctcccaagtagttgggaccacaggcacgagcaaccacacctggctaatttttgtattttgatagagatggagttttgccatgctgcccaggctggtctctaacttctgggcttaagtgatccacctgccttggcttcccaaagtgatggggttacaggtgtgagccgccgtgcctggcctctagttgaatttttaaaagtactttttaatctattttctcttttggtcctcacgccaccctgtgaagaggtagtagtattacttattttatagggcaagtcatagaaacacagtgtcagtatgtgactttgttactagtaacagtgttcgaattataatctagatttctcctctcatctgttatagttgactgtgaatggggtctttaggaagttgctgtgattctgtgatgttatcagtcagaaggtgtaatgggaagggcatcaatctctgtttcttaaatttggcccagtggtgagccagttcattctaaaataatttgtatttgctaaatgcagatatttctcactttgcatgattttaatatacacaattttcagttgccatggttaactaaataatactagtccctcaacacagtccaagtttcagttatcatgttacattaactataattgtggccgggcgcggtggctcatgcctgtaatcctagcactttgggaggccgaggcaggcggatcacgatgtcaggagatcgagaccatcctggctaacatggtgaaaccccgtctctactaaaaatacaaaaaattagccaggcatggtggcgggtgcctgtagtcccagctactcgggaggctgaggcaggagaatggtgtgaacccgggaggcggagcttacagtgagccgagatcatgccactgcactctagcctgggcgacagtgtgagactccatctcaaaagaaaaaaaaaaatctataattgtataaaatcccatacactagcacttcctgttattttgttcatcagcggacagcaaagcatgtagtcgtgttgccttcttgtctcccagtgatagacccatgtagcatttcataaaaatggataattaaaggggagaattgtcaaagatcaaagtgcatcaaataaatgaagtgttaaaattggattaaaattttagctaattgtaaacagcattcttaaaaaaaaaaaaaaaaaaagcttaccaagggaatgtcaactcagccagtgttctagaggctctatatatttagctaggagcacttagtgaaagataactaacttatcaaagtcagttatgaagtggttgtgatgaaaaggatgaagatgtaacagaggaaagatgctggcaaaaaaaatcatatgagaggaactctcacagatattgtataactgtgaaaacacaaaggataaaatgttggaagcaagtctgaacttagaaggaagtatacctatctaccaaggcatggaaaagatgcttgtttagaattgtaaattagcaacgagaataaggcattcccattgaaactactattgacacagttttttataaataaataaaacaattctcagagtttctgatgttttagagtactaaataaatatacttttcattttcctacacatttatagctgatagacagtttttactgttttgacaaaaaaattaaaggtcatagaacaatcataatatttctgttgattattaaaatcatttcatggccaggcactgtggctcacgcctataatcccagcactttgggaggccgaggcgggcggatcacgaggtcagtagatccagaccatcctggctaacatggtgaaaccctgtctctactaaaaataaaaaaaaattagccaggcatggtggcgggcacctgtagtcccagctacttgggaggctgaggtagaattgcataaacctgggaggcggagcttgcagtgagccgagatcgcgccactgcactccagcctaggcgacagagcgagactccatctcaaaaaaaaatcatttcacatgatttcagcgcgcatgatcacttttgtggtattgcattatcatgcaaaatgaggactacctgtatttattgagccaagtaggcactcttgtaagtgatgagggtataccaacaaagtggacaggccaaacctgcctttaagaaacatttattccaataaaggcttattgagtgtctgcagtgtgccaggcagcatgtacacatgtgaatgaatagtagttcgtttctcagagaatttggatcttagttgactggtgagagacaagaccattatactataacatatgcctataacatgtataatacatttctgtgaatgaaataataatgaaacaccaggcattgtaagagccaagaggacacctatcaaacacatagcctgagtgtatgagaggtgggagaagcagggagacatgcctggaggacttaggaattaatctggaaaagctgcgttgaagaagggtacagtggtgagatgcttctgcatggaaagcacaggacattttaaaaagttgagtgttgttgaagtgtgtagggtaagatatgggccagatcaggaacgccatggaacttgtaggcaatggggagggtctatagggttttcccctagtttcttttaaattaaggtataatttatacacagtaaaatggacccattttattgtattgtttggtgtgtttgatataagtgccatggccaccgtgacaatcaagacgaagaacatttatattactccctaaaatcccccagtgctcctgagtgactaactcctcccacccccagtccctagcaaccactgatgttttctgcccctatagttttgtgtttctcaaaatatcatgtaaatggactcatgcagtatgtagtgctttaattctgtctctttcctttagcataatacttctgagattgatccatgttgttgcatgtaagaacctttgggttttaagcagaattatctgtgagatttggttggaggatggatttgagaggagcaagactagagactttgattgtattacaatttaaccaggtgctaatggagtagagggaatagagatgccaaggaggagcttggtttgaggtaggaggtggaattcgtttcaactaaggtggggaatctagaaggaaaaacaggtgggaaagaggaggccctgcatattggacatgttgaggctgaggagtgtgggattgtcctgcaagtcaaccttggcagggtgtgaggcatatgaaggagttgatttctctccttccttatcctctgatctttgccaggatcaaatttgctaggcactgatcttgttaattaaagggctcccttttctctttatcctaccatatcaccaccaagaatttgctcccaaggccttgccttggactgtagactgtcattgaatcaacttgtcatgtttaaaaggaatgacctcttttttttttttttttttgagaaggagtgttgctctgtcgcccagggtggagtgcagtggcgtcatctcggctcactgcaagctccgcctcctgggttcacgccattctcctgccttagcctcccgagtagctggaattacaggagcctaccaccacgcccggctaattttttgtatttttggtagagacggggtttcaccatgttagccaggatggtctcgatctcctgacttcatgatctgcccaccttggcctcccagagtgctgggattacaggcgtgagccaccgcgcctggcccaggaatgacctctttatggagtgtcatcagccaagtcagttcatctgtggttacccattgtttttcactggtaacgtaaaaatatctgcggagatagctatggtttgcttggtccgtggaactggaagtcagagagttcagttgtcacaaatccaggctggagattctcttctgtaaagatcctggacatcctttccaccagaaggagttttctggaactgtatgtttgagggtactacatttgaaccagtttgaaccaaatgtgatggaattagtgatgaagggacacaatattacccatatttaggatgtggctgactcatcttgtgtgctatgattcagtgattctaattcagtaacggttctgaagctgcatcctggctaaggaaataattctgtgcttgattaatattgtctaagggcagggcgcgttggctcatgcttctaatcctagcactttgggacgctgaaccaggaggatcacctgaagcaagaagttcaagaccagcccgggcaacaaagtgagaccctcgtctctacaaagaagaaagaaaatattatctaccttttgcctaggaggggaagcactgtaggaagcggtggccagagtagttaccctctttaggtgattcaccacaaaaatacactcaaaaggtaccggatatagaataagcccactaccgtaacttcagctaacagatcatttcatcatcaggatagctccatgatgtaaagcatgtcattcttgtctcttacaagtgaggaaattgaggcacaaagaggtcaagtaacttgcccagtgacagacagctaattctggcagagctgggatttaaactcaggcagcgtggctccagagtccatactctttcatgcacatcatgctgttttcagaattctagaatgctagcaccaggccgacttaggaaaattattttgtttccccgttcttcattttacagctaataggagtaaagtctagagagggctctgagatgactgactcaagatcacaggtgatggtggatggagggagaactagtttccccctgcccagggcttctgacactcttggaagttttgtacctttgtcttggttgcttgtcagtttcacatcagtgaagagagatgttgctgaagtaggcagactggcaaaattggtgtttaattccattctttactttggcctcagctctctcttgcctgggaatgtactaattggctctcttcctgtcccctctgccatttattattttcaagggagcctggaatcactgttactcgtctctagcctgtcctgtttaatcactgattgtcagatcttttgctctttccagtcccttcccactaagaagtaggagaggggagaacctgcccaaccacgtgggtttggggtgagttttgggatgggggaagggaattagactgttgcagggtgggagttattgtgccgcagatcaatgaccttcccttgaggatgccactctttgtggttttgctctttctgccccacctgtatcacagtcatcctgtgggttcccagcaggactctgccccccacatttggggcagggcctctccccctttctgcagttggggttcagagctagagagggagttctgacgaaatttgcttgccccatgcatgcattctcatggaaccctgattatatggtatccgggacagaaaagggtttacatttcatatctgttgtaactttattttgaagagccacagtttgggggataaagtaattttctttaatatttgttgatctttctcttaaagtctcgtgtgtaagcttattcaggtagagactgactttttttttccctccgtttcttctgtactgggtctttgtatgtaaaattctaagtcctgttctagtcttcttccacctacccaggaatgaagttgaatattaatgcaccatggtcaccattctccaatggctcagtctttctccacattttctataattaagactgtccttcccaatttcaactcaaaatacctgaaaagactccttgtttagttaagagaaagcaaatttccccaggtaagttcccatatgttttctgtaaaaactagcgcacactttctttgtattttacctctgtcaaatgagattcttagaagagtaatcagccattctaagccactccactcttttgacttatattttcatgggtaattttaactctttgggtgctgtccagaaagtttactgctgcttctcacaagggaaggtgtctgtggttcccgagactaccctcttcctgccttcctttcagcttcctcagaggaccagcaagctccagttcttctaaataggtgcacaggcccagaggtggattttccttcaaggccctgggaaaaggccccagcaatgtgttcacattgccatttgtttctgtcaagtttttgtgtatttttatttttgcatacttttttttttttttggagacagcatctggctctgttgcccaggctggagtgcaatggtgcaagcttggttcactgatttactcaagaatggatgcgcccagcctgcatccattctttcgtaaataaatacataggctgggcgtggtggctcatcccagcactttgggaggccgaggcgggccgatcacctgaggtcaggagtttgagaccagcctggccaacatggtgaaacctcacctctactaaaaaaaaaaaaaaaaaaagccgggtgtagtggtacaggactgtagtcccagcaactcaggaggctgaggcaggagaattgcttgaacctgggaggtggaggttgcagttaggcaataacgagccactgcactccgacctgggtggcagagcaaaactctgtcttaactaaaaaaaagaaatacatagcaagaatttccatcaccttaagtagtcacctgatccccttactttccccgtggcctcagtttttgcagtggtgatatctgtgaaatggagaacaactgttcatccacactattaaacaggaggtgaaggccctcgcacaaacctgcccagtgggatactttaaggcttgggcagtcttgtcttgcactgcaatgagagcataaatgtggacacatattaacctcgcctagtgggtagttgggttcagcacaggtgggtttaaagttcccgttcttttctacaaagtgcaaacacattccctttccaaaaggtacactggaagctgtctttataaaatgctttgtagcataagcacatacagagaatactgtattcatactgtattaatcagcctctgtaagtgtccattctctgggtctcacgggcttaaaaacttgaatgatcgtcatcttatttcttcttccactcttgtcatttaccaagtcctggaagtagattgttttagtttgcattgccttctggaacagtcctctccttaaaagaaaaagtctcattattattgctccgcagttggagggcaggggagtggtttatactgtgagttcacatcactcttttaactccttttcattcccactgacctactataggcttgttgcagtacctgcccactttaactttagactttctctaggatactctagtgattgagattggaggcttttaaaaacacctctgactttgccagtgctcagccccaaaacttcatttattgcagactctctgtattcagagtaagcccttacctctgtgctcagtatccctccttgagtgtaggcttgcttacctttctacctccatctctttctgacactcttttgatattgtgtcctatccatattgtttcccaggaatacctcttattttgcagtctttttcttaaggcacttattactttgtcccttgtgggacaattatttgtacatttgtatagcgctccaaactagatttagaaattcttgaaaatactttatttacttttagtagtggtagtatagtagtagtagtggtaaatagttaaaaaagtagcaccagactactgcaaagaccttagggcaacatcccctgaatactctgaaccctaattatctgtttgcacagctgtcttccctgctacattgtgagcaactccagggctgggactgtgctcccagaatctccagtgctacagcagtgtggcaggaaagtctttttgactaagaagatagtcatgtttgtttcttattcatgtgatgctttcctccattccttgaataggaattttttttcttgttttaagcagaaattttgcctttttcccaaattcactggaaaaatcggatgctattccactgttaattgaggtgtcactaattactttgcttgaaatttcaattattctaaaatcttccaacattttcatatatgtatcgatattttaaaaatataaaagaattttaaaacttacatttggaaaatttaccaatacagttttggctaattgggttgtcagttagccaaaggttagggatgattgatctagtttaaatatagctttgcgatttcattgaaattacttaagaaaaaatatttctagacagcatggaagaaaggtgaatataatagtggtttaaatgaagtagaggtttaatttgtgaattaatttttgagattgttatagagatactgtgatcaagtgctaagtcaataatgtaaagcagtgcatatcatttgaagctgttcccaaatatatcttaaagctaaatcaatattaaaactgtcctaaatagtaaaattgtttaatcattagacaacctgagctttatgtaaatttgtagactcttgaaacttgtcgtatgcagaagcgtaagcgtagctataacataagcataaaccattgtgatttgcataatttatctcttcagcataaatattgtacttgtagagtaacatttttgtcctggaaatcagattttggttgtctgagtatttgtgggactggaggaggttttaggtttatgtttgtgtttagattaaatttgaatggtgagttaagatttatggtgagcagtgtgcagaatgttttatttactttttcaaagcttatgaataaaagcaacatctgaatctgatctttgggaaccaagttcaggaaatgtggtataatctattttaattgtctcccttaatttcaacttacttctgtttatttgcaaattgtgtatttaagacattaacatatttaataccctgttattggatatatttaactttctactagcttcatgctttcagagttttgaactctgaaaacacaagcagcattaagacctgtcttttgcttaaagtactgagtgattacactccgatgttttcattatatgaaacacccctgctttacttcagagtaaatgcttctaagaattaggcatgcctagcttctaaggtagactattcacttactcactcattcattaatacattcactttttccaaaaatgaatattccatgttcatactatgtgctaggaatgatagtggatatagtagtgaacaaaaggtagacgtttctggccttcagagtatcttagagtctggtaggggaggagaatatgaaaccaggcaaccacagtaccacgtactatgataaatggtgtggaacccctaagcccagagttccatcggcacatatgtgagtggtgcccaaagtcttcctggaggaagtgacacctctgcctctttattcttcagagtcagccagtggaaggggtctaggaagggttgctacaaatgcttctggtacaaagaacaacattggtaaaagtccagagaaaatagagaagtcagcacattagactagtatgtaaaaactttaggcaactagaactcaaataactagaactctcattttggctcagaaaaattttcctctgcattttacttgatgaggagatgaaaaatgactacaaacttattgatttcttaccccgatagaaatactcatttattctaaaaaaatttaattatacaaaattattattattattatcattattattatttttttgagacagagtcttgctctgtcaccaggctggagtgcagtggcacaatctcggctgactgaaacctctgcctcctgggtcccagcaattcttctgcctcagcctcccgagtagctgggactacaggtgcacgccaccacgtccagataatttttgtatttttagtagagatggggtttcctcatgttggccaggctggtctcgatatcctgagctcgtgatccgcccccctcggcctcccaaagtgttgagattacaggcatgagccaccacgcccagcctatacaaaattattaaaaattgaaagtcataataatattatatagataatcttacttgtcattttgtaaatatccttaccagttttctcctttccatctttggttttataaaattgagatgatatcaaatatgctattttgtaactgatattttacagttaacataaaaagcacattgtgttcatatcattggaagtatttgtaaaatatcaattttaatggctgtataatattctatcatcaactattattcatttatacatcatttattatatattttccaatatacttgtattggaaaagtagattgtttctaacttcttgttgttttaaaaattctgccacgaatgtgtttatattgaaacatttaattaaatctttcatatttcctttcagcactttgggaggccagggcgggcagattgcctgagcttaggagttcgcgaccagcatgggcaacacaacgaaaccccgtctctactaaaatacaaaaaactagctgtgcctggcggcttgcgcctgtagtcccagctgctcgggtggctgaggcaggagaattgcttgaacctggtaggtggaggttgcagtgagccacgattgcgccactgcactccagcctgggcaacagagcgagactccatcttaaaaaaatatacataataataataataaagttatagcctttcttctgtgcccctgcttttttttgtaggtatgcattgtctgccacctgcctccaatatcagtccagccctgatcttcagacctttggtgcaaatttgaaaatgaatcttttttgtatctgttcaagtaaaagcgtatcagctgaacaaaatgttacgtggctggacacaaaactgaagggtaatgtcgttttgcattaataaaaacatgaaacaattagatcccatttttttagagtgcccactctaaaaaaaagaagtccctggataaagcgttttatctggagatagcttctctctctctttttttttcaaacaaaggaattatatcttatagagaattttctttaagtgcatgattaagtactctttttggttagtgaattggaatagatctgttattaaataaatacctctgtagagttaagaattaaaagaaaactggacttgtttcttaggtaaagtaaacattttttttcttaaagatgtcaaggatgtttcccacatagcaaggtattctatcttaatactagaagccacttggtttacaggggttttattttttgcagattttttgctcttctggggctgaagtcctgttgttttcatctgtttatcctgtgtttgccttactgtccagtacatcatagataaccaataagtgttaaaaaagcccaatactttttaaaaagctttattgaaatgtaattcccataatatacaattcacctacttaagattttttttttttaaggcggagtcttgccctgtcgccaggctggagtgtagtggtgtgatctcggctcactgcagcctccgcctcctgggttcaggcgattcccttgcctcagtctcccgagtagctgggactacaggcgcccgccactacgcccagataatttttgtatttttagtagagacggggtttccccatgttggccaggatggtcttgagctcctgacctcatgatctgccagcctcggcctcccacagtgctgggattacaggcgtgagccaccgagcccagccaagatgtttttattagtttcagtagtttttttttgtttttttttttttttttttttgaaacgaagtcttgctctgtcacccaggctggagtgcagtggcgcgatctcggctcactgcaagctccgcctcccaggttcgcgccattctcctacctcagcctccctagtagctgggactacaggcacccgccaccgcgcccggctaattttttgtatttttagtagagatggggtttcaccatgttagccaggatggtctcgatctgctgaccttgtgatccgcccgcctcggcctcccaaagtgctgggatcacaggcgtgagccaccacgcccggccagtttcagtagtttttagtatattgtctaactatcactacattcaattttaaaccgtttttattacctcagaaaagaaacccgtaccctttagctttcaccttcctggcccccccacaacactgccattcctccagccataggcagccaccataatctactttttctctatggattgcctcttctggacatttcatacaaatggaattatactatatgtggtactttgtaactggcttctttttatattttcaaggttcatccatgttgtgccatatatcaatattttattattttctttgcctcttaatatttcattgtatggataggtcacagttttatttatccatcagttggtcaatcaaatacttttaaatatgtaaatcagcttgggtggttgtgccttataaaggcaaaaatgaaggtagaactgaagttgtgatatcctaaattggaaatgccttcagagcttgttagtcgttaaggtatatataagtatgtttagaattaagcttatatgttgttgggtttaagataatagcacatcaatcagtaggatcttgtcagttttacctcttggatacttcttaaatctgctttcttctacttacctctggtaactatctaatcaaaatcttttttttttttttttttgagagagggtctctctgtcacgcaggctggagtgcagtagtgtgatactggctcactgcagcctccaccttctgggctcaagctgtcctcctacctcagcctccttagtagctggaattacaggtgcacgccaccatgcttggctggtttttttttcttttcttttcttttttttttttttttttttacaatttttgtagagatggagtaacctaggttggtcttgaactcctgaccgcaagcaatcaaccatccttggcctcccaaagtactgggattacaggcaggagtctgacatctaattaacatcttttgtttgaacattgcattaccactgccatccccaaaagaaggcaaaaggagcatttctaaaaatatcgttttatgttaggggtcagaagtctttaacataacctgcttggctgccttcacatcagacccttgctgcctttccccttcctctgccctcctattctttaatacttgttttgtatttaacagaggataatggagtcctttctgaagttgtttgggcatctgagatttcagcttataccactttgagaactatgcattaaggatctcgtttgaagccttgtgcagtggaaagagctcaggcttggaagtctggtaaactaggtataggctctgcggtccaatgtgcactagaagtgtgcttgttccttttgagccttttatctgcaaaatacagatgctaccttgcaagttgttgtgaaagagaaataatgtgaaagtatctgacacataatatgtgcttaatagattgtcctttctgtttcttttttggattattgttttgaatgaagtggcttaggtcatcatgtttttttggctgaaaagaaggatttatatatattatgatcattgttggtagtttgggggttttttcttccaaagtttgtgtctttgtttcagaatcctgttttcatgaagactctggaattttgtcactgctctaatacctctgccaggcagcagcactcctttgggtctctgccaatagagaacatcatttattgccttaaaaagaaagtatttgtgtgtatgtatctttacaatatcctcattatgagagtaattgtagtatttgtgtgtatgtatctttacagtttcctcattatgagagtcattgtttttcatttataaaataggaaaatgcagaaaatagagaaaaggggaggagaaaataaaattcatttgccatttagtcacctactgtggccattctagtttatacttttctagtctttattctatacacatctacatacatatatgttagtgtggctttggaagtagaagttagataatagtatgtgttttgtttaattgctgttttctcattgccagtatagatattttcagtgtttagtaacatggaatgtatataatttttttccggtctcagagaattccattgtatgggagtaccatacttattgtcaccacttctctttgggaggacatttaggttgtatccaattttttgttattataaacagtgcttgctttgattttacagtcatgcgtgattctgacatgctttttacatcctaacagttctttttttttttttttttgagatggagtcttgccctgtcgccaaggctggaatgcagtggtgcaatctccgctcactgcaagctccgcctcccgggttcacgtcattctcttgcctcagcctcccgagtagctgggactacaggcacccgccaccatgcctggttaatttttttgtatttttagtggagacggggtttcactgtgtaagccaggatggtctcgatctcctgacctcgtgatctgcctgcctcggcctcctaaagtgctgggattacaggcgtgagccaccgtgtccagcccctaacagttcttatgaaataatttccctgaggtttgatgataaattcaattcaaatttgctcctcatgtttttcacaggtcttttgaatattacaactcatgtggcagaatgtccctgttctcctttttgctcttcatctggtactagttttctaatgtgttcatacccccacatccatttaccttggctaagactcttcttgcctttgtctgccccaaaccactgtcctatcgtttatttatttatttatttacttttattttttaatttattaattaattattttttttgagacaggagtctcactctgtcgcccaggctggagtgtagtggcgccatctcggctcactgcaacctccgcctcctaggttcaagtgattctcttgcctcaacctactgagtagctgggattacaggcgtgtgccaccatgcccagctaatttttgtttttttagtagagatggggttttgccatgttgaccaggctggtctcgaactcctgacctcaggtgatccgcccaccttggactcccaaagtgctgggattacagatgtgagccaccacgcctggctgccactgtcctatcttttaaagaatgattccttcatattcgtttctttcaattgacccttattattaacttcattaatttgtttccttcgtgttgcccatcatatcacctcaaatttggaattacttaagtgtttaattttttaaattattctgaaagagagtgcttgctttctttcacataacagaattagtggagtggtttgtattatgcattacaattaaaattacgtctttacaattaattggctgttgctctaaattgggatatttctgaagttattttaaatccaggactgtttttctttcctttgtgtctgtttcttgcctacagctagttgattatatccttaaggagtactagccattttaaataattttaatctgaatttaaataaatcaaggtggctgggcgctgtgggtcacccctgtaatcctagcacttttggaggctgaggtgggcagcttgcctgagctcagaggttcgagaccagcctgggcaacatggtgaaaccccgtctctactaaaaatacaaaaatagcagggcgtggtggtgggctcctgtaatcccagctacttgggagactgagagaggagaatcgcttgaacccaggaggcgaaggttgcagtgagcccgagatggttccattgcactccagcctgggcgacaagagcgaaactccctcttaaaaaaatatgaataagtaaatcatggtgtgtattctaaagccatagttataaacttgaggggtaggtaatacggaggagtttcctgcaggtccccgtggctgaaagtcagcgtagaagtgcctgacctggtcggggttccacttctggtctcagtcctgctgaggcagcagctgcgttggtcaggtaggttttggttttggacacagtggcccaccgccgctgtacattgcaggattatttcagttcaaaatgaactgattgctgagctcctctgcagccttcgtgttgcaaggactacagtttgtggaggcccggcaccaccagcctcattgaggacattgacaaaaaatacttggtcctgcttcaagatggaaggacacttaatagacttaagaagtattgatcaatttggacttggaaaatgagaatgacacacccctccagcaagtatccattgaagaaatcctagaagaccaaagcgtggaccagcagaccaggctggaagtagaggaactgaaagttcaggcccactgggatcaaggtctttccattccttgagcagatactcttgatgagtattaagtcctctgctcagaagctattgctcttgaagagtaagggctgtcactgaatgaaactgataccctggttacctcacacatttgaccagggactgtagtgtttctgaaaaatcatttttagttttaattctagcacacatacaacatgaagaaatcatgggagtttttttttttttaataacgaaatcagtgtttaaggaaacagtggtatggactccttcactgtggagccagcagctacttctgtatattgctcttcttatcccaaattagagtttataggggacattcttcatttacttataaataaaatataaatctcaaaagatgccatgaatctcaaaaagcgattaaacttgagcatgcatcagtatcacttgcttgtcttgtgtaatcacagattgctgggcccctacccccaggtcttttgattctgtagtggtcagggtctgataatttgcattcctggcaagttcctggatgatgctgttgctgctacttgtgagacactactttgaaaacaactgttctaaaggaacctagaaataatgtttgcattatctgtattccttgtaattacatgtattttttctctttactgttgtacatgacagatataactgagcatattttagtaaaagcaaaaacaaataaaaaacgcttcattggcaaaatacaagagggtcactggataacagatatacagtcttttgtgggataggccagcagataaggcatccagaggcttaaagcactcagggtcctgggttgttcagcccaaaacaggtttccttaaatattttgtagccttagtttttttgtagaaaaatggcgactgctaccagatctctctggaccctttaactcctaaatctgtagtcagatattcagtatgtttaaacaggcttacaatactgcaaatatcttgattaagaaatgcttgtatgtttttagtaaatgttcagagtaatttaataaaagccttatttgtaagttttatcacaatggagatttaaaagttggatgaggaaataaacattgaaatcatagatattccaaatgtctttcgaagcctgagctacagcacaagctatggtctgtatgtcaggcctgatagaatgtaaggttgagcccagaaaaaaggaggtggttacagaaatttttaaatggaatcgaaactgtcattggatgcatttggttcatcagatccagattcagttcgatgtgcagttctggttccttatcagatgtaacgaatagtagttgtacttattagtatactggcaatttaggccggacacggtggctcacgactgtaatcccagcactttgggaggctgaggtggggccgatcactcgaggtcaggcgttcgagaccagcctggccaatatggtgaaaccctgtctctactaaaaataaaaaaattagctgggtgtggtggcgggtacctgtaatctcacctacttgggaggataaggcatgagactcccttgagcctgggagacaaaggttgcagtgatctgagattgtgacgctgtactccagcctgggcaatagagtgagactgtgtctttaaaaacaaaacaaaacaaaacaaaacaaaaaaacatactgtcaatttggacctttgggcttgaagttttttctatatgacagctgagattgggggcgtgggataataccatctgcaacttgttggcaagcacattatttgtattcaaatagaaaggacgtactgttagaaaatgcgcaaagggaaaaaggcttttgtagaggtcatttggcatgtaggtgtatgaaaggtgaggctacagcaacacccagcagctgataagaccatacacagtgtaagatgaacggaaagtttcctccaagcaccttgggctctcatgttaagacttggtaaaaaggttgctgatgcttcatttactgtagcgacaagcccctttatctcagcggctgtcaatgtgagttggaatttcacatctttttaggaagtcttttggaccattttaaaattattattattgcactgtccctcaccttttttttttttttttctgattgcatgacgtgtagtcctcttttcttgtcagcaattaggagaaaaatctcaacagaacgagaaaaccttgtgacgctgaaaagatttgcctgaagtgttccatgtaagcagtgggaatggacatacactgaaagagagaggggaaaaaaggctttttgttgagagtgacaggcaggcaggatgagcaaagtttaacctaaatcctttcattgatattgcaaagtcataagccttcatatgacactgccacattcaactcactgtatgatctggagttcagtagcttgtaccatagtgcatgtgtgtgtacagtgcaaacattttatgaactgcagtgtctgatccatccgtctgtctgggcaagagtgtcccttgatagtaaaaagaacagcaatcaggacagaattggtcaatgcggcatgtctaatagtgggaagatatttgaaggactcactatagacacagtagtctctctaaatagcctctttgcacccggagtcttattgcaaacaggttcattaaggagagacattctgacacacagcatcacagtaatgaaagtagctctgtttttctaatattgtatcttgccacttcagttaggctgctagtacaagatttcccttgtgttgttgtatgtttctccagaaaaagaatcagtcttcatagaatatacaattattttgtacgggaatgtataactcctacctaagatccagtcttccctgtttatgtgcactagtgcaaaaataattggcaaacacatcctccagaccaaaagattccagcaccttcaatttgttgggcttgaagacgttgaaccagttataataaactttaaaaaaatgtgtaatgttcaaaatggatttgtgatcaatcataaaagacaaaaaaaaattagtacagtttcccatgaggtgtgaggttttttttccctaggttttagccaacttcatatagtatcagttcaaagagggggaaaatgcaaaaggttttcatctactaagctttacatataactactatatgatgacttaagctattggattttctgcctgttaatgtacagcgtgaacattatgaacaaggaaaaaaatgttatattggtttaaaagtggatatggaaaatttaatgtgctcaagtgggaacaatggcatattaaaaaaaaacactcatgacacagatctaataattcacttgcccctgtaggagaagggtatcaactctgatactggctcacagtttatttttatatacacccctggtccctgcagtataccccgtgtgtgggttccagagaaaagaaagaaaataacctgtagggaaatcagcctggaaacctttcattaaatacattgtactttgtattgtgtctttcacagactcttcaagaaataaaggaaaaacctgttatcagtctgcatgtgtaaaatattgtatttgaatactatcatttgttttaagattaaggctgaggctgcagacatattagttattattcacttacatctggtagataatgcaacagggatttaaaaattctttttccatttatagtccctgccatcctccccccaccatgaactgtaaagatactactttaacttaaaactgtgcttgctaaaatatttcaatgttggaaatgttgcctctttatagaggattagggttgtgagggtaataaaatcagtcttgaatttcttggcggagtttatctgtcatttagcaaaagatgcctttctagggaaaattgaagaaagtgttaaatacattcttttatgagaaaaaatataaatggtaagagtgtaactgtgaatagtgacacctttatcaagttgaatgtcctttggagtgaggctttgtcttgtcattatagttcatgtattgctgttggtgggcttttaaaatctataaacgtcttatcttttttgctgactattcatgcaggatatgctaggcaagccaactgtgacacatactctgcctatacttgtagctgcctcttggatgaaaatgaacacatatcttaaaaccaaaccttgggtgccatatagcagtatttaatgaacttctgggattgcagacagtaagagccaagttttgatctcacatacctgggaacacattgtcctacacaatctgttgaaagatttattatttctgaagtagcttgtgttaaaaaccttgttttaagtatagagggttgtaagcctatcagtctcagcaaattgataccttttttcacgtctgttagactcagtgccacctcttgtcctgaggacagatatagcacattccactccatattaggtatccttgctaagaattctttttttgggggacagagtctcgctctgtcacccaggctggagagcagtagtgtgatcttggctcgctgcaacctctgtctcctgggttcaagcgattcttgtgccttagcctcctgagtagctgggattacaggcatgcggcaccatgctcagctaattttgtatttttagtagagaggggtttcgccatgttggccaggctggtcatgaacgcctggcctcaagtaatccacctgcctcggactcccaaactgctgggattataggcgtgagccaccgagcccagcccttttcttttctttttgtgacagggtcttgctttgtcgctgaggctggagtgcagtggcatgatctcgctatcttggctcactgcagccttcacctcctggggttcaagcgattctcccacctcagcccctgagtagctggctctacaggcgtgcactaccatgcctggctaatttttgtattttttgtagaggtggggttttaccatgttgcccatgctggaaaaaaaaaaaaaattcttgaatgacttgagggtagggtttttgaaaaatagaggtgtgctgttagatgtagaacttctcaggtgaaacagcccctgggtgattggttaccatggtcattgtgggtaaactcctgatttggaagtagttgctccagtattcatatgggtcattttggttcctttctggcttcagaagcctgtcaattgagttcttaagccaaagaccaagttaatttagagatgtcgatgtcagtaatttaccttctgattgtcagtgaattatttaagaagtatcttactatttttctaaggtgaatgagctttggggagaggtttttcataaccaccatctctgttttacctgaatagaaagagcacaatcagcccatatctgtgactacacagggttggccctgatcttagggtggcagtggatgagcatccactgtcaactctcctgtatctctgggtgttcagtgcctcgcattctgagatttggcccataccttccaggttagcattgagccatgggactatgttagtttcctctgctgttgaactgctttaggaagaaaagacctccttgtttctggcggtgactgctgggccttacattcattttgggtcaagtaattcattgagcaaaaccgtaggctgtaggttaggtatacagcttctcctccccatagggtttgtgtaaatttcccaaggcctgggaaatttctctgtaattccggagggctccacttatcctggagcacccacttagagcctgaaaatgccacaggttggtctatacttcacagcatcagggttttctcacgtttgcaagcttcaatgacaagctccacccacatgaatcttgtaagtggtggcagagcttgctgttatccagtgcttattgtgtgccaggcattctgctagatgctttacatccatcatcatttgctctttacattaagctggcgacttggagactacttacctcattttgtagatgaggaagcggtgtgactagtaaggggcaggcagcactgggatttttagatccaagcctggtctcattcccaggtccgtggcctttgacatcacatcctttaagctgcatggcctccctgagctctcctttccgttggctctcatgcctgtgcaatgattccgtccctgatttggggtcctgtcacgtgacccccatcacttattaaccaggtgacactgttagtcttttcactgactgagtggcattttccctgtcagtaaaatgggagagaatgatccttcttctttaacctgttgttgtgaggagtaaatgagataatgtctctgttatttattagacacctattttatgctaggcactgtgctagaacttccagtacagcagtgacacgaacagacgtggtccctgctcatgaagcctgcagacctgtaggcatggcaagacacttaaacaaaaagcgcacttagttttgtgctatatgtctgaatcatatatagttgttaaggcccaggaactttgacttcaagtttaagctgcagcctcagcaggcactatgcttttccagggtcctatttgtaattcttacagaagacccgttgctttcttttatgttgcctaatcctcttccattgttccccatttcaggtctctggaagtcagaaacctggaagttccgccccctacctacttctcagcttcttcttcccctcttctattctcctgccactgtctgcgccatttgtctgtttcttaaggtttcctgctctgctttctgtctttctctcgtttctgaaccctgtttaaattcaacgcttgatttaataagatcttagtctagtctccattatttcaagtcatatatcgcttttgataaattgtctttttaagcacttatcctaattttgcatttgtttatgtaggcagtttttctgtttctccaattagactaaaagttctttgagggtagggaccacttctctgtctctctggtacctatcccagctgcttgtctgttttcaaatacttactgagttaggttggattccacccccctcattctcttctctggatcagctctttctctttcatctctttgcctagcattttcatttattctactaacatgtgcatttggtctatcaaattgaacatatcccaaactaaacacatctccccaactctgcattttttccttatttccaattcttgttaaatgtctctgttgccattatccaaatcccttttgcctcagtttcttgtaacactcccgttttctcaccatcttctgaataggaagattgatttaaggaaagattccttggcatctctcataacttccctaccttcactgccactacttggtggctcttactgacttctgtgtctgaattgcatacactggcctgtcatggtggttcacgcctgtaatcctagcactttgggacgctgaggtgggtggatcacgtgaggtcaggagtttaagaccagcctagccaacattgtgaaaccccgactttactaaaaatacaaaaattagccaggcgtggtggtgggtgcctataatcccagctactcgagagactgaggcagaagaatcgcttgaacccaggaggtggaggttgcagtgagccaagattgtgccacttcactccagcctgggtgaaagaacaaaacttcatctaaaaaaaaaaaaaaaaaaattgcataacctgcctcttcacttcttgccctgatagatttgagcatgtcggatcttaaaagtctttgatagctactgaagtattcactagtgaaataatgtcatgttttggattttctttaaaattatccagtggaggagagagctaaaggggattttgggagaggtgaaacaagactgaccatgtgctgataattgttgaagttaggtagtgagactcacagaggggctattatactgtttacgtttgtataatacatgtttgaaaacttcaataataaaaatttgaaataaaacacagcaaattttggctttacactgtctatagataatatatgaacctcttggcagagcatacaaccctctcatactttttccccagtgcctcatttggcttctaatctccctcaactctgtatacaggctgactctactctgaagccatttctgtcctcagcattgatctccggaaaggctcagctctacaaaaaaaatcctccctggcctaatttactagcctgatttgagttttctctcccatatcccttagcatgtaccgcccttaggggcctttcacattgtatgtaattgtttccttgtgtctctctgagcactgacccccagccagttttatcccagtactgaggactgcccaaactgagaaggttctccccagcctgccagtatttcagtttaatactcattgcatgcctactgagtgttgggcacttgatgaatacttgagatttaattgactggttgcttctggtctataatatggagagagtctaccatctggctttctgggctgacgttggctgtacatttcatccctctccctcactcttacgatcttcctagattctcctttgggaatgaagtatataatgttcagagatgcttaggtagactatgccatgtaaggtagccagatagtgattggcatgtcaaaaccctttgtccagtctcttcttaatggtgactttaaaaattgttaggctctgtatttacacttgttaagtccctctttcctctctttggttcatctttactccataaaactgggtaggggagttgtttttttgtgtggggagggcaacctccagccagctttttgtgagagcccactctaaagcccctacactagactcttcaggaaaagcaaagtaaccttcccaaaccatttaattcatttcacttatttctggccatttgatgattccaaactccaacaggacctgtagcccagaggtaaaagtagaagatgtttaaaagatttgagaaatgaactaatttttgtggtctggagaagtaaagaccaaggtatgagttaatcactgttttcaaacacatgaaattattttgcatggaaggtagtaccagctgttagccatttgagtgaaaataaacaaaaggacttagattgcagctggagggattttagttagatagaaatttttcattaagtggttctgggtgggaactgggttcccatcccagtagattgttgatttaggtccagattggagggcagtggggcagatttgaggaatttaagcatcctgaaaatcagtcctcatgattaaaaaatcagcagctgcgaatgctcttcgtgttcagagctgcagaatgaggattcccctcatccctcccaccttcccccaagttgaaagaaattaacctcaattaaaggaaacagtgatggatggttgcagagataagtatgatatatcacacaggaaaaactacattaaaagcacattaaagttgagacagaaagcactaaaagtgaagaaattcacagttaaggttgaaaagtgatatcgtttacatctctgctaatatggagacctaacagggtacacttaagaaattatgagtgccgggcgcggtggctcacgcctgtaatcccagcactttgggaggccaaggcgggcggatcacgaggtcaggagatcgagaacatcctggctaacacggtgaaatcccgtctctactaaaaatacaaaaaaattagccaggcgtggtggcgagcgcctgtagtcccagctactccggaggctgaggcaggagaatggcgtgaacccgggaggcagagcttgcagtgagccgagatcgtgccactgcactccagcctgggcgacagagctagactccgtctcagaaaaaaaaaaaaaaaaaaaattacgagagtgccctgttgtgctaagaagtaagttttttgacttcacatactaagcttaatacacagtttcattgcccagctttaattaaggcatcattcatgactgattatagcccatggaaaaaaacctgttacttttaccaaaagagtttggggttggttttaaaatttagctttggaggggaccaggtggtgattctgtgactctgtgcatttcattacctaacatatttcagcttttctaaagtcaaattatttctgcttttctaaagtcaaatatttctatttaaaaggcactagttttgactaaaatgttaataataacagatttaataatattgagtaatattgtttccatctgtttagaaaccaaaatttagcttttatcccttcatttcaggggtggatttttgcttctccaaaatagatcttaaatcttatgtgtatattttaagcaaattattattgcattttaggagtcttagccagaataaaatctgattacattttcaattcataaaattacattgtgaccccagaaaacatcctctaattgctttagtttttacctaataagactgtctctttgtgtatgtttaccatattagagacaaaaatccctcaaatgggtctagaatactaaatatttgtgtacgatagagtgtggatagtacaaacgtccgtccttagctgcttcatcccttgtctgactctaaagagttgttacttcttcctaaaccaagagccaagatggaagatataaccttccaaaaaatcagagtatatgccacagcgggtttcgtatccttacagaagatgttctctctctccttcttttttcttccttcccttcttccccatccctcctccctccttccctccttctttccctccctctcatttatttttgggataattttgagttctttcattgaccataagcttattgtgaagaacaaattcagtttatcaaatttagctaccaaatcttaaaatttgatttttaaagtagaaagataattgcttcttattaaaaaaaaaacagacaaataagtaaagttatgtcaatttgtataattccacattaatgagctagtacatgggttaaaatgttatattagtagtttcaagaaaggaaatgtgagctataattattatatgttttctatttttgttacatttaaggtgagtcttgtaaaagggccaatgaaattgccttaagtaaaatgattattaaccaatacaatttatggcatattgacttgggtaatattaatttgggtacatgacaggatatatactcatggtctcttgtcacagatttttaggttgggttacttaccagatgaatgagtttgtgtttccacttaatttttttaaagttcaggaggccaacaatttgacagatttgaaaataaaaatgaaattgaggtcactttttttctagtggctactttggtatgccgtgcatagactctgtttcttaatgcagaaaatacaatctttatgcctgtttggagtttcaaatgtaatataaatgtcatgtatcatcataagtatgcaaacatgttttaaaacacagaattgtatggaagcaattactggcagtgagtgagctacacaccccaagggtgggttggggccaaaaaaattaaagttcctaaacagaattacttttgtgtgggtgggaaagagagagcaatgttaacttttattaggaaccaatcccagctcttattttaattctcgtcacatacttggtaactcaaataaataggtagtaaagggacattaagggactttgtgttaggattagttttccccccacttgctatagtcttccggtagggagtgattagtgttcagcaggagggcctggtggacaccagtgcatatatagctctgtagttttcaaacactaggtgttggttaaagatgatgttgccaccctttgtgacatggtacttgagcattcttttgcggggtgtgttgtgttcatttttagcagaatgaatgggatgtaggaaggttagattttatcattggaaagtaacatgctatgtagttttctgccactcaccactagcctggagaagacctgaatgatgggttctccctcttgaccccttcatgctgtatgttttatttgtttcctaacttcatataaaatcactatcatctgaaggtgatgatggtttttttttgtttttttgagacagggtcttgctctgtcactcaggctggagtgcagtggtgtgaacacagctcactgcagcctcaacctcctgggctcaagtgatccttctgcctcagcttcccatgtagctgggaccacaggtgcatgtcactatggccggctaagtttttgattttttgtagagatggggttttgtcatgtttcccaggctggtcatgaactcttgggctcaggcgatactcctgtcttggcctccaaaaatgctgggaatatacgtgtgagccaccatgcctgaccctgaaggtgattttgcattgtactattttgtgggggtatggaccacaaaaatggaggggaacggaattactctctataaaaataaatttatcttctgacattctctggagccctttgctaacaaggtttaaatggatcttttttctaaagcccttatcaccataacctctcagctagagagccgttttgggttcaactgcaggttgagctgagtgaccatctaagcagcacagggactagcagccccttaactgtgatcagaacatcactgtattgataagtgagtcttggtcaagtcacttaacctttcttccttgattttctattatgtacactggaaatgatagtatctatctgcctttgatctcatagggatgcttcaatccattaaagtcattaaagcactttaagtaaggtataaggcactagatgcaaggcctcttcattgttgttatcattactgttattttattacagtgctgtatacaaagggggcactttttaatgctaaacagtcatctcagaatatgttctgtggaatccagaagttgacagaggaccttaagcggtcaggttatctttctctttcttcttgaagccaggctctgttcctcgttgtctctgtctgttactttggagaacaaatagcaaaaccaggaacacaaaaatgaaaatagaaaattgagacaaatggggtagctgtagtctacttcgtgttatttcctgggaactgctgttggtgttgggtctcctaaagtgggaagttcattgtgcctctctggatactgatctcccctttctgtaatgtgcacatccaggggttttgaagtggattgtgggctttgattcattcccacttgcaactttcattttctttgttttttcgaaatactgttttactaggaaagagaaaaacatttgggggtagggtgggtaaagatctctggatgtctttggatagtgttcaaaggcattttgtacgagatgattgtatttcctacatcagccccttctggcatttcatctcaaatacttcctcccttgcacctcataaaaaattccagaaggtgaggtacttccatatggccttggatggcaccaacttgatgatgtccatgaaaaaatagaggatcaacgctcaccttccagagtgaagagtttgcttcctggagcatgggttcttttgatctcacaaatatcactattctaaagtaacctaccctgtcctttatcttaacattctgaagctgatgttggtgactctattggttcttcttggctaaaaagttttgctactttccatgttcattctttttaatttttggtactttgagtatcatgataaattttacttctgttaccttatttgtggactgattactctgctccaccatttacatgtaacttggtagcattttcaatttcatcagctacagagcactaattcctcaaacatgggcctttgtagttaggtggaacttaagacagttgagtgtcatggtctgaaatgtaagttatttctgttcatcaaaaatattatttaagggagccctggaataattatgagtactgaataattaagccataaataaatataaattggtaaagacatccatcatttattatttggttttccagcttccataactagaatcctgaacttacgagtatgttgctttataaattaaatagaatggtttgcttttctgactccctctccccgcaaaagcataagagtctaacaatggattttctggtattgatttgtttgtttgaaaaatcttagattatatcatagttttgtattttagaatcagtttcttgaagaggaagaatacaattatatgaaattgggattgttgtggaaaatcagagacgtatgtttgctataggtataatattagtttttcagcatcaagagtaaaacaagtggaattacctctgaaattgcagctaactattgctacctctataccagaaatattttttcatcttttcataccacatgtgaaaactttgttgttgttgttgttttttgttttgagacggtcttactctgtctgccaggctggagtgcagtggcacaatcatggctcactgcaaccttaacctcccaggctcaagtgagcttcctgccttagcctcccaagtagctgggaccacaggcatgtgccaccactcccagctaatttttgtatttttttttttgtagagacggggccgctctgtgttttacaggctggtcttgaactcttgggctcaaacaatcctcctgccttagcctcccaaagagctgggattacaggtgtgagccattgcacctggccctgaaaattcttaagtggggataagggataacagaacttcttggttcattgttacctacttttcttttttctttctttttttaaagaaatgctgcagcactcattattttttcccctgtttccctctcctccccaaatttcctgtcagcaactttgttttctgttcattagaattcaaacacaatttaaattaatttcccttgccaccttctctgtggttagatacacctttggtgagttcacaaatgactcattggactatgatgatttttgttgatttcttacatggtccaactgggttatccttagagatgccttagaaccagtggaggtgttggctgtaggattagatggacttaacgcagattactggggatctcctggtattcatatccctgtagttgctaaccaggcttggatttatcctggattggacctttttttcactatcagggcctaaggagcctttttaggcattttatccaacctcctcccagccaggccctcattacatcctaagaataagattttgtctggcagggttgaactttaaaggaccataaaccgttgtaatatctaaattttttcacccctattgaaaatgcatgatttagacccaatatgtggatgcacaaattattaaatgacttagctatttatattccacccaatagtgtgggtacatttttctgagagttgctgaacagcagtggtattttgaaaaatactactcaccttgaggaggttacattgaatttgtcttttttggcttagttttaaaatgaagctgattacttggtggtatacttagatggtctttgataggaccctctcctgtcctgccttcccccatggaagtatcattatagctatttcctatacattctcactgcaaataaaattcagaaaatacttagctcgtaagagtttctgtctctggccccgcgcggtggctcacgcctgtaatcccagcactttgggaggccgaggtgggcggatcacgaggtcaggaaatccagaccgtcctggctaatgcggtgaaaccccgtctctactgaaaatacaaaaaattagccgggcgtggtggcaggtgcctgtagtcccagctactcgggaggctgaggcaagagaatggtgtgaacccgggaggcggagcaggcagtgagccgggatggtgccactacactctagtcagggcgacagagcgagactctgtgtcaaaaaaaaaaaaaaaatagtttatgtctccaaaaattgaggtattctatgatatttatgtgacttctaccttcagttgtgattgtagaatgccttcacagatttaaaatagataccaataaaatggaattatatataaatggcatggttaagaatgattgttctcttgatttgttttcaagctatgtttagtattccttttttcttcctatgtattttgagggatttaacactgagtcatatagatagtgttaattttcatttcagtttataaacttctatcaagacaataagatttcagtgtaaaaaaaaattaaggaaaatatatttggtggttttcctcctcctgaaatcttaaaagttaccatactttccattaaagtcctctctaatatctatacagaaaacatactgttcttgaataaaacaaaattaatttgtggtccttgacttctgtggaaaaagacccttatcataacaaagtacaaaaatagtaaaagcaattagtgaattaagcctcaattccaattgcctcgattttttgtatgaaatcatatctttcttattatagaagtgtgagattatagccagctgttggagtagtaacttgtaatccatttctgtacgttggtttttggtgtgaactgaaaatgattaccatgaagttaagtgttataacctactttaaatgaattagtttcctggaatttattactgctaaaaatcagaacaaatttccttaggaatctgtgtttataacaaaaacatgaactttgaccgtagaatacttttcccattcaaatgaaagataatttaaacaatatttttaaaaggttgatttaattttacatctgtgagtataaatacaaccagttgattcttcaaagatttttgattgtgataataagattgatggatatattgtgccttagccttatattaaattggcagatttttaaataccagataattagaaatgctattaattctcagtgtagaatgctaacctaacatttttgtatgtcttgtgcggtcaatagaataatggccacccaagcatgaccaacttttaagaacttgtgaatatatatcttacataagaaatgggactttgggctgggcgctgtggctcatgcccgtaatctcagcaccttgggaggccgaggtggacagatcatgaggtcaagagtttgagagctgcctggccaatacggtgaaaccctgtctctactacaaatacaaaaaggagccgggtgtggtggtgtgcacctgtagtcccagctacttgggaagctgaggcaggagaatcttggaggcagaggttgcagtgagtcaagatggcaccactgcactccagcctgggcgacagagtgaaactccatctaaaaaaaaaggaaagacaagggactttgcaaacgcggctaatgttaaggaccttgagatgagggagatattcctggattttctaggtggacccagtctaatcacatgaatcattaaaagctgagaacttttcccagctgtggtcagagagagatgaccatggaagaatagtaagagagctctaacattgctggctttgaagatggagcatctgggccctaagctaaggaatgctggtggcggatagaagctgagaaatacaaggaagcagattctgcttttgagtctcttaaatggatggcagccctgctgatatcttgactttagcccagtgagacctgtcaggcttctgaccaatataactgtaagataagaactgtgtgttttaagccactaaattagtggtaattttttagggtagacatagaaaactaatataccttgctttgtgtttgtaatttcttgaataaaattatcaccaaactctctaaatactgtaaaggaacaaaaagctatttgcttgcatataaaattgtaatttataagactttattataatggattgttacaattaattttgcttttaaataacagaacgaacttgatgcgaccttgcaagtatgctttttttttttctttttaaaatcaagggttgctttgctaccattgtaccaggaatatagtaggcagtcaataattgttggaaacagtaaaattacatagtcaacattttcattagctattgttaatgttgttgttaacaatggagttttgagaaaggggcttaaggaaatgtaggaatgtaagtgtgttaggtcttaagaagtatctccaaacttttgacagatatttctcacatttcgatttctgtcatgttcgacagttgtcaagaaattgctcaagggtttattggactcaagcgccagggcatgagtgagtttatctctgtcttgataagctggacactgatggtagccagaaagtagtggtgatggggagttctgattcttcagataatcgtttcctatttagttagaaaatgacaggattcaagatgttgtaccatatagcaagagatttaagatcactgtaaatacgtataataaattaggtaaatctacatgcttttaaatagcttttaagctgcttgtctactttcatggctagtatgttggaacattcaatcagaagtatttattgagtctgtctgtactaggcactggggatataggttcaaagagccctgccatcatggtgcttattgacccataagaaagaaattaagtaattactagtgttggaaagtagtacagggcactttaggaataggtagttaccttcttgggtctatttttttttttttttttttgagacagagtctcgctgtgttgcccaggctggagtgcattggtgtgatcttggctcactgcaagctccacctcccgggttcaggccattctcctgcctcagcctcccgagtagctgggactacaggcacctgccaccatgcccggttaattttttttgtatttttagtagagacagagtttcactgtgttagccaggatatttttgatctcctgaccttgtgatttccccgcctcagcctcccaaagtgctgggattataggcgtgagcccctgtgcccagcctaggtctagtttaagaaaccatttctgaaggcaaggggagaggttcaggaatgaggaaagaaaaaagctttaaagcaaagaaagaatgtctggagcagagaaaatctgagatcactgtgagaaggtgataagatggttaggttggcagagatcaaatcttacagggtcctcttaaatgattttggaacctcagctgcaatttgaagaatgtattggaagggagaaaaaggtgactccaagaagctgaggtaggaggctatttcagctgtcaaaatatgagagtctgtaccagagtaatagagagaggaatggaggatagatccagagacagttaggagataaactagaaagatttggaggttgactgcatgtggggtgtcagagaggcagggagaggtagttggggaaataaaataatcatgccaacaaaaaagacatattatccacagcgaagagagagagaatataatttattattgagtaggcataaaaagattttgcaggtatgtaagatatctcaaaagtggctatgaagttggggacaaaatcacagttaatacagaacagcagaagaaagtatattcttaataacttctcatccctttgagagacaaagaaagggttgtcccttttgatagtcttctgtacatctcatgagagacacctgagttaatcccagagggttgtttttcacatatctagcgttggtttggcacatgacttagacgtatctctacattgtaaaaactggagactgaacttaatccttagagagatttatctctgttccaaaggttagagtaaggactcagattcacaatgtctccaaggaaacactcctaagaaaagcggagaaggataaaatggtcttttataaatggagaaaatcattttccaagccctcaatagcagatggtgccatttactgaggtaggcagcgctggaggaggagcagatttgaggagtaataagacagacacttgggaagatgtcaagtttgaagtttctattagacactgccccggaaatgacaggagtgcattcatagtggagaagggagatctaggctaaatatagacatttactagccgtcaacaggtagtactgaaccctgggaatgtactgggtagcttagggacatggaacggtgggatggggaagaaaggatgggggggtcatctcttttgtcatataattgcatagttagcatagtgatattaccctaatggttaagcgcagcagtggtcgacactttcatcttttgactacttttcctggataatgtagctaaaagtttacatcacctactcttgtaatctagactcctgcccttttctgttaatagggtatgttctgaggtggtgtccccccacagcctcctttccttttgttcactgattatgcattctcttcagtcccctgggtctcctgtggactgttttcctgcacccagtgtgcttctgcctccctccatttgaggccatgtgtcttctcatgctctcttgctctctctttttgaactgttgcttatttggaaatattttcagttatttccacacataacttctagatgtttatacctttttacagagtcaggtatcctttttctggtgtatttatttggtctggaatgtgtcaggttttgaggccacagcacagatgctttgctctcccataagtgtgggcaatatgtggagaatggctttgtgtggattggaagtggaggtgaagggggaagtatcttgttgggaagaaatagctgactgtggccctcaagtgcttcttgggtggatgcatttaataatgatcttagtgaatcagttgctgcatattgaaaacaagatggctggggccgggcgcggtggctcacacctctaatcccagcactttgggaggctgaggcaggcagatcacctgaggtgaggagttcgagagcagcctggccaagatggtgaaaccccatctctactgaaattacaaatattagctgggcatggtggtgggtggctataatcccagctactcaggaggctgaggcaggagaatcgcttgaacctgggaggtggagcttgtagtgagtcgagattgtgccactgcactacagcctgagcaacagagcgagactctgtctcaagaaaaaagaaaaaaaaatgactatttgaatctataactgaacctataattggaaaatgaaatatggggtgggggaaagaccctcccatttgtatttacaagaacatttagatctggattaaaatagcagtgacctttgctctttattatatcggacaggtcagtttgcaagtttgttgggttggggcaacttttctgaatcagactcatgtactgataaattctgcacttggtggaggaggcaaaggttcttatccagagacactttagggaactctggggtttggcaagtaggaaaataggtagaaatggcgctcagggacatttcattttgtgatgactgactgtgagctgaagataaatacataaaaaggtaggcagtgatgccttggacaaagattttaccaactggcagtgtgaaatattctgtagaccaccagttctaatgagtttatcttagacagttctgagagtgtcggttaataatttaccctttctgagagacagaggcagcaattacaggctataagcgagcactctgaggcttcttgctttgctggagcccatctgggctggagccatggaccccattggttgtgacacaagtaccaagtgtctgcactttggcatatggaggcttcacagcgctcagtaaggcatagacattcagtgtgattcacttcaagtgatatctaaagtatggattactgtaactacccatctgctccacatcaaaaagaatagaactctgtatagatatttttaaagtttattttgaagtaggatggtgttctatatggaagagagggtggtggtggaaaaatagattattttgaagaaatatttatgaagcttcagagaagggacatactgggcttgctgattgatacctggaatatgcttttattgtctaacaaaatattggatccagctgtacatgtaagacttacccgttggcagtgtgattgatactgttaaaaacttgagtctgtttaccccttgccatacaatttgttttgatgcaatagtgaacacaactccactgtagatttaagcactatttatgtgaattttatttccctgtttagtcactgaatcacattgtagtgttggcatgataagttttgtaatttgctttcccgtgtgaagagtgcttttcttgaaccaaatgttgacttctgcatacttttaaaagttaggctttatgtcattacaaagatttacagttatttaataatgatttattgcagtaatttattctgccagctgtggcacattttcactggaatttgtaaatcaaatttatatagaaatttaccaggacatgcatttcaggatttaataaaatatactctaaaatctttttgaagaatgtagttttatgcttacacatttgggattaagctttaccttaacagccattgttactattcaaactgctgtgtttgtcccacagtcattgaaaagaagagtcaatgagatctgttaaaatacacagtttcaggtcatctactttgcttccagacctttagtgtcatgttatatttgacctgggatattcatatgatgttgagggacatggaaacatcctgacattaggctctgtgcagttctgtaagttttaatcatattaaactgtgcatccagaatcataactgagagtgaatgtagtgcactgtattcatttagaaaccctaagtgtcagattttctctccctttttcaaaacttactggctaataaccatgtggaatacatttagcattggctgtgccagctcacactcctgtagtttctttggaatgcacaaatacggcaagttattgtattttctttcttattttaaaaaagattgttgcgattttgtttacttgatgatatatatgtttctagagagagaatctagaataaaaagaaaactatacagattattttgtaacttgtgtgtcattaaaaaaatctagcaatttgagaggctgtatttaaaatgtgtgattgccaagtaatttgtaagaatgacttgttctctaagactgcgtaagaattttacttctaagattaaactactaattcacagcttcagtcagctggttattttgtgtacaacagcatgaaacgtctcatttgacttaactactgccgcccaaacacattgacttcattgatcagttgttttaatattgtgaagatacagtctgaatgtgccctgaagctaaactttcaggttatagttaattgtatttaaagcagtaggctttggactatctaaaaaggaagtgaaagcatttgcaaatattgtagcctttaatttttcatagtagtttgtttattatgttcaagcactggtaaaacataacttaacaaaacaaaattttgagccaaaacagcttatcatctgaaatgtaaacccagtttatcttcggatctcttattttttaaaagacgtaatttcttaaaagaaattattagaacagtcttcagctaggagttcaagttaccgtacataaaaaactggatctttatgttattaagatgaaaatatttttgtttttagagtcttgctctgttgtccaggctggagtgcagtggcgtgatctgggctcactgcaacctctgcctcccggattcaagcaattcttttgcctcagcctcccgagtagctgagattacaggcgcccgccaccatgcccaactaatttttgtattttagtagagatggggtttcaccatgttggccaggctggtcttgaactcctgacctcaagtgataaaactgcctcggcctccaaagtgctgagattacaggcgtgagccactgcgcctggctgaaaataattgttaaaaatctttaattttatatatacatacatatatatatatatacacacatacatatatatatacacatacatacatatatatatacacacatacatatatacatacatatatatatacacatatatatatttgtgctggggacagcagctttatatttctagaacaataataactttttatatgatttatgactcttcacagtgtttgatatttacttttattttgagaaaaattaatctgcaatgcaagggaagtcgagagatagggagatttcttgaaagggagcaaagataagactttttcttgagagagttcattgctgatctcttagatgtgatactgtgttttccttgaaagcatgtaacatttgtgtgctgaatggatcatggagaacgcatgagctccttagtttacatttactcatccagtactccagtgctcacaatatactagggtttttttttttttaaaccattttcaatgcaatttaagagaatattttagaattaagttttcacagttttgtagttttttttatttcacagttttgtagtttttttttagacttcagtgatgttttaaatgttttccttgtgcttacctggaaaagctttttaaatgataccaatttggaatgttaaaaaaggtataattctgggatgacagatatatttaatcttgtgggtgaatttagactgatggttggtgaatgctttgagagtctgaggtgggccagagaaaaaagacacaactctgtacttggttagcaatgcctgccattgccgctgaagtaccagtcagtggaagcatctcctgaattcatctccctagcccagaaacttctgtgttactgtaatcattcatttattcatcttgtgttcattcattcacccaaatttttcaacatttctgaatatgtggcagcatgccaagcatggtaggaatatagtggtgaagcagacatgaatttgctttcaagccttgatgagtgggaggcttaatcgttcattaacaaagagttgaaaacagggtggcagcggttttggcaagaatgtgttacggtctaattcagagatactgaacttgggacctaagtaagaaggatattctgttgtagaaatctggcagattctagagtttgtttgagagatctcttgcatttgctcattgggtatgccaggcattctggagggatgcccattcgcatctgacaggatagatgatctactggtcaaatgtatagatgatgtctaacatctccgtaatgcaaggcaaaagtaggttctgtaaggggaatgatatgacattagtttagagatgagtggtaaagccatatgctgttgggtgtgatgccagtcagtagtagatggtagagaattgaagatagagcataattttagtgttcagccatttttaatttcagaaaatatttttaggtagaaatattttaactgtatagtacatgtattggtacaaatataagtatcaaattatatttctaccttcaccattttttccaactagaaatcctataattatcttttgcttcttttcccttagagctaaaattattttaggtatcagttctcgtagattctttaaaacagaaaacaaaactctaaattgttaatttatttctcacaattacctagtttaggtcctcatgctctgtgatgggctgtccatttcctattagtgtctactatagtttcaagtgtaaatgcatgcagtgtaaatgaatataaaactgataaaattcctcgttcttagagcttatgttctaggggaatatttgaatacaaacaaatcccctaatttaatacttctgttttctgctgcattcaccattcctagatgaaacataacttctgttacttaactactgtgttcagaaatttgaagtccaaatttcaaggcctctacagtttgcctgtatatacgctttctaatctcatgtcttattaaataatatctttcatctatccaaggaacagtgcatctttacatccttacactattttttttttttttttaaagcacaggatctctctctcttgcctaggctggagagcagtggcacaatcatggctcactgcagcctcagccttccaggctcaagcaatcttcccacctcagcctcctgagtagtagggaccacaggcatgtgccaccacacctgggtaatttttaatttttttgtagcgatgggatctcactctgttacccaggctgatctcaaacaaccgggctcaagctgttgactttcccgccctggtctcccagggtgctgggattattatacttttattcgtgcttcccccacccatttggaatgttctcttctctttgccttttgatattctccttagtctaagaatcttggctcaaattgctcttttaaccaaataacgtatgttcctggatatattataactaacaacacgtgtactgatttgtagacttctacttttgtaagagagtgcttatttacatcttttatttaacttgtacatttacatatagtctctccagctatactgtaaatgatgtgaaatcagaggactttgttttaaatattcatactgggctaatatgagcacagttgaaaagcaggcaggaactgtgctttgagcatcctggagaatgaaacaaagcttacaagcttacatactgaatttctaagatagtcattcccccatatattgcttagaacctgaaaattccaaaactctctttggttttcagggccatcattatatattaatttttttattttgttaatttcatatatatatatatatatatatatatagtataaaaagtgaaaaaaagtacagaagcttacacagagaaaacaaatggtccattgcttttttttttttttttttttttttgagacggtttcgctctgttgcccaggctggagtgcagtggcctgatcttggctcactgcaatctccatctcctgggtcctagcaattctcttgcctcagcctcctgagtagctgggactacaggcggctgccaccatgcctggctaatttttgtatttttagtggagatggggtttcaccgtgttggccagtctgatctcgaactcttgacctcaagtggtccacccaccttggcctcccacagtgctgggatacaggcatgagccactgcacccgggcaaattctcctttttttctgtttactggattccttctttttaaatgtttaagacaatgtctcactctgtctcccaggctggagtgcagtggcacgctcaggactcactgtagcctcgaccaccccgggctcaggtgaccctcccacctcagcctctggagtagctgggaccattggcacgtaccaccatgcccaactaatttttgtattttttgtagagatgggttttgccatattgcccaggctggtcttgaactcctaggctcaaacagtcttcctgcctcggcctcccaaagtgctgggattacaagcgtgagccatcacacccagacttatttgccagatcctgaaaggtatttctagcaatagcttagccccattttagaagtatttgttacctcctcagtttttcttttctactctctctttctcctgtttttctctttctccataaatgatagtacacagtatttactgttctgcatcttgccttttactcatgttttgtttggagatgttgtttatctgtatttacagtttttttttccattcttcttaatgactacttaatattccattggaaagattcatagtaaaataaaatagcaaattctagaactgggaagaaggcaaatgttaggcaaacaattaataattataactaactatgaaaggataaaatggtagatagttgaatttaagaaaacagagccttcccagagctcctctttcccatgccaagtcaagtaggaagccctaagcacttagaagcctaaagatattaccagatattaattgatgtttaattatcaagaaagatatgtcctgcttaaaacagggtaataggcagcaccttttcagaaaattcttgtctaaaatggtagaaacctggagaggcaatgctggatatttggatgagcacatattttgaaatcagaccaacttggtcttgaattcccagtttgacccttaatataagacttcggccaagtgactaaactctcttagcttcgatttccttattggtaaaatgagaataataatacctatctcagaggacttgtgaagaatgaatgaaaaaatcttttatgttttgcatagtacctggcacacaacaggtgctcaataaatataaagttccatctccttgactctgtgcccttccagaatgattaatttcctaagagctctggatgctgagattttactgttaattgtatcttttataaaacttgcaatgtcttgtacatagtaagaagtccacatttatgtgtagatttattctgtaattcttaagagtctggcttggttttcttgaaacttttcatgaaatttctcaaatctctagaagcgggtacaaggacaattaattatttatgtaccctgtgaagatgcctaacttggccaaatgtcaacatctcaagcagtggttgtgcttgtaaaattttaataatctgtactttcgtagtatactttgtatttctttgcgtggtgtgatattttgtatattttaaaaatgggaagaatttcagatgttttaatatctgttaggtggaaagtataattctttttcaattacatggattaattttttttttttttgagatggagtcttgctctgtcacccaggctggagtgcagtggtgcaatctctgctcactgcaagctctgcctccagagtttacttcattctcctgcctcagcctcccaagtagctgggattacaggcacccgccaccacgcccggctaattttttgtatttttagtagagacaggtttcatcatgttaatccaggatggtctcgatctcctgacctcatgatccgcctgcctcggcctccaaaagtgctgggattgcaggcctgagccacactgcccctggccgaattttaagtttaggccaggcgcggttgttcacgcctgcaatcccagcactttgggaggctgaggagggcagatcatttgaggccaagagttcgagaccagtctgccaacatggtgtgaaaccctgtctctactaaaaatacaaaaattagccgggcgtggtggcacatgggtgtaatcccagcaactctggaggctgaggctcgagaatcccttgaacccaggaggcagaggttgcagttagcagagattggaccatggcactccagccttggtgacagagcaagaccctgtctcaaaaagcaaacaaacaaaaaacaaaaacgagtttaataagattcatagggttaaatgtggggggctctgacactgattgcagtcaggttcaacatggccaatatgaagtcaactggcttgtaagtttcctaaaaatttaatagtcagttctcacaagtcgcaaagagtaaatctggtatactactagattatcaacctcctgggtgactgctttgagctccggtgtaaacatagttaggagaaccaattcgtgaaaaatggtccaggctttgctaccagtttattctttgactttgcctcagtttccttgattgtatagtaaagcaatgggattagatctgtttcctaagattttttggtatgaccttacaattctgtgtgtgtaaggctgcagaagccaaggagcccaggctttatacgacttgtctcatattcacaatatcaatatttttttcttttcaaaaaaggtctcccctagttaaagcaaatatatttgagaaccactgttactgaaaaaatagctgtctcaaagcccatgtctgtacttccagcagggcccctgatacagtcacatgtaatgggtttacttattccttatatatatactacagtaaacaatctagggtttaggaaaacggaaaagtaatggaatgcaattcagtgttatttttatcagagacaggcataatagaaaacattttggtacttgatactttatttaaatatgactttcatttatgtgtgaatgaactctccatatatgctaatggatgcttgtaggccaggcatcatgaacttagatggcaatagtggccaggcaagtaaaggaattgcgagaacctggtagggtataaaatgaaagtacgtgctgcagagagtagtttctactcctcccttgctgattgttgtcaggaaggaacatacgtttctgttaccatatctttaattctttaacgcctcaccttttgcctctccctgcccattccctcagcagctgaatatccatattttaatttaaaatttcttgtgttttacatgttggtcattaattaaacatatgcacactcatacacactcacttaggaggagccaagcaaaacacatctgaagccaaacttggcctgtggtcttctactttgaaatgtcttttcacacacgtacctacgcagcaactgatactttagtacttgtatgctaggcgcttggctacaccttttgcactaataaaaatgtttaaccttcacaacaattctgtgaacaggtacttttatttccacttcagagatgaactttggataagtaacttgccaagatcacacaattagtaaaaggttctgcagttattcaaacccaagaaattgcgctgcagaactctgacacttaagcacttggcaaaattgatttcctggatatgtttcttctatatatgctctaagcacacacacaaaatgtaaataacactataaaggatgaagagaaattgtttactattagttcattcatgtacatatgtttgcatatgtgggcatgatgtgataaagcactgaaatgctataagctttcacattttacacagtttttctgataaagctcagtgagaccagtgtaaaaatttcacagggagtttatatttctccttgccacaaactagacatcctgagctttggggccaacgttgtctgtgtccaagggcaaaagttctctttcttctcattgtcatatttaaaccccacccatggaaatgctccaagtcctgagtgatgatcccttcctctgggcaagggtatgaagaataaaagtaaatctagcaggaggagtaaatcccagaagacagagataagtacttgaggtcagagactgcgtcttttatagtttgtctacataccaaactcattaatatgaataatcatcttagcagtactggttgtagtagcaaaagtaatacaagaaaccagtcttctcctatatttttacattagcattcattatttgtaggatttgggaggtctttttgagaaagtgatgtgaaactaagtctctcccacgtttttcctttagttccactttttcataccagcataaaatatttttcaaccttaaaaactgcagtctaggccaggcgtggtggcttacgcctgtaatcccagcactttgggaggctgaggcaggtggatcacaaggtcaggagattgagaccatcctggctaacatggtgaaaacccgtctctactaaaaatacaaaaaaaaattagccgggcgtggtggcaggcgcctgtagtcctagctactcgggaggctgaggtaggagaatggcgtgaacccgggaggcggagcttgcagtgagcagagatcgcgccactgcactccagcctgggtgacagagcgagactccgtctccaaacaaacaaacaaacaaacaaacaaactgcagtctgtaggaataaaagtataagatggtaggggaaaaaaaccgagaatagtgtgaacaaaatctatgtatttatccatttaggtttttcccctggggtattttggaataccctttgacaccataagcctctttatggtttactcacttggtatggaatgggggagaaaaaaggagccagtccatctggcagtattcctctcaacaccctatacccatcatgtgaatggaaagaaccccaaaccttcattttcagaactgtatctcagcctctggctcctgaagaaaaccagtgtggttcagatgtgggatgggaagagtggtttgcattggcatcagccctgcgggtgctttggggctggagcacacacagctgtgggttacagatgcttgctctccggtattaatgtggccaacatgtgaaaccatgacacccacaatactacacaaaggtccacgcctctgatagtttgagaaataactccgtctgaagaaattcctttttgaaggcctagaatacattctagaatggaaggtcctctttcagaggggtagaaccaggaaagagatgccttataatgttggacagagcacagggtgtctgtaggcttaggagctttaaccaaacatggggaaaaaaaaaagtaaaaagtctcctctaaaccttagattaataaattcgaaattctgtgctatgcatgtagcagaaagcttgtacactcaagtcatcgtgtagtttctttggagatgtcaaatgcaagccatcgttggtggttgtcatctggcctgactcagggtgtgttagaaatgtttccaccgatttttatttccctgagctgtctccaaggatggtagaaccagaggaatctatacacaagagaaaagaaatgagcatgggttcttggtaatttaataactaggactcttttcagggtgtggggattttgtcctttctcactcatgaggtccatgcttccttctgacagtacacttgagagagctgagatgtttccatcccccattcagttagtgagacagttttctcattcaggtacaatttccagtgaaatagtagcttataagtatccagaagttagtttattgactcttattgcacttctgagcacctaataaataatttattagtctgatggatatgtggctacctaactatggggcatgaaatatgcactgtttttctaatatactgtagggagacctgtttataaagtatttagtattggttttataatgcactgttgacaacaggagaccacgaagctcaaagatcaatctcattttggcccacagtattaatgctgctttataaagctctatgacaggtcacttagacagtggtcttcacagaaaggactctgttaggaaagcaggctgtaggggctgctagtatagtagatgaatgtctttgtctgtgtccctaaggtgactctggcggttgctgatgttggccaggtgatggaacccatcatttccctgctctccagagggattctggactagaagtgctgagttctgctaatgcagaccttgctaattgggcagaaagctggtgtgactttggaccacaattgcagttctggagacagaaatcaggcaataaggagtggaacttggctctcttcagctttgtcttatgtttattaatgaagtgaaattattccacatcttttatgcctttgttcaaatcacataggtgacatagcataaagtattttgatttttgttggctttggggaatttcctagccagaaataaattcatagacattagaccactacatactaaacacttcgaatttgggaaaacctaaacaaagactaagtaatttcatccaaaatcaattctcagtgttttactttattttcttcataagaactatacactatgagaatgctgcataatgacaatgatttatatcatactattgcccatcaaggtatacgtgttgttgtcttttttttttttttttttttttgagatggagcctcactttgtcacccaggctgcagtgcagtggcgtgatctcagctcactgcaacctccacctcctgagttcaagcgattctcgtgcctcagcctcccaagtagctggaactacaggcgtgtaccaccacacctggctgatttttgtattttcagtagagacggggtttcaccacgttggccaggctggtcttgaactcctgacctcaggtgatccacctgccttgtcctcccaaagtgttgggattacaggcgtgagccaccgcacctgtcatggtgcatgttttagagcaaggtatttttctctttgtgtccagaactccttgctggttctaagtatttcacttcccaaactgggaactctgagctatactttcttggacccagtcagcttgtttattatttctcacgcttttgtgggaaccaggctgagttctactatttgccatttctgttactcatttcttactgattcagagtttcattttttttttttgaaatggagtttcgctgttgttgcccaggctggagtgcagtggcgtgatctcggctcaccgcaacctccacctcccaggttcaagtgattctcctgcctcagcctcctgagtagttggtattacaggcatgcaccaccatacctggctaattttgtatttttagtagaaacggggtttctccatgttggtcaggctggtctcgaactcctgacctcaggtgatccgcccacctcggcttcccaaagtgctgggattatagcagagtttcattttaccctttccagttggacccaatgttttcttccttctagtactcctcgattccttcctatcatgtctcccttagcagatagccccatctttaactttcctcagatgattattttgttcatgtagctgttatttattgagcaccctgttagaccctgaattaggaaagataaattctgtctcttttaagaagtgtacagtttagtggaaaaaattggtaataaattggttttctaacatgagcagttttaatatatgtatttcttaaccacagattttttttctgtatctcttacctttggtttctgagggaaaaaaagggtttcttttttctccctccaggggcacccttttcatttgtgctcttgatcatattctctcctcggaccctttcataccattttccctctggcttagatcttcaatatcgttttctctcttggcttcatcccctttgcctgtgatagtctcttttttccctgtagtgaaaaacaaactgccaacttatgaacacaacctgtctgagctcctctaacttttcagaccacgtttctcttacttgttttctttgcagaatttctccaaagaatgttttatcttttctgcttctttgtcttcacaatttgcttacttcttaactcctctgcaatatggattctgtatacctatcagtctacaaagacattcactcttatgacacaaagcctaataaaatattttagccacaaatatacatgaatgttatgttgaacactcattgacccgagtttaggaactaataatgtacaaacacatctgaagactagagttaccatttaaattatactgtgtcagtcactgtcaatctccctatctgcctttccccattttccatccttaagcactattctgattttggtatttattattcccatgccttttggtttgctcttactgtatttgcttctacttactatttcacttggttttaaccataccctaaatataagtcttgttgttctagatcatttaaaactctcaagcatcctatcttctgtcaactgttttcccttatcaggtggaacgttggacaatcacgatgctcctgttaacgctgttccttctgtcttttcccctaataaccatggatatcccctgagatactaaccttggccacttgttttatctcttgtttcaggtctgtgtagatggctgctggatgtgataacttcagtatcagtctgttttctaacatttccagttgcctggttatctgcatgatctgctgttccccccatactaaacttgctatatattctcacaaactagttcatccccctttctgttgataatgctaccattttcctgtgctcagactattagaactttagtgtcattgttgacacttctcatttgttacagtcattctggtccccttgattttatcttcacagtatcttctgtatcttgtccttttttttttctccagccgtattgccagtaatttacccagattattgactgattgattgagatggagttttgctcttgttgcccagggtggagtgcaatggcacaatctccgctcactgcaacctctgcctcttgggttcaagtgattcctctgcctcagcttcccaagtagctgggactacaggcatgcaccactacacctggctaacttcttttgtatttttagtagagacggggtttcaccattttggccaggatggtctcgaactcctgactttaggttatctgcccgcctcggctttccacagttttgggattagaggcgtgagccaccatgcccggcctattttaatgtcttcctaattggaccctgcttttgtcttttcacacttcagtccatctgtcatactgttgccagataaatcttcttggagcaaaataatgatcagacgttactgctgttgagaagcttttggtagtttggactgttggtagataacaggctaaatagcaactctttgtagtggagtatagggcccttacttttataatagttcctatcaaccactgcatccatttcattgatggttcttctatgtacatcttcccttatgttccagtcaaactgtattacttctctaggaatataatctacgctcagtgtgagagtgcctcggtgtagaagcttttttttttttctaaaccatactggctggaagggatctctaagttgtatggaattctgctcttgtttcttttcctattctgtttttgttaaggttgttttgttcatagcttatctcctgtactagattgtaaacttgtgagcaaggagtatgtcttaacttttgtgttctccacagcttcttatacttggcaagggagcggggcggggggctggggcgggaggatgggggtgggggtgattagtattccctaacagcagttaaaagtgtcatattaagtggaagaaaagggagtaagaaattgagctaggcagggcaaaagtgtatccattatcaatcagcaaattattcagttattcccactttgttactttagttctcaccaaagtttatttagctgttggctactatcagccttagaaactattaactcttaaaaaatgtgtttagttggtcattggtgtgttatatttgcaatttcttaaagttttgatgtactcaatgcttttaagtaatactgtctgggcatatgtaatttcctttcccaatctctcaataggcacaccttgggcccaccccacctccacatagccttaattacaaatcagaggacaggcttagtgagcaagactggccagcatatttcaaggtcccatgttgtggggttgatacatctcaaattgaggtatgttggttttttttttccccctttaagttacttggacacacttgcattctttgattacctagttaagatatatctctcacctcttctttctgccactcttttactgtctttcatacttatcctcattctatgaaactcaggtatttatttgcttcctaacacttcttgcctctgaagaaataattgaaagtagatttaatgatggttatttgaatgattttgaacgtgataaagtatctgccttctattgtttctctccctgcacttacttctcttttcctttttctattctttctttcctattgttctagggctagtttattgttatcactatttttaataataatactatattaatagtgttagtagtaaacttttaaaactgaagtttaacatacttacagaaaagtgcacaaataaaagtgtatagcctgataaattttacacactgaatatacccaggaccaccaactagatggagatacataacactacctgaaccccaaaagtgtcccttagcccagccactattctccatcaaagccaatcactatgcagatcttctaagggacctgttaagtcttcgtatttttaacttgccattaataggtttctggcatcttttgggtttcttcatttggaaaacaatctctaagttcatgaacatttgctctgtttcaacatttttcgatttaaatatgtatgtatataaatagtctctatcaaggccagtagattgcttgagagtaggagttcccagacttgcctgggcaacatagcgagaccccatctttaaaaaaaaaaaaaagccaggcacggtggctcacgcctgtaatcccagcactttgggaggctgaggtgggtggatcacgaggtcaggaaatcgagatcattctggctaacatggtgaaacctcgtctctactaaaaatacaaaaaattagccgggcgtggtggcgggcgcctgtagtcccagctactcgggaggctgaggcaggagaatggtgtgagcttgggaggcggagcttgcagtaagccaagattgcgccactgcactccagcctgggcaacagagcgagactgtctcaaaaaaagaaaaaaaaaaaaaaaaaaaaaaaaggccaggtgtggtggctgaggtgggagggttgcttgaggccaggagtttgaggttccagtgagctatgattgtgcactgcactctagcctgggcgatagagcaagatcctagctcttaaaaaataataggccgagctgggcatggtggctctcgcctgtaatcccagcactttgggaggctgaggcaggtggatctcctgaggttgggagttcgagaccagtctgaccaacatggagaaaccctgtctctactaaaaatacaaaattagccgggcatggaggtgcatgcctgtaatcccagctactcgggaggctggggcagtagaattgcttgaatctgggaggcggagattgcggtgagccgagatggtgccgttgcactccagcctgcacaacaagagtgaaagagctaggcaggccaaaagtgtatccattatccatctcagaaagaaaaaaaaaacaataggtcgggcccagtggctcatacctgtaatcccagcactttgggaggccgagagaggcggatcacaaggtcaggagttcgagaccagcctgaccaacatgttgaaaccccgtctctactaaaaataaaaaaattacccaggcatggtggtgtgcacctgtaatctcagctactgaggaggctgaggtagaagaatcgcttgaacctgggaggcggagattgcagtgagccaagattgcaccactgcactccagcctgggtgacagagcaagactctgtctcaaaaaaaaaaaaaagaaataatcataataataaacaataataataataaatagtctctgtttctataaaaatttttgaaactttaagtatactgggattttattttttaagtttatttgttaggtttgtaaattgcatatgaaggagtatcatttttagtgttgctttttcctgtgataattctaaaggcagtgttgagtttctcaataattttgtaaggtactgaactctgccttgcaatatggttttcttttttctttctttcctttttttttttttggaaacagagtggagtgcagtggcgcgatcttgggtcactgcaacctctgcctcccaggttcaagtgattctcctgcctcagcttcccgagtagctgggattacaggcatgcgccaccatgcccggctaagttttgtatttttagtagagatgggattttgccatgttggccatactggtcttaaactcctgtcctcaagtgatccacccgccttggcctcccaaagtgctgggattacaggtgtgagccaccgcacctggcctgcaacatgattttcttggatgttggtgaatctcaatcttcttttctgacagtaatttaaaccattattatgacacctttactgaggctgcaagcttcttggtccacagactttagaaggaagtaaataaagaaattaacattatcttggctgggcatggtggctcacccctgtaatcccagcactttgggaggcaaggcgggcagatcaattgaggccaggagttcaagaccagcctggcctggtcagggtttggtgaaaccccctctctaccaaaaaatacaaaaattagccgggggtgatggcacacgcctgtaatcccagctactcggtaggctgaggcaggagaattgcttgaacccaggaggtggagcttgcagtaacccgagatcacggcactgcactccagcctagaagacagagtgagatcctgtctcaaaacaaaaacaaaaaacaaagaaattaacattacctttataattcttgcaactttcatgttcatgttaatttcccgttgtgtgcgcccccagcctgtttttttttttttttttttttaaattcatttaagtaaagccatcactggttctttccttctagattttctcataaaacattgaatataggtttggtataaagaagccactgttactgtttggacttgagagaagattaataaagtcacttttctttttttaaaccaaaacaaggtaggtaaaatgtttgaccttttgtaggcacaagattcatgctgacctcagctgcttttattatctgcaaatatcttgagtctaaggattcatcatttccctaacattttgtaaactacctcatctaccataccctactcaaatccttttattttaaaatttttgtagtgcatcaagggattatggcttttggatatttccttgatgtgtttctatgaaactgagcccctgattaggctgtcagcagatactgtattacattgattgttttagttggtacagacacacgtgtcagctagagcagtttctcccttttgctgagaagggtgaagcttttagataatatttagttatggaggatgtttgtgccactgtttaaagtgatttgaccctgtgtcctcctccaaccttaagttagaaggcctattttcctctattggtctaagggcatgtaatgaagtcttcagcacacaagctttctccctccctgtaggtgagtggttattattttttcttttgtcacgggcttggatatcatgttcttatgtgtaaacactggaccatatagtactcacaatactttggcaaaaaccaaactaactgaaaactgaaggcatgcctttatgtcttatttccaacttggaccatgatcttgccccttgaaatcttcaggctgttttgatgaagccttctgtatgttgaaatgcccagtcaaggtggccagaaccatctggagaaggtagagttgtaaatatgaagtgacatgtataattctaatggactcttataatgagaggggccagtgattgaggctggcaatcagagatgacacaagctttttccttcctatttgaatctgtaaagacccttaagagcactttgaatttgttcatctataagctgttaacccaaattcatgtcccaggtttttaagagaataagcaatagaatataggcgtttccaaagaggaagacgtacagaagcagataggtgtatagttcattcattcacagataggcactaggttagatccagtagttggcgtgcatgcatcaacatgttaatcggaattaaaggctgctacatttaggcttggctagatcatctataaattgaaacccaaaagagaattgttaactaggaaagtagctgtccaggttccttaaagtttaaatacagggatccaactagtattctccaaaatttttcaggaatatcagactttactgctgtggaacacttggctgttgtaagaggagtgtttcatctctcataaggatgtaatgaaaggaaattaggagccagtgggagagtgcagggacttaggtgtaaatcataggtgaatctttttttttttttcagatggagtttccctctttttgcccaggctggagtgcagtggcgtgatctcggctcactgcaacttccacctcccaagttcaagcgattcttttgcctcagcctcctgagtagctgggattaccagtgcctgccaccatgcctggctaatgataggtgaatcttaattgtgaagatgagtacctttatgagtagagatggcttcatatcagaactttatcttacaagctactctttactcttcctctttctccccgctccatgccaacagagttaatgtaagcatagtagagtaatatttcatctttgtgtgtgtagttttcttttttttttgggcgggaggaggtgaactttttactgtctttccatctatttacatatgtgagtccagggaaaacaggcagcttaaattatgatataattttttacaaagggaaaacctgaattgaaattattgttttacttcttttctattcatttctttacagtgagtcaaaaattttttccccttaacttcacatagaaaatgaaactttacacaataaagtaaggatggcaggtttcacaagggaaaaagcttgctgtcaacttctttcctcaggaatatggaaatttgggtggattatcttttcagaagaggtttcctttattacttcttttttcacttaagacatctgttaacatttcacacagcccaacagatgttggagagcaagtcccatactttgttctcaagaaaaatgacatttccttagttggttcccccacttctgtgactgagtccagcctgctgcataatttgcatatattaagttatataccttaatgccatatgaatttgtatcttcagcattatttttacatggtaaagtctggtttgattagaaactagtttacatgttgctgtagaattaagagagggcaaaacattttaaaactctacttcgagaatggcaacctgagtccacatataagattggatagccagtttttaacatttttttctataaaataaatgaattacaaaagcttgagttgtttcgccataaggaagtgctgattgtcatgcgatgtggagcgtcatttttattattttggcaagaacagggacagttttgtcttgacaagccattagatgaataccagcgtgtgtcacatgaaaaaccactgatctttaacccagctctgtacttaaccaagccttgaaaatgaatagtgaataaaagaagagcaaaggcagagcacattacagattatagaatctgttaacagttgctgaactcaacccagggaattacaggtattgttctgtgaaccagcagaagttctagagatgcttgttaaattgtatacaaaaactacacatttattttatatttgtgcaggatttacattgttggagacagaaaaaataaaaatcctagagtactttctcagtgcagtaaatgtatgctttcatcataaaatcatatatatttacatagaactcaatgaggtttttttgcctgcagttacataacttattttatgaaagcaatgtgcttttaaagaaattaagtagaaagaagaaaacataggttatatccccttcccctcaaagaaaacaccctacaaacatacatgcaaaacaaaattctttgctcacttgcgttttcatgtattcattgtggctgattttttacaccaacataggttttttcttttttgtttctttttcttttttttttgcaggaaatggagggaaaaacccaaaacccaccgtaatactcaagtactgaaaagatcagtaacattttaaacggttgtgggaattattgcttacagagctaacaagaaagaacacacttttttactctgctggtggaattgcattgtgcctccctatagtcttgttatcccacactaactgaaatgcaaattttttgtaactaattggatctcattgagggtacatgcacagtgtgtagttatatgcaaaaaggttttaaaaagtaaaattttcctgcaattacaacttttaattactatccaaaacatggtacctatagcacaggtttagaatatatatgtctgacttttttacagattactcaaaaacatgagctatgaaatgcttaataaggtgtcagctcgaaagttacagggaaaatgtttaattacagcagtctataaattgaattttactatagttatgtgaaaataaagatttctttttaagttcaggatttagtgtattagagccagtatatgaaaggcatgttatagtgcattccttttcttggaagattttaaacgttaaaacatcatcaacatcagaagtcactttcagagccattgcctttttttccccttcagttctccaatctattttaccattgtaaaatgcttttgagtttcttactttgtgtaagtatatttctacttatgtggtgtggtgtgggggaagtattcacattcacacaatgtctttaacttggatgcagtgaaacctagtttggtggacttcataatttccatggtccatctctcactatcagtaaatgtgggaaagccaacagatggcctttaagtacttctgattctttaacctgaaatactcagaatcagcagcaaaaagcaattattgtggaagtgatacttgtcttcttccttctagttttaaataattttcatataaatgattccagagagttattccataattgtcagactatgtagccagtgaaaaaaactcagaagacatatttgtgccttgtaggtgtatttttttgtacctgtgtctgtaaaacgatacagatgtcccacttgctagatagaaattatcctaatgtcaaatgttctacacagtatgttatatgtggaagttcagatcatgtatcttggggatttatagagggattaaatgttcttttcaaatatttattttaaaatgagtgttagagaaacttaaaatcttatttattattgagtctggattaattgttgtctctttttgtaacagagcttgtcctctttgtaaatttgtgttacaaagtagttaagattttgtttgagcaaatccatttagcaggtgcagtactgtatatttatgaaaaaatattttttaaaacttagaaagatatcctgctgcttttaaggctcgtgttgtggcagtaacatgttatattgcagacgtgtttcagccagggccacctcagtccatgatatctgaaggagctcagtttgcctatactgggtagcattttgtcagaagactgctggctgggcagactagatttggatgtattagctagtcagcctaataaccctgtacagactgtattgattttctaggagagagtttatgaactaaataaacttggggttggtgtcttaataaactgcttctctcagtctgtcacatttagttacggagctgtgcagtttagggggaaaaaaggctaattctgttacagattgttcacagcagggtctccaaattagccctttgttttgtaatgccaccttgcttgggcttgctttgagcacatttctcagttttgccctaatgagttgcaacactgataatgtggctgatgatctttcattgatttcactatcacttgcttgtctggtaattgatccgttgctgagcctctagttaattatatcggctttgacatggcccggtccacggggaatttcaagtcttgcagaataacagttttaataaaagagtctattactgcaggtgcttgctgctgcatgccagttgatttttgtgttgttagtgtgtgtgtggggtgttgggtaggatacctgggaaagaagaggactgcaggactgagaaaaaacggggtgggggctagaaaaagaggaagagggagtgaaggagggggagaaagagacaaggagagggcgagtgagaggcgagagagaacacaggcaaaaacacacaggcaaagcgatacaacagagcctgagtggaaggaggaggaagcttgctattgacagtgtccttaagcctcccacaaataacagccattagtgggaaggtcaggagctgagcaggcagcttgactgaggcactgagtgccacttcagaaatcaagaggctagcaaattttagagggagtttaagtgggtaatagctagcactaaaggtacagtcactgttgacaattgactcgtaggggattttcctgccctcccccccagcaagaatatttttattgaccacaggtggacttaatatattttaaggcaacaattctttgggttcttgtttgtttcctctcagatattgaatttgcttcttttgagacttttttgtgcttaatggtggggaactggagggaagtttaacagaaaagctttcaggagatgtcggttctagaggggaaggcacatttgtgtcaacatagtgtacgttttctcatcttttctcattgtccactaatgacacagagctgccattgaagctcttttctgtttcttttgttgtttcagagagtaaggtttattgttattcttgagttaagaaggaacaaggagagtggtacatttgtcctcgatatttgtaggtggttgaagattaatgttccttacatgttaagtttaggaaggatggctttttcctgctgactacttttatgagatggcatgaatttagctttccattttgaacttactgtttatgtacagtgcattttgttcagtgctgcttttccataaataaggcagacaaatactatctaataaataggtgaatagttttaagacttgtttaattaaaaatacgacatgttatcaagggtgtatttcatcaggcaggaaaacgttatagaattttccacagagatcttgaataaaaaatggagtttttatattcattactttttgcctgaaatgggacaggctttttttgtttatctttttcttttcttaacgatttgaaaggatattgcagatgcttcatctaggaactttaacaaaggatttttttctacttctgagctttaagaaaaggtatacttttttcctttgccattcagtttctcattagctaacatccagtttagtaattaatagcctgaggtactagatattaaatagtatatatttatatttggcaaatgtttattgtgcatcttctatgttataaaaactgctaggcttatttgcttactctttagagtataaggtcacatctctatgtacgttatttaggagtttctatgtggttataaatagcccagcacatacgagatgactttcaggagctaacatttagaccataactgagccaactttacattctcttacagctgaatattttactttcttcagtgtaattaaaaaaaaatttaagtatcacagttttacaaatgttaaagccaaagactggtgtcagatattatgtgttatatcagaaagcattgttgagaaaaattcccggggaagggccctagcttccccttgccctgtgcaccgtgattgtggtgctgcctggagtgtgcataagtgtgtatctatctgtatatctggagaggggttagtgcagggtgtcatttggtgcctgacagtggaacagtgcagttgactcttagctctgctatccaatgacatgcagtggctgagagtttgaagctgatggttgggtctccagtgccgcctgcacacctgacaggcagctgttaaactgagcaaaggcaagcttggggagtcacaatctatgcataaatgatagggatatctgtgcagaaggtgcgaaagaagctctgaccccctccctcccccaaatctcccccttcccaaatgaaatgcacagttcagccagcttcttaactacactacactcctgctactggctgccaagaggctcaaaaaatccaccttcacttttcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggtaagttactttctttcttgattttttttttcttttttttaagaaaccttgaattgttatgggcacttttgtttctggtgtttttctttctaaatactttttaaaatgtggtcacttcctagttaggctcttgttttgtcataactgtgttactggaatgtgcagggttacttcatggtttccctaagggcgtcttaaaagaaaaaggggaaaggataccgaagtaaaagaaagcagagacattgttgaaaagtttcacagtacaatctgggtcaggggaagacttaatttatttctttgttttctgttgagaatgaaaaaagccacctcccaacaaatgtatctatcaatatgaatcacttcgtccaaagtgtttgctctctcggagtaggttccgcaacctaaaaaacagtcatcaaatctcggggcccctcagaacagccctactgacttcatgtggctggaggcagcttcgttcagacctgagaagagagacgaggctgtgcaggcttggctgccagcgccgagggttgctggaggagtcggcgtgcgtggcgggctgtgctgctcggtcctcgctcctccgctccgctcctccttgccagccagccctctgcgcccgcccctgcattcccttcgccggctccggcccgctctcccgcccgcccgccggcccgccggcgcactcactcgggcgcagcctcggcgtcttccccagagccgctcctccgtcccggccgcgctggaggcgttcggcttgctggctctgctgggaaagccgacgtggtagcgcgaggccatcggttactgataattaatcaccggagccggcggctcgtaccatgcgctccgtgatacgcgccctgtgcgccggtctcctcttgcacaattgctggctccttggctccgcgggggagcgagggtgagaggaagcgaaggggacacaacccagaaactttcatcttggattgtgctcaagtgagggagggaagttccctggtgcctccctcctagacacgtcttgcttttccaaagcctacaccaaacccacacaaagcaagttagtttgatattatcatccacacacaaagcaagttagtttgatattatcatccacacagcacgaaagtactattgacaaatatacttggattttaagttgacggcggttattaagaaatgttgtgccactcaagaggaaaaaaatactgcaactgctttttttttttttttttttaaaaagcttttgtttgtaagagttcacgaaaattaaatactttgagttagatatttaaagttgttgataataaaaaaaaaacaatttgccaggctataaactactacaagtttagaaatacatttgcaagcgataatacctacaaccagggttttgtagcatttagctagagaacagttttagcacacaattctaaataggataaatgcatttgaataaggtatattttgacatatcctgtagagggaccctgattactgctgatacagtaagctgggatttaaatgcaatcaacatcaacccaataagtaactcttcatgtgcaatttcccattctttcaagtgaaaagttcatttccacacagagatgctccttgtcactgcagagcgctgtgagaggtgttttccgcgacgcatccctgcctgggtggctctcgcgtgttggaatgcagtgttttcgctaaccttagtaccaaataacttgtgcttcacttttaaaactagatgtcaccttcagggttttccttgagttagtggaggtcgtgtgtgtgtgtgtgcgtgtgtgtgtgtgtgttagaagggaagattggcttacgtctccctctagctagaaaagagttaataaaaccagatagagataatgatcaattgataaatggctattgaaccacatagatggtgttagattgcttatttggcactagcccatttccaagtagatttgaatctaaggagattttgtcatggaaaacattttaactaaaaaacaaataaagtaatataaatgatgggtcagaattaggacaatttatgatgtctttgatccagctgtctgactgtgtggatattttgtgtgtacctgtgtgtgcatatatgtgtaatggtgagcatcagtgattatatggagagaatagaaatatagggaactaatttatgcttaatggatgctattaaaactgtataatattatgctatttatgaaatagagtagtacaacaaaaggagagaaatcacagttttaaatatgttttcttttttttttggttttgatgtagttagcaatcactcctatccccccaacccacctttttctgtcatggtcactgaatgtttacctcttgtgcatttttggaaagcatgtaaaagaggatatgagcttgcattttttttctcttcaagatgacattttagtttgtataaatattacataacttaagttcaaactatgtgagtgaaagtatgtgtgctgttcatatttaatatgtttgtttttcttacctgtagttcatcagcaatgctgattcagcacgtgtgtgtgtgtgtgtgtgtgtgtgtgtgtgtgagagagagagacttattgaaattatatctctgatatctcttgaagccagccatttaaacgagtattactttcaatatatacagttacgctagtttttgttacaggtaaaagtttgtccagtttaatcaaatatgtagaattctgtacatctcattgctgaggcataaagaggtttctctagattatgattattttatttctaagtaaaatttacttagcttatgaaatgaataaaatttattgggttattttttttaaagttttctttaatagtataaaaactaatattttcctgattatttatttagacgtttgaaaactctgactagtagggctgctataaaaggtttcaaaactgagttacagataatttaccatcagtatttaactatagagaaaattgtgggaaatgtccatgaatactgaaatttaataatctagttttatgtgttctattagtaaactaggaagtagggatacaaaaatctttgtcttttgtttcatatgagcaaagttggatctgcttaaatgtacatctttcattctgtctaatagtaacaaataatcacaatctgaagccaatttagatttagtgggatgaagtatgtgcccctaaagttcaagtgaagtctatttgactacattttcctgtgcctgtacattttttcttctatactcaagtatgattttctcaaattatttctatgtatatagctgagtatttgagaacattaaagggtatgacacttgtgtaaagggagttcttctttggatcagtttgatcagtgacaggtggagaaagaaccttattttgcctattttagtttcacaaggtactgttaaaagcaaaaaatgaggcttgcttttcaaagttttttttttaatcacacttgaggaggcaattcttctatttgtataaatattttgtgcatttgagagaatagtaaataaaattcttgtagctatctcaagggatgtaatagtccagtctatttaaaaatctttttagaaaggaaaccataaaggtatatagctatagcccacatttaatgtgttactagagacatttaccttttattattggtgaggtatatttaacctgtttcaaataaaatgtagatcccttaataaggtcttttttcatacttgagtgaaatactaagttaggattataaatgactctctgcatcattatgtagtaatttaggattcacccgatgatgtaacaaaattaacaacataatttcattgtgaaactgtgtcttattaaagaacaactgtctgacattctcttacagttgctttatttaacttcatgcaaatattattagtagtgacatttttctattgtgcattagattctctcattagcatgatgtgttagttatcaccagagaaatcattttttagataggtgaggggcaaaccaagaaagctaaaaattaaatcaacgatttacattaataccagagcgtctgctcaccagagatatgacagagtaaaagcaaactttcttactaatataaaaatctagcacctttcagagaaatgataaataaaatataagaaatgtataataacattgctagaatccatttaaaacagtgctcaatatgaattttcctcaagaaatcttttttttctattcatataggccaacaatctcagtttctggaatctatatttttaaatgaaaatgtttttgtccccccccccaatttttttgagtatttattcactagtcatttaaaaggcatatatatatatagtattacaagtcagacgcctagttgtacattgtggtttgggtcttctttatagttcatacaacgcatttttattctaaactctgtcccactcaaatagacatccctttttacataggatgtatattcttatttaatcaaagccctgagtaaagcagctgatagttaatggtctttgaaaacgactttcattgccaggcatcatccatccctagcttgctttctgcagttttctccattttttactcccttccttacagttagtatgtttggatgatcttgtcttactaaaaaaggattaaattgactaaacttgtggtcttaatgctaaaataaatatttatattaagaggcatgcagttttagcctgttgaattactaggctacgacctccaatttaggcccctcttaatttgagtggtaatatgttttatttttaacaatagacatatattcaaatataattctcagtatattgtctgataatgtaacactaaagtaggaatatttgggtatttgtatttgttaagatacaaattgtagcatagagacaggtgcttggtttgtcctaaactttgaaggtctatggataacatgcagacttcacataagagataccgtctcatttgtaatgcagtgggaaagtaacagtttatatatatggtattctatgtacatgtaaacgttaacgcaagtaaagcatgcacaaacatattctcaggtgtgtattttgtatatgttaaaaatctgtgcacaaatttggagtttattttcaacatgattcatttaaatgaatttgaacacagtaggtgatcgttttgaaattatttaattttctcacctttctgtcatctgcaaacaggtctattatgtttgtgtaatttgtaaagccttttgctaaggtgagccaagtaactgcagttgaaaaataaatccctctaaggtgcagatatcttatctataattgtaggtattttttataattatatttatgagtgtatattcacattcactgataaatccaattattcatgcatagctttatggaaatctgattaatgcagtgacaggacagatttgggctgccacagcagcacatcctcccactcccatgtcagggttaagagccacggcaaatcctccctgactaattagatgctgagtaaggcatctctgagaagttggggcagaagtgaatgggtcacaaccaaggcaggattgcaaggactccagtgatagtgaaagcattcaagtttgccaggtcgttgtgacacagggagctgattccaaaggaacagtccgttacagatagtgagctggcgtcatccacttgaatgaaaaacacaaattctggtgcctccctctctctaccttgtatgcattacacacactcacttaaaaaaagttgcattgggcatctgccgtcatctgtctgcaaagcttttgagaggattttccttgtaaacgtgaatagctaatgattctgtatagcccaagaggtattttctgaacttggcactctagattagcacatatatcaaaaggaaagaggaaaagaaattggaatttgtttttagcttgtgtctataatttgaaccttagtgtttgaatcgatctaggaattaactcctttttccccccagagtgctgtcagagaactttgtggttgtagagaaaacagagtgaatcgggtaggttgactttttcagtgagagaaattttctgtgggattccctgcttgttattgtccaaagaacatggaatataatgttccaagatttcctttcacggtaggtttggagcctggtttgttatgcgtgtagaaataattcgccatttgaaaatcctcttgtacctttggtggtacgcttttgtggtctgtttatggtgctgctcagtgaccacccttctccagaccttggtcagaagattgtttgggggtcctaggaagtgatggatctcactactgtctgccaaagctgatgccattttttatttccagaaaagcagctggcttctacattttgctgggcgatcttcatctactgtaaggaccctggagacaggagaaagggagtcaaagaccctttcaagaaactgacatctatttttaagctttagagaaacaaaggaaaagagacataattcaggaacaacagcctttatatcctcacatagaaacaaaacattgggtaatagagggaatgttttcctataagaaaaactggtaaagatgcaggaaaaataagatgaaaaaaatctgctaagcagctcaaggtctaagaagttttaaaatgtgcagatggcatcccagaaatgatgtctggggccatgacatccagggtccccacatttcctcctcattgagcctgacctgtactgccatctttctccccaggtttaaagaaagtttaacgaataggaaaaataaaagtattgattattttttaatttgtgcgttccctgtaggaagcctcgcagatttcacagtgtacattcaaaccctcaggtgaaaaatttatgactggagttcatttgggtggagacagtgtgcagtgtcattctgttcaaatgctgtatgtagcatttcatgccacgaagtgcagagatcaggagaagagaggaatcgctgtatgttttcttcattcatagagctttctttaatggaaatgcttgtggaaaaacaacacattactcaaattggctagtttaggaaccaaattctcaacttattaatcatcattccgattaaaaaaaagaattgatcctttaacaacaaaataatatccttttgtttttctttaattaagcccatcagtttttcatttctctctgtaaagaaaatgaaaataatcttgaacagtaggaagttactcattgaaacaactgattctcttgagcatatctgacgtcttatttactcaatgcttttgaactgtaatgttatttcgctactgtctttagggtttatgtgtcattgagtggtgttgatttataaatctcattcatatttggttggcagaaatttacttaatgacctaaatacaaggttattctgttcctatttcctttctcatagaggtaatttctttctcactttattctcttttcttctcatctctctcattctgaattcctccttactttcactggccctttttgccttaatagaagagaattgaaatgcacctgaaacgtagcagtaattgaataaatacccttttgccaatacatcattctggcagaggcatgagagagaggtgccaccctcaggtgtggtcctctgtgagtgctgacaggactgtctcgagtgttgctgtagaagggttctttgagtaagggcatgataaaaacgtgtaaccaggggccctggcttatcattcagaggtgctgaaaggcagctcaatttgatccttagcctgtataagaaagtacttagttgaagagagattttgctttccttttttcttcttttaaaaacctaattcttggacttattattttgtgcagttagacttctacacgagcttatttccctacaagaaggaaaagataccaagggcagtgcagtaggttgaagggatgattctttcagacaaactgcagctagtaagagttaacagaaacatttaaaaaaggacttgaaatgatggtaggaccagtattaatggatggtattatgaaattaaaatttaaagcatgcagtatacataacacatgaggaggattcactcttgttttgtatttaataaattttaacccattgtctcacaaggcatacagattgttaaaattgacaagactgaaacatattctgtatgggaaagacatagctttcaatattgttacctgctgtgcttttttgagactgtcatgaatttttcaactttattaaggtgtcttttagtggctattggttctctagacagttcttcagaactcacattttatgatcggagtacctgaactgggtgtctgaaaaggaagataacaggttagtgaacgttttacatgacaacaagtaattgctttcagctggcttaaaataataacaaaactaatattaaaatgagaatctccattagaggattttaataatttttttccctttccattaacatttaaatcaagaagaatttcattgatttaaatcattagggtggctatttgggacacctgatcaggcatagattaagaaagctgcccactactgcgccctctgccagtgctggaggtcagtggacatggctgggatgtcaccggcaagatatggggagtaattatacactgagcatattcatgagagtgtccctgagtgagaatgcctgcaaacattctcattgttgacctcatgccagaacctaacttggagtcagcgagttagctgctgtttaatattgcttttcttttattctttcttttttaggtataaatattagagtaccagaaagaaccaaaaccaaagtctggctgtaaactttgtggaaggacttactgtcttgaaagtactaaaaatcccatattgccacattatggtagtgcatttatatgtaatgcgtagacatgcagaaagtgtatgcctgctccattggttggctggtgacaattaggtgacttaattctatgtatgttgaggatttgctaatgacttcctcagaggcagtgagcctgtgggtggctttccccaaagaggcattctccatcctaagaatcttgttgtaattattccttatactatgctatctatatagcctttttcctttcttgactatagctttttggtgaaactcagtgtcattcattggaaaatagcatgatggtttcttattttgtgaactgccattttcagcaagtgggagactacagcttacttcagataaattagaattgcgctaggatagagacaccaggatgagtctctctgactcaaatttcagatgtctcattatttccctttctagcaacttttgtttgttctcttggacaactttggaaagtaatcatgggactgaatggagcttaaaatatgttaccagtcctatcatgactaaatactcttcattgtggagaggagttttttcatttttactttatttttgtcatctattataatgtaagtaggaagggataagaagaattcaaactccaacatctgggagagcttgtttcagtagccagccgggcagccggaaagctggcctcatacaggtgagatgtgttatgggaataagggccttgtgcacttaatgaaccctgcctgcctgtcagcctggtttttcatgtaccattgttgttcaaataagaaaaagagagtgttcacagcctgtggtgagattagagtaatgaaaatgaagtgttaatctgttgataggaagcacatcccatatcctgcatcccgggccacattcatgcgtgtataatatattccaggttttctcatgaccagaaaagcttgggtgttcattatattgaaaacatccttttagtaaaagtgagaagttggttgttttaacttgtgtaaacagttattttaaataatttcttaataaaccaactgctgcttaccttctgagtattctgataatcactgttcctgtatgtgccagcagtcctgtacttttgatcttttaaattttttttacaactgcagaatgccgaaaatgagcttcaatataagcctactttgagatactcttttctcaaagtaggcttaatagagtgattaatagaaggagttaagtgacagtaatacttttctctccataaaacacagattaactaaaacatccattatctcacactttatttttcatcttaaaacaattaagtagaaacaaaaatttgtgaattgtgagtcttccagaactgctttacatatttgcagtcagctgccatgatgtgaacctgaggagaccagcttaaagctttggtcatcacatcatggtagggaattgtgtatttcataaaattctctttctaagatggtataaaaggcaaattaacatgaatgtaatgaagtatatactttccttagaatgtttgttttaatttttgttttttaaatgattttactcagtaattagttgagaaatttccattttttttccctaaagctatatacttaaaaaagaaagaaagtaagtttagtcttggattacaacaaggcattttaaagaaagtaatgtgaacactggttcagtgccctttatatgcaggtcatcctataagatcatatctttcagatgcatcgtaagaaatggtttgaagaaaagtgtgaaaggggtgcggagagataaattaacaactgagttccaggtgtctatttctaattgctcacatttcaatcataatggaaattaaggaaaaatgtttcccataagaaatacactgtcattcaggcctacctaagactgcctttatggagttcatgtttacggtattttctttttttctattcacctaggagttaaggaatgctacagtatgatcattatgattttgtgaactgtttacttaaagttgtgcaagttgctaagaatcaagagaatttggggattaaagtccgattgtgaagtaaatttggcatatgttcagggattacattctttaggtaaaaatggaagaaaaatgcttcctttcggaaggaaacaccttaaaaactaatctttcaagcatgtggtgcaatgatgaaacataatgtaaaaacactatagtatagttgatccaaattagttggcatatgactggtcatagcctacgtactacagtttgcatgatacgtaagcatttctgtactgtagtaatacgtcagagatagcctgtttttaatatagttggatgaaatgagaaggccgttgcttccctctgctaaatagggtatttttaattggtttttaaaatccattaataggtagaaatgctgtgtcgttgtgattgattgggaataatgaaatgtaaaagatattctccttgcaattgctttcatgtaaaaaaaaagtagatataaagaagtgcatggtgactgtgtcatagacatctgcttttaggtaataatcatttgtaaagaaatatgccatgactttttgggtcatttgaacccataataatgtctatttaatgtaagtataaatgtcagatggtggcatacatgtggagtcagtaaagatgaatatttgctgtgataatagtcatgcatcttaaatgttgacttttaaaatataccttgaagacatatcctattttcatattacagtacattttcacttaagtacatgatagctctagaaaggaagtgtggaagtgttaacatgtgaaggaacaaaatctgagtaatgctttgacatgagcatctattttgggcttcagagaaataggtggctgattgaaaaccaatgtaaagattgttgaaccactctgtaaggctgggtcatcagttctggatttactattttaaaaaacatttaattatgaaaatgagtttcctttggtttgcacgaatgtttcattgaaatgaaacttgcttcccattgtcttatattctgtaaacttgtgaaatatgtatttttaaatctctgttctgagaacaccctcttctttttttcccagaaactctagagtagtatgacattttaaggagtagtagttgtctaaaagggccatgtggaggtaacaaaaattaaaacaagtagagtgagtctagtgggaactgtggtggaccagaaagctcatgtctcaaccacagtgaggtagctgctccttggttccagccgattgttaccaggtgggaatgcacgcccagtttgccagatccactgctgctgctttataatgatgagccaaaaatccagatttttatgtgaaatctcctgattttgaaatcttggcaacctattcaaatattttaaaaactgtgtggtctaaacaaaactcatctgcaggctacattcagccctctggctgccagatagaaacctctgttttagataatattttaatggatgaagataatagtttcattgcatgtgatcattcatcttgggaattccccactgggatcaaccaaattcttcattttttcccctgtgattagaaaaaaagtttagtaaatatatttctggtgctgatagttttgatgtatagcttttctccttatgacccacatttaaagaaaaatcacctgtgtgggcaaaacaaaaaaatagtcaaataatttaaataaaggtagaagcataaggattttaaaataataaaagatttctgaattctgaaaataatcccatgatttgtgtaagtaattgatgtagatgaaaagccgaattcaactataaaaagcttttcgtctcaccttaaagcggtagattcttggccctgaatctttgtgggattgctataatttaccaagcaattgattatgatgtcacaaggaggagatggaccacaagggggaaaacttccccctactaattcatgcaaggccaatattttatacctgcttcaagaaaacattatttatattgtataagatgaggtttaaaatgcctgtctatattttttgaagggtctctttaaaagaaattatctattcataattgaaattctccaggcaaatcagttatcagcattttcaacagaacaggtaattaattggtttgaatttcaaattgaaggtcatcctgttattgattttcgtgggaaaaggaaacaagaacatcctgttaaaatgatctgcaaatggggcctaggtatatctaggctctttctagggtcttgtttaacagcatcactgaacagtgtcagaaaccaatcagaagggagccatttgtgttttaaacataacaagttgttggtttgcttccaaaacttcagagaagaactcaactggagaaaagaccagagattaacagtttgtgttagagtaagtcagatatttcaaatcaagtgctggtgcagcttgtaaggaaacatctataaatgtgtcagaatgatgctggtatgccatgttcaagaagttcagcatcaacacagctgtgacttaacgctttcagaaacctttcaactgggaattagataaagtatctttaatataaggggagggaagcactgaagtaaaagaggtagcgaataatggaggataaaagaatatacccctttagatgctgttaatttttataaaataacatttgtgctttgtgtttgctagatagttttattgttacatatgctaggctatttcaaagcattcatttctctcctctgccgtgtttaaactttttgagaatggtgtaatgtaaaggtaacacagacgaagtgggtggcagacattttgcctttctacagtaaaccgaaattagtatcattttggtggttgaggggagacaaggtgtggttctgtggcccaggctggagcacagtggtgagatctgggctcatggccagcatccacctctcccgcccaggcgcaagcagtcctcttacctcagtctctggagtacctggaatatagatacacgccaccatgcctaggtgatttttgtattttttgtagagatagggttttgccatattgcccaggctgggcttgaactcctgagctcaagcgatctgcccacctcagcctcccaaagtgctgggattagaagcatgagggcaccacgcccagccaaaattgagtaagtattttaattttagctgcactaactaggttggaaacttaatgcagcttcttatggttcaaagtaaaattcttaataaaaaaaaagggcgggggaaagccttccattctaaataccctggagctgttagtgcagttatttctaagttgacatacttttgtataggcatgacagtggcaccaaccatctacattaagccttaacattccacagagccatttcaagtttattatgagcttcaaagcctgcacatccctaagagaatatcaagtttaagcatgtcactttgccatagtcacagttaactttcttaaaaaaaaaaaaaaaaaaaaaaagtgccttttcctaggctggttttctacaggttatccttgaaaaatttcccagttcagtacagtcatttttcttacccgttgtttctgcccccttgagttctgtagatttatcctgttggtgatggttggaaactacctccaaataaaagtagtattggtcacaatttgttgaaaggtctatgactatgtaagtatccctttgcagctttattcctagggctcaagacattgatcccattttacccatttccatttgggtttccattgcagtccttaaaaaaaagtgtagctggggagaaaaggaacatgtaaaactgtaaaattgctaatgctgtcctagtacatgacaatttcccaccatggaatgctccatggggaggacgatgggcctgctcagcctgatcttacggtacactgcttctcttcttagggaaaggaattccccatttcctgaatgtgaaacgcctacccttttggagcctcctagtctttagttcctacctcagttaataaaccatccctgtctatgccttgcatctcagagatggaatttgacggactagtcagcattgcaaaggtcaccctaaagctattggcagaatacactgccctttgttgctcagtgatgataatgctactgtagcagttaactggatgtattagactgagctacttttccagaataccaaattatctatttatttcttttaaacacctgataaaatgcccatttacaagctgtctcaagtgtattttcaaaagggatcttaatgatagtgaaatatcagtgctttggcctcagaagagataatctgtgcagtgtgtgtgtccgttgtgttgttttgcttccacgaaaatacttctaaaattatactcatcttttagtgtttcagttgtctgaaactaatcatgttccaacaagtttgaaaattcaaggtgttaaaaaacagttttatttacattttgtcttctgttagtgcaataatactctaagatgttatgaattgctttattttggaaaaaatcttataaagcttcatttccattcccattatttcccacaaatataaaaatgtggaaatagcatttttggctttaggttataactttacacatagtgtaaaagtggatgtcaccatctttttatatctttaaatctactcacaatttacttactgaaattatattcagtatttattactgcttaaattatattcagaattatagaagaacaattaatgatcatgctacttgaagcgggggagctatacttgacatagttttgtgttttgcgtgtgtaaactgattttgtgacaccacagtgcagtcttgatataattttttgtacacaggtaacatttttgtcttggttctcacctaaataaaactgagtaatgatccaaagtgctaaggtatttgtgactttcactaattattttcacttatccatgtattttgtactaattactttcctaaatgatttgccacatgctcttctatcctgtagttctgttttgtcctaatcagattgggtgagcgattagggatttaaaattactacttctttggtctcaaaacgagtaagtgaagactcagagaaatacctttaatttgccttttagtatttttgaataaagcagactctgtcctgccttcctttcatgcatgtattcattgtttcttactgagtgagacaagcacatttaaagtagaatatattccttctctccagaataatagaatgaaatcagtgatcaagtaatttttcatttcagtaattcaacaatcaatggaaacaaaacaaaatgagttaggaaagaatagtttgcattaagctcagacatggaataatatttgaaaacaaagtatcactatagttttgtgctgtaggttcttcctgacctaagtgattgttgaaaggactttctctagtttagaggtatgtttatcttcgaacaataatcacttcatgctgttctttttttcctagttgacccattctccagacctttcaaaaactttttaagtggatgtaaactccgttttaattagagcagtgcagtctaatactgcaactagcgaggaatggaagaaacgtgctggaagttaatacaacccaaatcaaccacagccagataattcccctgatctttgtaacaaccgcccccccttccccacctccacaattaagtgaccctgttgttctgtagtttcaacgagacatttaaggttcatttaaaaaaatgatcatcctttacaggattctttgctcttgcgtttctctttctttcttccccttgccacacagctgtcactggtataggagaaagactggggggaggggaggaggaggaagccctgctcaaatcgtgtcacgtagcactaattcatctgctctcattagagggagcgagggacagcagtgatggccaagagctgcactctacacatgacacgcgaacagtttggggaatagaaaattgctttctcaggaagcccagccaattaaggacttgaccatattgaatgtcaagtgttaatttaggtttttcttcattttcccagtagtaatgtgggtcctgtgatgagcaaatacatgtcaagtaaaagttgattgcatgaaggacctgggtattatatgtcactgacaagtcacaaatgtactgaagtcttttaaccccttaggtgagttgggagggggaggggagaatgggattaatggtaccataatgataagaatagatagtttatgtgggggtggcttggatgggacagacaggaatggtaattcatgcaaaaactggggatagaacaaatcctactctgagggcataaatagagacccttgaaaagcatacatgcatatatataattcccactgcaaacacactgcccagaatatatgttcggtctcctaagattttatgaaaagggaaaatagtgtactctgtggtcatgaaccaggaaattccttattaattatctcatttgaaagaaagaaaacattcattaaataattacactgttttggatattttagccctttggctcaatgccactgtaatatttctggctatttacttataatttcaatctctaatatttattttcaatggactctgtgtgatacatgtcataggaaagatgcaaagcataagactgaaagaatgtttgttttctgtcttgagtatctctgtaaggtgttgtttaaccaatagaaactggtggaaggtccatcattgtcattcatttctttttgtgcccaggtgtaggaggggaagagattcaagcttcagcaagtgaagtaactttttttttttttaaatgttgaacgttgcccatcatgtttagcatctcatttccattcatcagcattcatttacatatgaatgtcttgaaaataagagaatgtctgtttctgttgcagttgtacatgtagcaaataagaatgcctccagtttagaatactgtgtgtagtctgggcaatcttagaagttattcgtgattgggccttgtttttcctttatacctataaccacttttccccttcatatctttgaagacataatcttaattaaaacactttcttgaaacctactctcttctatttattccaaaattttaacacacttgcctttgtatgttgacaatgcttaaactttgaaaatttaagtctgatcatactttaattttggcaacaaaacttactaacgtagtctttccctgtctctcccacaggttagaaactgtgcaatcattatattaaaagttaactaaattttattaaggaataattaggaaacaattccaagaatttgatgtttaataaaataggtttttcttgagaaagaaatagtccctctaatgaggctcctgaatgctgggctggcatctgagttctttaacatctctcctccatgtctcaaaactaaccaaacaaaattcgcttaactctctcttcccttcctattttgataagctctgtggaactgtggtggcattgcaagtgtactgtttaattaaaatccagttgtcagcaggctctcttccactgggtgtgctgagagacttaagtaagtttccataaagtaaattctgacgatggcagcgtgggttgctgattcaagttattccttctcttctgtgtcacttttgacggatggtacctaatgcaatcaaccacaggccgagaaagccttttctttggttgctttagtaactggaccaggagttcccctccccacttcatctccccttcagtggcttgctcactccttgctgccacccccaccaacacttcagcccaaataggaaagcggaaagaacagcagaactacctaggactggctgacaggctttccctaaacctccatttcccagcggtgaagccgaagctgcctccctttgcgtgcgtttttgataaatttaagaagtcaaatcgctgacacagatagataatccaagtgtatagggtgaagcgttataaattaacacattattccctcttaatgtgaaatacttgagaatgcattttctgagtcccctgacatctacccagtgagggctcacattgtgcttttctagtggcattgatttgttaaagcgctgaatcagcatctcaggccagctgcctgatccactgttttgttgtggggctccagctcctcctctctgccagcaatcccttttttccttcggtcttccttttctttttctctccctttccctactgactccttctctgcttttttccattttgctcctccccatctcattcttatttctttttctctctcaccccgcccttcctgtggcttgcttttgtctcaatctggttttcctcccacaccatctctttgcttttccttccttctctcttttgtccatacacatcttgtcctttctcatctctgagtgagttttccctcactcagggttggtgtctgttaactgcctttgcttgcatgtgcatgttgtatgtgtgtgttgaggagggggttgatttagccaatctctcgactccaaatgaatccctgcagagcagaataaattaacgtatgcctgtttgcacatgcatgtcctgtttttaatagaagttcatgagaaaactttcacctattttgctttctagaaattaaaacgtagcttacagaactttaaaactcttatttctaaatgccatttaacacagtaaagttttcttttggctcaaggaaaatggaaatcacggctggttatcacagatttgatctactcacattgtacccaccaaaataaattaacatttctacaaaactctgggcacctttttgaatttcagtgaacttactgatacgacattttttcttcagcaggttctgtattgttctgattccacttatttgtactggtacaatttcatagaaaatagttttcatcgtggtatttgtagcatgctctgatttcctaatatgtgatgcatcgctataccatagtagtgaatacttagattataaaattactttggcccggcgtggtggctcacacctgtaatcctagcactttgggaggctaaggtgggcagagcacctgaggtcagggattccagactagcctggccaacatagtgaaaccgtgtctctcctaaaaatgtaaaaattagccgggtgtggtagcacatgcttgtagtcccagctactcaggaggctgaggcaggagaattgcttgaacctgggaggtggaggttgcagtgaactgaaaccgtgccactgcactccagcccgggcaacagagtgagactccatctcaaaaataataataatagtaataattacttggcaacttgtttagaactaaaatgagattgcttatccttcttttagtgatgtatcccagagttccagaggtcttcagaggagatatattaccatggagagggttacatgtactgcaggtgcaacttcacagacctcttttcataggccccggttcatcctttgaatattggtccaagatactttggtgtcactgtgttgattaacttgatataagaagaaaagtgtatctgtttggactaaaatagaaattaacctctgtaattttaatctcacggcatcacttgattcttccttcaattttactgggttttactctagtaacttcacactagtaacatcaaaattggaatttgaatatgcacattgataataaatcagattacttgaaaaaaatcaaatgtctattgctgttgtttttttttggcgggggggcggagtcttgctctgttgcccaggctggagtgcagtggcgcgatctcagctcactgcaagctccgcctcccggattcacaccattctcctgcctcagcctcccgattagctgggactacaggcgcccaccatcacgcccggctaattttttgtatttttagtagagacggggtttcaccgtgttagccaggatggtctcgatctcctgacctcgtgatccgcccgtctcggcctcccaaagtgctgggattacaggcgtgagcctccgcgcccagccttcttgctgtattttatatagattaaactgacaatttgatttcagcatttgcaatttgaaatggaagtgtttcacataggttttggtaacctttgcttctgagttggattgattctcccctccccccagtcaagtataattccttttttttaaaaattaattgctgtcctctcatgaattagcatggcttggctaaggtgaagggattagaatgacttttcaaggcatgataatgtctgtttaaaggaaagaaaaagaaaaaagtcttttaactagggcttaagactaattccagctactaaggagacaaaaattactctaaagaagacaatttggttttattttatatgtgcatgttaacctgctttgagatcatcattttgtattttagggtattctcttagatgaagtaagatgttcttcatttgttactgaaaggggacatggcctcactccaggagattaaagctggaacaccttctgccttctgtagggataatcacagctcacctggctgtagctcaaggtcagggcaaaaagaggggactttgtgctttttagaattgcctatgactacagtagagaagaggaataataaaacaattggacaagattgaaagtgaatgtgcatcatatgaagatagttaataagatgaatgatcagaaaaagacaatctggaagacatccttcagtggtaggagaatcagtggtagaagaagaaaggggtattttggggtgcaaaactatgacctctgttaacttgcaaaaattagtactgttgtgattggttataaagggctacatgagaacaattttaaaattataaaaacatttgtaaacatttagtatgattttaatttttcatttggtatacatactttttaaaatagttgcttgtcagttatgttgcttggaaggcagaactctctgcacaagcaataagtcagtaaatccagttttttgatctaatattgttgcttgtttgttttgtaataatagcatgtaaataaaaatggttaagtgtaggtgttttaggattcaatccctttgaatttttctctcaacttctctggagaaataggaattgtttctgggtgttttgtaaatctaaattgaatgtcacttaaatgtgaaagaactggcacctttgataagtagtccccatactgaatcattttgtcattaataataacataattatcaatgcaaatgtaaagtttgttttttaaaaagtccaaaacaaacaaaggagggaaaaaaaaacccaagccacactatcatacaactcgaggaaaaagcatccctacatttaaacagaagactttcaatagtagcagtaataataagaaagaacctttggcgtctgcccaagagcctgttgagagggagcagcaaatggcctgcgcagtgtgtggctctgcagaaattccagggtgacacatgcctcacaagctggtcacaatgcaaggggtcaggggtcatgttcaagagcagggtgttgctggataaggctgaggaagcagaggtggcccctctgtgctcagtgtgtgggtctgtgtactcctttcccgtcaaagctggcccagcgcggccaaaaaagcggttccttggcagggtttaatggcaggatgatgtagtctgttgtgactagtgcattcctttcaggttaaactagggaaatggcattgtgttaaaattccaagtcgcatgaatgttttattgccacagtgcatttagccctccaggggagtgtgtgtggcggccggtgggggtgggggtgggggtgacttagagactcaggaactatcagaagaacacttcccttggaaaattttacccactagcatgaagctgatttgctgtgatggtcacttagaagggtttcgctttttcctaaactgtggctgtttaaagtcttggagtctggacaattaacagctgaagaaaatatgacaagacacacgcaaagaggttgggagatagagaggaggagtgcgccagaaaggagctgagctgccttcttgtgtaaactgcctgagagcgggccccctcccctggcctccgtccctgtccccccttccccaaggctgtgttctgctgtctgcccgaaggccaggactgatctgttaaccttgcaccactggctgggaggccgctgcagctcatggtactgtatgttaccattactactccctcattctttttcactggcttttttttttttttttaaaaaaaaaaaccatttctctgtaataacggtttatattagtcagagggatacaattttggaatgcagaagatccgagtttaaaacaaaacaaactttagaatggtactttttttttttttttcctttttggcatttagaagggctaaatccaaccatgctaattcaattgcagccaaaggttttcagtgtgatttaaaatcaggagttctggaaatggagcagttgaaagatgcagtcatttgggctgtggatcttataaagggactttgttgtgaaaccacacgagcatcttcaggtttttaggatattttcagtctttgcatttgtctcagttatatccattttgcagattgcccccaacccctatccttccttagggaaaactctagccgtctcattcactgttggagttgttttaggcttacagttactgagggtgtgtatgatttgacttcagttgtaatcgtgtgcattacatataacatttgaactgactcaagttaatttataacagattaaagtgtggatgtgtggaacagctttctgataatgcagtgtgcctttataaaatattcatgtgtctgattttttcccccaatgtataggagaaatatgtattatcctaagatgacctaagaaaggatatattaataatagtttgaattttacttttggactgcatttctcttcaatttcaaaccttaattctttctttgttttcatgttcctgttcagatgttatttttcttttccttaataatacatatatacttgtatgtgtgtgtgagtgtgtgcacattttaataactgccaaatagttataagaaaaaacttggagagctgctaagttacttttccattgatacattatcagtcagaaagtcatgtaacaaaaattcaactcaagaatatagcacagaaaagtaaactatgagtggacccgtgtgccctatttatagagttttaagtacatgttatatatatcttataaaacaatgattttgtcaagatagacccctgagtttaatctgactaatggtgtttgtatgatggcttgttcttcttaaacatatatattgacattatttataggaagtcttacaccaataagcgatcagctccataggaaaatcaagctgtgtttatgggctgggcacttcaaattttaggtgaattcattagatatttttttcttatattctagagaatacccacttcaataattatttctttttgttctatttggtctagtaacatgatgatagtttttttagtgatttgttttttagttgtacattttaaaatgtgatttttccggagaatattgctctgtgctggatttttatttcttttacttaacagccaattttaaagttaattattttatttaaatactagaaaaagtagttaatgttgccaaatttaggagaaaaatctgtcaattaacatttagattatctgaagttatatttcttttcctagtgatagaagcactttttttaaactgtgaaaaggatgttgtagttgtgttcagccctttccaatttgatttattaaaagtttcctttcataatccaagaggggaagagtggaattactccagtatcacatctctctaataagaaaatttcagctgatttaggaatcttctccgcataaaagtaaaattttcttaaaaaatatcatcacttgttcttttagtgttttcctgttcccattgtgccaggcacacttgtttggctttggaaacttcgtggaatagtgaaaaaatgggtgttgtttcagattctaatgctgctacatgttagctttgtgactttggataagtgactttatccctgacctttattttctttgcttttaaaatggggaaaaggacatttagcttacagattgtcaggaaaatgaaatgagacaacacacttgaagttccagtacatagtagatacttaataaaccttaggtcatcctcctttgacctgctctgtggcttattctccagtttttatcccttgggaagcttgaatttttggaaatagtagtgtaggatggtaggggaataagtttaaataaaatgttttaggttcttcatttatctctaggaaaggcgatattaggccatcagcagatgtcttttttttttttttttttaagtaaagaaactctggcgttatttattagtctacatttttaccactctgcaaaattttcattaggttgatctttgtggatgtcagagtgatgctatcatttctgtgttaccagttttggtacaggtagtttacaagtaaagttggccgattctgttggatcctgtttacttttgtataatcttttctaatcatttgcttgaattaaagcttcctgccttatagtcattagcatttgatagtggatcttgaaacttgattttgcaagttagactccagcgtctgtccctggttttgtgaaaatctacttataatcatggaactaagaccacactaaagcttcgagtgtttacacctctgtagaattaaacaaaacagcagcagtcaacatacatgtatctgggcaatactttatcttcatttagaatcttgcagaatgcctaaagggtagttaaggacttaggaactatttgttgagcaaaataatgtgcttctttttattgttttttagcccaggattatgttttcataaaaaataattgtgttcccatgtgaagtacattaatattattgtggttggtctttttttttttttttttttggagagtctcgttctgtcacccaggctggagtgcaatggcatgatcttggctcactgcagcctccgcctcccgggttcaagtgattctcctgcctcagcctgctgagtagcttggattacaggtgcctgccaccacgcctggctaatttttgtattttcagtagagacggggtttcaccttgttggccaggctagtcttgaactcctggcctaaaacgatctgcccccctcagccttccaaagtgctgggattacaggtgtgagccaccacgcctgcctgtagatggtctttatttagtattgctattttgcttaacatctaacttcttttagcctgccaaagtttgaacatactgcatcttaagatctaaaataaatatttgacttagtgtttactttggcttgttagtaagcataaaaaaatgaaaattgttaactaataactttattgctaccttttagcacacatagtgtgctagggatgctagtcatgatatcttatttatgcttacaaaagcattcatggaaggtacccatattttcattttacagatgaagaaatcaaggcctaacatgtgtaatccagcaaagttgattccaaatcccttgctttcccccttgctgcattcttcatatatcatttaagctagctatttaaaaagaaaaaagaaagttagttgtagaaaccactggttttatttcctttcaaattaaattttatgaggaagtcagtatgtagaactgataaaaatcagagttgttctagatgaaaagagatagagccacagtcccatcttttaagcctctcctagggatccctggaatacttgatgagaaagccttagcctaatacctccacaccccagaaaatggggcctagtgcaactcttcagtttccccatctgggacttgaaggttttgtttatcttgtgcttggcgatgttattatgtggaattcacaggaaaagctaatcagtataattttatttattatttatttatttattcttgagacagagtctggctagagtgcaggggcccgatctcaggttcaagaaagtctcatgtctcagcctcccaaataaccgcgattacaggtgtgtgccaccacgctcagttaatttttttcttttgtatttttagcagggatggggtttcaccatgttagccaggctggtttcgaactctggacttcaggtgatccatctgcatcagcctcccaaagggctgggattacaggcatgagccactgcacctgactgctaatcagtataattttaaaagcttatgaaagactgtggggtaaataccaccgcaaaaaaaattacaagccaggttgctggcacgcacctatagtcccagctgcttgggaggctgagtcaggaggattgcttgagccgaggagttttgagtccagcttgcgcagcacagacagggtgttgctttgttgcttgggatggagtgcagtggtgtgatcatagctcactgcagcctccaattcctgggctcacgtgatcctcagcctccagaatagctgggactatagttgtgctacaccaagcctggctaattttttgtagatatggggtcttgctatcaagacctcaagcagtcctcctccctcggcttcccaaagcgctgggattataggcatgagcaaccatgtttggcctcattgtaaatgttaattttcagggtataaattttgtttcatccatagcaatgaagtaattttactatggaacgagtctgaaaaaactaagtcacagttttatgtctaactgaagtctgtgtctacagactctacttcattttgaaggttaaagtttgggtgctgtatatcacattatagcatatctattaaagacatatacatatcatacaggcatatatgtgtaaacataaggatggagaagataaagtggatcaacttaactgggaaaataatgtcaaaatcactattttaaataaattgcttgtaaaacaaattaactgccatgataattctgtaatatctttataaaccagaaattacaggttttctcaccagataaatttacattgggaatttatgtagctctttattagaaatatgtctctttcatgaatatagtgagaagagtccagactttttagctagatttacctgcatttgaactgatctctttcctatgtgactttgtaaaagttatataacctctttgaatcttagttgcttcatttataaaatggggcttagaagtaaatgatgcctgtgaattctggcacagagagggttagttagaccaatttcttcttctgtctgttactattgtagattgctagtcttatgcagtttgcacttggtatctgtttatcaacagtgccacagtgttctttatacttgcatcatgtacatacttggccttttcaattactagtttaaaaaatacttgtgtcactcttgcagaagtcttacttttgcagaagaaaatgagggtggagagaaatctcttctttcttactcttcactgagaatcagtcactgagcagcataattctaaaatcttatgtggcttttgggtactttatgaacctttttatggtaacccagaagcaaggcactgattgaattaatacatttccatcaagggactattctgttggcctgtcttcctcctcctaacccatgcatgcttctataagggacttttttgttgcattatttaggttgccacatatagtggggatgacagtttgtagatgtgcaggttactggtaagccttatagcctttctgtttttaaaacaaagggaaaggacaaaacaaaaacaaaaacaaaaacagaacagcaacaacaaaatcactacccaaaccaaaagtaacttaaaaataccatcttagctttctggaaaacccagtgctttataaaatgtagaatctaaagtttgcatactgatattaatttttaatagttttaaaacttttaaatacaacttctgtacaaaaggatatgtgttcatagggcagatctgattaagaaaacctcaaagagagaaaactgcctgaagggctatcaccaaggaactgttaatgtatttttagtcgtctttcttcatttacaagtacctaccaatgtatgaataggtggtagtttcataaagggatgatgttacatgtatatgtgacttttaaaaaatgcattgttatcctaagtatctttccatgtccgtaaatataggtattcatcatggcttttttttttgagatggagttttgctcttgttgcccaggctggagtgcggtggcgccatcttggctcaccgcaacctctgtttccccgggttcaagcgattctcctgcctcagcctcccgagtatctgggattacaggcatgcgccaccacgcccagctaatttttttgtacttttagtagagatggggtttctccatgttggtcaggctgatctctaactcctgacctcaggtgatcctcccgcctcagcttcccaaagtgctgggattacaggcgtgagccaccgcgcccggccctcatcatgacttttaatggattcttagcttgccattgtatcatagtttatttaatgagttcttggtttgtggattttttttttttaataaacagtagtgcttaaatatgaacatccttgcttgcccttgtatgcttatttcctaaaggtgaagacagatgtgatactgctagggaaggcagcataattttgcacagcttaagagagagattggcaaatctgttctgtgcagggctagatggtaaataggtagatgtatggtttctgtagcaattattgaagtttttgtaggaccaagcccctgtgtatgtaaaggaataggcagggctctatttcaataaaactttatttacaaaagtaggcagcaggatagcatttggcccacaggcttgtttgcctaccctggacttgaaactaagtagaaactaatttgggatgaaaatttatccctagtttgctgtaaactgcttttacagtttcttagaaatgtgttcctatctcagggcaatgtaatgggctgatgactgactttctttccaggtacgtggcaatcaatacttaattttaaagaacttattaaaggagcttctcataccagctcctactcctgaagcctagtaaattttaaactaagaggttatatataccagtatatatttttatcattctatactttttttttttttttggaaatcgagtctcacttgttgcttaggctggagtgcagtggcaatctcggctcactgccacctccatctcccaggtttaagcaattcttgtgcctcttagcctcccaactagctgggattacaggcatgtgccaccatacccagccttttaaaatattttagtagagatggggttttgctatgttggccaggctggtcttgatctcctggcctcaagcagtccacctgcctcagcctcccaaagtgctagaattacaggcgtgagccaccgtgccctgccacatcgtatactttagatttcagcatatgttgacaacttgttgggcaaggaacgacctctttaattaattaattaattttatttttgtatattttgaggtggagtctcgctctgtcacctaggttggagttcagtggcgcaatctcggctcactacctggttcaagcgattctcctgcctcagcctcctgagtagctgggactacgggcacgtgccaccacgcccagctaatttttgtagtgtagtagagacagggtttcaccatattagctaggctggtctcgaaatcctgacctcgtgatccacccgcctcagcctcccaaagtgctgggattacaggcatgagccaccgtgcacggcacactctttaatttatattgcagggcagatgggtatttccccctttctagaaggttgcttagttggagtcatgttctagagatattcagaagtaagctgaaaggaaagtccaataagaggagaagaatcatttcagcagaaatataccacagatcaacagggtgacattgagttagttactgaaccttaataggctaaattatacttgaaaaaatgctctgtgcataaataataacctttttgcatcttgagtttctataaaacaggaattattggcctctacttgccttacgggtatttgttgaggatctgctggaataatgaaatagttaaaatcactctatttgtaacattgtgtcactggtgcccttatgaattttaagatatttatttattattcagtatgtatttgttgactatctgctatgtgtaaagcagtatggcaagtgctattgggaaatacaaagagaaataagttagttcttgatcctaaggagagaaaaacatgtttttaaggttcaaggtcatgtggtgcttagagccctaaggaacatagagcacttgggacgatgagatccctttcatccaaaggtatcaggaaatttcatggaagaagtggcatcaggaaatagggacattttcaaagggagaatacaggcgagggtattccaaaaagagcagcatgagaactatttcaggttaggaaagtccaaatcagtatgcaagagacataaaatattctaattagagtgtctatcaagcatttttcatgaagaaggaggagaagataaagctggaaaggcaggttagagctagattgtagagggcctggaaagaactgtaattggtaattggtggggagctataaacatgatctaggagaatgtgttcgacaattggaggggtggtgtatagcactagttggcaagtatggaatgataaagtcaggattattgctaaagggttattgcagaggtctgagcatgtacttgttagaattattctggaaagtgtgtgggggacagctgaggggattgaaagggcagaatggacaggctatcagaactgactgggttcaggaaataaggagaagccttttaataatgatgtatggttctgagtctttgttaatgggcttatggtaataacattgaaaaatatagaaaaatccagggaaagctgtagtaaagaaaggagaccagtgaacctatttgcttgtttagctcgagatgttaactggacacttagaaaaatctagtgagagtttgaaaatgcaggactgaaattcacatgagaggtaaggattagggatttgggagccctgttcacacagaggtacgtgacagatgagacttgagaagagcttcacgtcacttaacgagaatgcgtgtaagagagaaaatgcggccacatgatgtggctcatgcctgtaatcccagtactttgggaggccgcagcaggaggatcacttgaggccaggagttcaagaccagcctgggtaacttagcaagacccccatttttatcaaaaaaaaaaaaaaaaaagaaagaaaaagaaaaaaatttagctaaaaagaatcacttctcagctaaattgcagggcacgtgggtattttcccccttctagaaggttgctttagttggagtcatgttctagagatattcagaagtaaactgaaaggaaagtctaggagtttaaggttgcagcgagtcacaaatgcacatcactgcatcccagtctgggtgacagagcaagaccctgtctcaaaaataaaaataaagaaaaagaaaatggtattattttaagtattacttaccattgggtaagtcaattacgtaagtagctctgtctttttgtgaggcaactaataccaaaagaaaagcaaaaaagaaactctcatgtattttaccatttataaagcattctgttgtccactaagcttctcttcttagcttctaaagctactaggtttcaggggtaaagtatgttcagtttggggaaaaaatattttcataagattcccaaggaaaatataactccctttgactttatcttctctccacttcctgagaaccttagtaacaaagatgttactggtaggacgggtttacattcactttttacctgtctgatacagactactacagcttttcatctcccctagttctcaccccagttgagatccatgcatttgggatgggggtgggggggtatcccttagaaatcaactttgtatgcgtttgcacatttttctctttttagtctggggtcctcagcaggcttggaggggggattgtgtagtatacagtatgacttatgtttgacttgggaaaatttttcctgtatggaacagcaggactgaatctgctttctcatttcctttcttcttttaacattacctatgttcaagctttgcatgcaaagaaaaccgtgttgattcattgatcttcgacatgctacattatgagccttggcagaaggtaaaggctcccctggctcccctgtttagagcagccggaattcctctggtctgttggtaccatctgtggccttccttcaggctcagtcttcatagtaagtctaactcatgtcaaatgggccaaggtgctagtccagagtaatttgcatctctagccaaccactgtgcatttactctagtagtaaatgcctgttgtatttgtctcttaaactgtgtatgctactgaaacttttttttaaaatcataattggtttaatgtaggtggttcaatgagtagtttgtgaagttgaatttttgggaactaatatttgctctttccctttctgatgccacaacatattcttctatcctatttcattcaaattcactattctgcttttttcacataagtttttcaatcaccctttttccctttggtgttgtttagcaagggaggaaaccctttcaatttgttccatttttgtgcctctgatgaagtaagagcaactcagacggatgtattttcttcctaagtaaactcttttctaaaaaaatgccacaccctccccccaaaataaagcattcaatagcttgatggtgattacttgaaggcagtctctttcctcattagaggtaaatacatcttcactcttgattgccgcggaaagataggtagagaagctgagtggagcaaacccaatggctgagttcaagttgacctggatcattttaaagtgcttttcatgtaaatgctacagttaatgtctgtccccacataatttctttctaatgtttgcagcagatgtggagttggccttaccactgctcaagctgcttgctcattttggctttttctcgtaagcttttcctttcctggcttcctttcttttctttacagagtgagatgttgggagataagaattttatgccttggtgtatgctccttcttctttctctccattgttttaagttatatcttttctaaaactaagttatgatctgtagagcttttgtcttatggttcctttttggttttctagtttacatgggctagggagcctcaaactttaatgctcatcagcatcacgtggagggcttgtaaacacaggtgagggactccacctccagtttctgtcacagtgggtctcaggtggggcatgcaaatgagtttcagacatgctctcaggtgatgatcacaataatctttggccaagaagcatgccttgggcactgaccgagactattggtcttgtctgtcagtgtgctgcccacccccagagggttgggttcttcagattttattcatgcacgttctctggaaactctttactttttaataatttataggccaggctgctagcataagagaactcagaaaattaccttatattttaattgtgaaacggttggttgcaggaggggcagatatgctgcttcttgccactctcaccccctcatcccccagtgaagtcttttttttttttttttttttttgagactgtcttactgtgttgcccaggctggagtgcagtggtgagatctcggctcactgcaacctctgcctcccaggttcaagcgattctcctgcctcagcctcccaagtagctgggattacaggtgcccgccaccatgcccagctaatttttgtatttttagtagagacggagtttctccatgtcggccaggctagtgtcgaattcctgacctcaggtaatccacccaccttggccccccaaagtgctggaattacaggcatgagccacgacgcccagcacccagtgaagtctttaacactaagtccctctgagctgacagcgatcttttcggtcattccaaacacagcatcactctaggaagccttctaaaagatgattgagttggcccttggtccctaagtgagaccaagtgactctgtctctttttagtttccccagttgcttataatattcctttgacccttgtggcttgctttcctttcccctatgcggcttccatcgtggtctcaaagttctcagccttcattggattggtatgctgtggtgctgcttttgtgggctgggggcagagtaccatttacagatatactgtgtacctactgaatccttaggtgctttacatgtgtcatctcattcaaccttgccaaccctgcacaataaatataagtatcctcattttacaggtgcaggaaacaaggctcggagatacgtaactgagcaactttacaagatattgcggtagagatttaaacagagatctaattgcaaagctagaactctttcagtattacctgtctttaagatagctggagttgagtgttgaggatagaaagtaagttaacctgggtgtggcatacttgaaattgcatttaatgtcagttgtcagagttgacaatgtatttgcccataagcaacaacctgtggtgttcaatttccaaaataatgtattacaagaatgattgcaaaccaatagaataatagaattctgtacctttttttcttaaatataagaacccgccgggtgcagtggctcacgcctgtaatcccagcactttgggaggccaaggtgggcagatcactttaggtcaggagttcaagaccagcctggccagcatggagaaaccccatctctactaaaagtacaaaaattagccaggcatggtggcaggcacctgtaatcccagctactcgggagaatgaggcaggagaatcacttgaacccgggaggcagaggttgcagtgagctgagattgcgccactgcactccagcctgggtgacagagtgagactccatctttaaaaaaaaaaaaaaaaaatggctgggcacagtggctcatgcctgtaatcccagcactgtgggaggccgaggcgggcatatcatgaggtcaggagatcgagaccatcctggctaacgtggtgaaaccccatctctattaaaaatacaaaaaattagctgggcgtggtggtgggtgcttgtagtcccagctactcgggaggctgaggcagaagaatcgcttgaacccaggaggcacagctttcagtgagccaagatcgcaccactgcgttccagcctgggtgacagaatgagactctgtttcaaaaaaaaaaaaaaaaaaaaaaagaacccatacccatccgtggatctggtacaagtgacttcattctcattttctccaatgctaaaacccaggtaaagcaagaattgcaggaagtacgtgaaatctgtccaatagtaggatgtttttcgagtaaagcactagcgaagtcattgagagaactttgtcttaatttcacttctatccatttttatcaaatgtagagggagaccatagtgataggtctcagttttctcatttagaagtaaaaggagtacaatggaaatttctccccttccttacttgtctgatgtgggaattaataaatattacgtgtaaagccctttgagcactctggaagaaagattctatgtaattttagcattattcgtggtccattaggctcctcagggtgtcaccagggaagagagatttttaccttttatcccatatttcacagtataaaaacaaggtatttctgttgttgtttgtggctgtgaaaaatctcctgtaattgtacctgcagaggttgctcctatcacagagcccagggcactgttctttggcagctcaccccagaggatcagctcctgagggaagagcaagagtgaaccttagtgaaatagctcctggtggctgtgaggacattgtgcctgctccaccccgcaccctggcatccccccacctccgtcaccttctgtgtctttcaacctgttgcataacagaatcacatactgattgactcttttccattttcttttatcttatgctgatcctatagttcattgctctgagatgactccagaggagatctgtgtctccttcaggcactggcatctgtcctatccagttcttctcctataaaatatctcccatccttatcatgttcctattgatacaactctgccttatctgactctataacaatgaatgtatttctggtcattccatccttgaaaatggataagtactgtgttgtatttatttatttgaaacagggtttcactctgtcactcaggctggataataaatactgtgtcgttagtatgtatgtatgtatgtatgtatatatttgagacagggtttcactctgtcacccagcctggagtgcagtggcacactcacggctccttttaactttgaactcttgggcttaagtaatcctcctaggattacaggcacatgtcaccacacccagctaatttttctttcattattacttttctctctgtgttgcccaggctggtctagaactcctggtctcctgccttgacctccctaagtgctaggattacatgtgtgatccaccacatccaatttgactctgttttgatttaccagttgctttctgatcagtgagcagtgggttccttcttcgcccttaggttctatattcttggtccttctgagtcttagtctggggtcccatggtagagaaagtttaggcccagaattttgtctcctagttaaattgtaggctgaaaaatggagatataatttaactgcatactctgccacgtagctcaccttcctgtgtttctgcttttgtattcatttattttgcagcagtgtgtttagcgtgcatcttcatctttacagtgttggataatttgtttatttctttatctgctctttctcacagggactcctggtgagcttattgtcaaatctatttcacttgatggtcttcctgaactctttgtgttatctgagtgatttttcctcttgccgcttggcattgtataaccactgaaattaggctggagtgctattgggtcttccttttggcttggaatccggcagtgcttgtacctagccatgtctctgaggagcactctgatggggctttatttctgtttatctctctccctctttttttttttttaaacttacattgtatatcattcttttccaaggtctttgtcccttcaacactgccagactgaagccaccaaaacacatacacttcagaactgatctgggcttggggccagcttgactgaggagactggagctcacatggaagttagtttgtttatttaggctgtgactttcatagtgtctatcaggcagatgcctacctgcgtgtttaatatttaaaagtaaaatggaaatttcaagtggaccctggctctgcagggggcatccctgactacgagcccttttcatcgtaacatgactcttctctcaagttatcatttctgtgacttttctcttttttcctttgtcccctttctgccacccatttttcacagccattcatcttcaaatattttcaacggtagctcccatttacaacctggagctttttatgtcttcttttcagaagtctggtccctaacattttttttttttttttttttttttgtgatctcagtaaacaaagagtgtgtgtatgtgtgtgtgtgtgtggttatgtgtgtaggaagcctgccatatttcctccctgccccacagaaaatatgttttctggaagcccttttgacaccgaagtgaatgcccactggccctcccttgttgaattctcctgaggggagagagagaggcctttatacttgtcatatcttttgtttctgctgattatacacaaagtaagttgtaaatagctctctcacacaccatgattccttcaaggtatgtatatacaggagagtagatatgtactcagcctccacttgccctggggatttcagagggtccctttcaaggcctctgacctcctgttacagtactaagataatgaaatttacatcagttgtaggcagttattccataattaaacctgtggcataatgtttagaaatattagctgaacagttcaccatttttttttgtttttaagttaaatgattttattacttttaaagcaacatatacaatcatacaaaaagaataaaagttaagtacctataatcttaatcactgtgaacattttggaaaatctttgtagaactttgtactatatagtatgtcaagtatgtcattaaaacaggcactaggtgttagcacagaggaaaagtggataaaacggaattccccaaatcagtttaaaatttatattaaataatggttaggcacaccccatattttattatcctaatttacaatagactaataataaggggttagacaattgatatctgatttttcttcaatcattttttgattgcttgtggctggctaacttctgaggcttctaaatcaaaaggtggaatgagatgtgctaaattacaactaattaggttatcagcttttatctcttttgtatcttccttagtacattttgatgaattcagaaagagatatggtttgcctttccgtgttgaaagatttccctaactgatgacgctgattgtggtggatggggtgagagtgtggtgtatttttagaccatgaaccgttcagtgaactttgtgaaccaattttgatttgaatctcttatccctcattttttagaatatgggagtcaactttcaaagattcttatggatatatttttctgctcagaaatcctagcactctaagtttgaaaatgtacccacttccctactagttcctttttgtgattatgattgttgaaacatactggtagtttgccaccatttcctcccaacttactcacagacctttatgttttctcttagaaacagtgtatttctaagtgtctcaagttgtaattgcatgtaattttagttgtttaactttctccttccctcttgagaatgtttataaagtgcattctgtgactgtgaagataaaaagaactagaaacttagtgtttgtgacgtggtcaaataatcttaaggtaagtagcaatttgttttgtgtatgtgagatcgggtgaggtttacacttaatttgcaatatatggcttactgaatctgccttagttaagtcccatttattgaggttttataataaggttttggggggattcattttgatttggaatattctcaggttaatttttttcttttcccttctattgctccctggggagaattactgttgcagaactcattagtggccttccatatgtcagctgaggggtagaatgagcattatttctatgtgtgacacaacacaaatgcacagtgcccccgctcttctccctgctgcatttctttcttattcctcagttaagaggataaattcccttttttgttacttatgttgtcctagaccaaggagcaggtagcaggtcttgatttcggttagcgcctttttcctttgttgtcttctttgtaatttctttcatatgaaacatcaacaaatacctctagaatggatgccactaaatgtagttattacatttttttttaaaattaaattcttggaaatgtattctcaacctttcttttctttctcatgtcttaagtttgaatccaggttttacaacctaataacatgtgactctgagctagttatttacctactctaagcctcagttttttcgtttgtagactggagatgctcatactccgtaagagtgttgagaggaaaatgagggttaatctacacgtaagattccccacatagtgactcgcgcattggcctgcacgtgtgaaactcttgggtaaagagtggttgtaaacttcaaagacagatgacactctgtccatttcaccttatgagcctagtaaagaagaataaaagacttgaaaagaatgagagaactggacctaaaaatgtttgaagcgttgaccgagtaccttttatttttcttttctttccagtgatattcactagtgaacttgcaaagtggagtatactgaacgttgtttaagtttggacgattgtactgatttttgggtgaaaagaaagagggaagcaccttttaagctagcatgcatggctgaaaactgatgtctgaacaaagcaaattgattagcacagatgatcttaattggagttttaaaaaagtcaaagaaaacaaaacagaggagtgctttgatagggaaagaagacaaaggtgagatgatgcttagttgatgtattgagtttagagacatatagacagatatatgattagtgtgagtagtataagtatggaaataatgaggaacaattagaaatttttaaaaagcagaaaacatgtttaggtggaatctaaaaccttgtttaatcttaaaaaaatctgaaatgaaataagcaagggacagtaggcagtatttagggatgatattgactaattataatagcttagttttaaaaagggatcttagtggctttcagtttagaattttagatatagagaaacattcattaagttttaaccttgtttttttattattaggacagatacataaaacaaggtttttaagcttaaagataacatgtttaaatgagtaactattaataataaatattgataaatagaagtctgcctgtgctagcctacaccaggaacaggaaaaataaatttgaacaaatattttaagaacgtaaaggaacttaggcattgttgaatgtatttttttttaaattcctacataagaaaattaaaggaaagaggaaaagaaaaaatttatgtcaccaatgtgaaacagaaattatctattttagtcttttcccatccctgcatttccttccttctgtctccctcctcctgtccgtggctatttattaggtgcctactgtgtgctacctgctgtgaatacaaggaggaacaaaatttatgttgcttttttcttcttggaatttaccttctggtagttaataaactttgttacatggtattcactatatatttgacatactaagtgtcacatacatgtcaagccatgatgacctgttagagacccgcagttgggatttcctctctctgcctgggtcaagtgtgactgtgtgcagttctcagcagcctccatacacagcatctaacgtggctgtattccctcaggttccattggcatgtactggcagagtgctgggggcagacttctgcccaaacctggaggagccataccacaggctggaagtccaggttagagtcttaactgttttctcagctaggggtggtgtgacagaaacagtggtcctggaaagccatttgggtatatcagcgtcatcaggaaaagacaaccattgagttaggtgtaaagaggaaccagtgtagcgtatgtgcagccataggtccttttcaggatgcgttgtctgtaactgtagatcatttgtctgttcagtcaagacatatatacatactgtagtaagtacatggtctctgaaggttgactacctagagttgatacaagttgctgtgagacctttggcaagtcacttaatttaagtgaaccttagttttctcatctgtaagatggagatttaccacacaaggtgatgatgagaatttaaaggacctgacatatattcagcagttagtgcaggacctggcacataacaggtacccagtaaatattagctttcatcttctaagacttttgggatatatgtgagtaagtcatgcttcctacaatatggtctcccggctcaggagaacagcagccattcaactgagtgctttataagaaaagcaggacttaatgaaatatcttctgtcttcatgcgttggaagatatgtcttgtggtgtaataggagtatattagcaaagtacattttttttttttttggtgaaactgttggattgaaattcagttcgttttgtatggtcttgaggcattagaagtgatttggtgtattgcaaattaaaaatgtaaatgtgacattttggctaaaggcatgcctccatttctatgtacataataatatttaaggaatgtgtgtgccaatgcaaagatgcaggctgaagtttcaacatgggtagcactccctagcatgaggaaactcatacttttttttttaggacctccatttggccttattttctaaattttcaggcttataagatgagcatagtgagctcagttttaaaacgtttttactgatttagaaccacaaatgagaagagagaaccatttaaaaaatggacttctatgcagtgagaatgagggtagaagtggtggtaggaggaggtttcagtttttatggtaccgaagggtatgccatctctagcacacctgctcttggcccagggaagaccacctgagctctgctgtgccccaaactggtactgtctgggtggtgtatgtctgtgatacaacagaaaagcaggtgggacacatgagacacgatcatgtatttcctagttctagaaagctaacagcttgtgtgtgacatgcaaatgcagagtgatggaagactttttgtggagagtagtctgatccttgaccttttttgggtaggacgagtgatgttcttcaaacacatcacctggaatggtctgtcatgggtgattgttggaaatctgtttttaaaccttgaattacagtgaaaagaaaattgggttttgcagatgtgagtgtgtaaaataaaactggaaaaaaaaacctattgagtacattgacatactatgggagaaaatgtagaaaatgttatatttacaggttaaagtaacattctggttgtagatgaaccagattgtggggttgatagttcagaaaggaccttgcaaagaagactaagttcctggacaaagtaatgaaagtgacattattggatattcctcattgtggatcatcattttggtggactgcgtggaaggattgaatctgttaaaagatgatcagctatggagagttagtcaagtagctgggacccacttgaagcatttcttcctctcttctttttcttctgccttcctaaatgtgcttcttctgcacattttagaaatacctagtacatatacatattatgtccaccataataaagatgcttaatatacttttcaccagctatctatttcaggagtattttttagcttagactgctttcattcttgccatgtcatgtgtcctagtcctttttaaattttttcctagagaatgagccatttcttattgttcagcatagctttatactctagggagctcactataggacttgccagtcatctccttttcctgcttgtatcataggctttgccccagggctaggcattatcatcactagaggttttgctgtttggcctcttgattctgagaataaccttccgtacacctcaatttaggagcagcggtttgtttatattctttcttagaaaggatttttgtttagacatacagccctgaaatctggtttacttttatgttttagctgacgtaagttctcatgactggtggagcccctttctgctctttgccttcttccttttaaacctttgccttttattcctaaaatttcagatttcttagcagctttatttttaataatcccaagatcccctactgtggtcaatgaatgtatctttggttttgaatgactgtcaaccttcaagtctgtgcctgatttgacttttgcaaggacttctgctgtggtttgtgttaatattgcttgattcagaaaaataactggaaatcaagattttgattctgtaactttatttactttccccagtggcttttgaagtgggtactccagtttgggaggttaactgatgaacagcagcaaagaatcccactcttatgcaatcatcttctaagaaatggttattctaatttagactctccttaattgctgatattttacttttatcagagaaaagttactttgttagttcagttgtgcctcatcatgtattaagttgttacatttagctcagcacagttcttttcttggttgggaattcaggatgtgaggtttgacttggtatttttcaccactgaagtgcttaaaaaattagagtaaataatgaaccaatatttcagtactagattagacacaatttgctgtgatgttttataaaccacaggctcctttcttatgtgaatgcgtggaggatcacttttttttccagacatactggggtgcaagtgtaaatttccataaaagttaaatgaggtgcttcctgtaattaatgaacaactgtggctgctctctggtctgcattgtaattaaccgtgatcaggcttgtttagtgatgacactgttcctgtaataatttgacaagctactgtgaatttgccaggttattaaacaacctgcagcattcacttctggaatcacggagatgagctcggctgctgctgctagttaaatgcagcataagggtgaaccaaaagctgctcatcgaagtctgtcgatcactatgaacggatttaaattcctatgatgttggagaagttaattaattttgtatagggtgtcttgaaactttttattacatgataaacctactggggcaaagctggtcatgtttatgaactcacaatgaagccagcaaattctctatattttttaacaacagtatgaactaaacaaaatctgaagttctccttaccaccttattaaatgggtataacttatttttaaaaaaaggttgtttccttcacagatacatccacaacatccccccaaataaaagttcactctctcttttttttttctgttccaaatagatgaccttgtgctaaacaaagtggtgttgccggtagagcagtctaagtggaccagtagccttacatccttggtcaccagcgcaccggtcccccaaccccctctttcaggttaagatctgttcaaaacgttactgtctagttactgtggtgtctttcattcagattctgtttattgactaaaccgcaaggattcctgcccaaagtaccaggcggtctatgcttgactgattttgattttctaacatcagccctgcggtttatttgaaaaatgtacatacactgcagctttaacaagtcaagtgactgcatgtttttgaccatggagtagagtatatctgaagatcattaaatttagtgggggaagggaggggtagagaataagtgtagtagtcattgtaccattgcagagtgagtgagtgtgtgtgtgagtttgtgtgtgtgacacatggtttttgtcttttcatcttctccaagagccagaaagtttcctgcagttctctttccagctattgacaaatgattgccagatgtgagatctttgcagtgctctttccctcagcaaacctgcagcgatgggatatttgattctcccttgcccatttcatctcctttccacatctgccagggacacacaagcaatacatccctacatgagagtttaaagtttattcagctcctttttcccctccgataaaatgtttggagacaacagaatgaggtccatatgactctctcctgacttcaccgtatgaaattaattgtttattttacttatctacctctcagtaattgaagtatttcattttagtttcggtccatggaaaatttgacgtaactctgggagtgctaagagtttcctattgtctgcttgctgcaagtatgccaccatctcagcttccctttgagtgcctcaattctgataaaaactagactgttggtttcacaggacttcccagtaaagtaattttaatcaacagctgtcaaaatattaagtgtggagtgtctggtaaaattcagtagtcatttagaatttaaaaagccatctaagagggagaaaattcaacttatttggtttgattggtttactctgtgtttgtgtccattgtcgaaattgatatggatgaggctctagttttaatcacaagtagcttaaaaaagagaaagtacactgagtttcagaggaatctgaagttagcctgtgtaggccacacacgtaatcactaacatgcacagaagccttttgcatctgcttggaatctgtattgatactgattttttttttttctcatctcagtttgaaaatattttccaaaatgcccttatagctcatgttcataccatagggtgggctgacacaggtggcctgtctgttttccttttacactttttggcaaatggaaaggccccttattccctgaataagatcaacgtttttttttttttaaacatttaaaaaataatccataaaatgtctgccacatgttctctagtttatggaaatgtttgccaaattagacttgtggaattggattcttattgtaaaagtattagtgtgtttactatttctgctaccttcttagctacctgtgattatgtgaatttatatttttatatgaaatttaaatgaggagtataattattatttctgaattcccgtactgaggaaaaattttttgttattaaaggaggtaagtgattatacccacatcagaatcaacatagaaaaagtgtgaagcctgtttttcaatattttctttaaaaaattaagaaaacgacaaagctaacaacaacaacaacaacaaaagcccctgaaaagattaaatcctcctaaacctaagtaaatggcggaaaaccatttaccacaagttgccaaaatgttgtatgtttctattgaaagttttcactgaataggatagaacataatcacagttgaacatgaggacagtgatttcaaactgtttacccttaaaaagaagatgaagatcatgatggaggggttaagtttaaataacactccccctatgcgaaacaaaattactaagaaccaaacagatccctgtggaaaagtttgtatgattattgttctgactttccctgaggactgacgccatggtaggcactcagtggataccagtggtggaaggtggaggcaaagagcccttttataaaacaacaaggttaggaactcctctggcaggagccaagttcctccgagtttagatcacttcacataatgtgcccttgctaatgcatttgctggtttctcacgccttcctgccttttcctctccatggttactctgggaggcagagaggtgctaagcaatggaggtgtcatccggcccgcgcatctagggaacgtccttcagaggacaacttgtcaccagccgtcaaagaagagagtggctttgtggtctctgaacatctggcagcgctgcacaggaagctgagggggtgtcattaattgtgatgaaataatttaaaccatcaggaataaatgaggctgttaagctaagttcagattccatttgccatgcacatgtgtctagcagcctgtgtgcagttaaaagaaattgaattatattagctcatgagtagaagtgaaacagatactgtaaatgaaacaagttgctgtatagcgatgacatcgtgttgaaccatttcacagagttacagtttgtaggatcactgtatcaaaagtggtatattatttaatgaatttttatattataaaacattcctacggtatggagtatagtaaggaccagtggtttatgggtaggtagagaggatgtgtaggtggatgggcagaaagaagcaagccaccaggtaaaggtgcagtgaggtgggtgggaggtgttttgccaggctgaattgaggcacagtgtagctttctatagagtctggctgtgattgcaatattaggtgccctcgctctgtgtacatagtgcagcttggaggacagtttctctctgatgaccagatacgaatgttcctgtgagagcctctgacactttgggcccatccatgttgttttcttgctattaaaaacaactatcttgggcgatagaaggttactcctcaagcaagggaacatatttataaggctttgcacaatcagtgaacactgatttcgattgtaattttcaggcactaccgaaggagacatctccagtttctttacaaaggaaaaactgttgggtttggaatgtcaggacaactctgagtttttgtgcactaaatggatcaatggtgtgtaggttccaaagtatatttgtaaaataaaagccattcctttacacacaagtgaagctttcaaagttgaacttttatgtaaaaacaatcatggaaatttgaaaaaaaaaaaaaagagactgttactgtttaggtacagaaagaattttaaaaaaattactggagaggtaggtaatacctctgtcagaaaacagatacatggccaggcgcggtggctcacgcctgtaatcccagcactttgggaggtgggcggattgcctgagtcaggagctcaagagcagcctgggcaacatggtgaaaccctgtctctaataaaaaaatacagaaaattagctgggcatggtggcgtgtgcctgtaatcccagctatttggaggctgaggcacgagaattgggaggcagaggctgcagtgagccgagattgcaccactgcactccagcctgggcgacagagcaagactctgtctcaaaaaaaaaaaaaaaaaaaaaaaaaaaaagaaaaagaaagaaaacagttacaagttatggtctggaacttcggcaaatttggacaagagttgttttgctaaaaatattttatctcccttcaccccttcgtccctcccttaccttactgcctttcttattcactgtcacctgctgccttttttcttcctcctctctctccattttctcttttcctttccattattctctctttttattttgcatcctctcatttttgttacaattgattctcatcctctaccgtcacagaaagtgaactgcaattccattttcatttataatgttggttttcctgctactagttaaaagatttatatctataattacttagtttgtaaaattataaaatttaggttacatttttacataaagttgtgtgaccattggcgaattttttgaaagaaagcaattgaaccttgattaagctttttaaaaggaatgcagaatactcattgagttatcctcttccctggaccagaatgaaattgttattagtgaaagccagctagaagtttgcagctctgggttaccctctcccttcttaactccggacacaggaggaagacattcaggttgaaacacttgtgtttcccctaacttgagacgtgtttgaagttgaatagaatgaccagtagtcaggatattgctactgtgtgtgtgtgtgtgtgtgtgtgtgtgtttgtttgagacaaagtctagctttgtcccccgggctggagtgcagtggcgcgatcttggctcactgcaacctccacctccgaggtccaagcaattctcctgcctcagcctcccgagtagctgggactacgggcattcaccaccatgtccagttaatttttgtatgtttagtagagatggagtttcaccatgttggctgggctggtctcgaactcttgatctcaagtaatctgccagcctcagccacccaaagtgctgggattacaggtgtgaggcaccatgcctggccatgtgtgtttttatctttaaattttattttaattgatggatagtatagaaagatgagttcttcagcctatctcttgacactgtcggacagattgaaggagattgtgcctgtgtattagcttttggctaatagtgaatgcattgttgttactgtgtaaattacttttactagcttgtggtggccaagcacataaaaattagacagaatttttttctgaaattttcacatatcttgaaaaattaaatattatttacctaaaaacagttttataatttttccctaaaataaggaatctaaagaacacagaaaattttggaacaagataactatgtttttctttttatctttcttaattcgccttctgtaatacatctgtttctcaaaacaaataagaaaatgataatatcttcaacagtgacttgtgctttctttcagaagtgtgttagtgaatatttacagggaaaaaaacagttcatgaacttgctttttttttctcctcccttgttctcacttgggtgtggtgtgaactggatgcccctacatattttcgagaccttctttattccgctgctgcggttaacttagcatctgcttaggcagcattaaatttgtgaattcctgtgtctcaggttctatatgtcagatacattgtggattaagtaaactttggttgaatggcctgagaacttaactacatttctgcattctctctcaataccaatatttctgtgagagaatgttacctagattttggacaaccaacttaacatacactgttcatgttggcaactgccagtattaatgtaagaagtattaaataagatgcttatgtttatgtatgttcctaagccatagcagcttcatagaagaaggaaaacatagagaaaaacaaaatgttttaattcttggcttaaatagaattacgcgtttgtgtttgggtgtgtgcctatgcatggattttgtatgtacatacacacatgtcatatatatgtatatatccatatttttatataagaatagctagtgatgttctgttcaaatattttgttggagttagtcataattaataatttaagagcacacattccctcctacatgtacacaaaagaaaaagaaaaattcttttgtttgagtagataatggaatctcaatttgtgttttcaattctttaggatcagtattttttcatgttttcgaaattaaaagctggaattgattgattgattgagacagagtctcgctttgtcacccaggctggagcgcagtggtgaaatcttggctcactgcaatctctgcctcccgggttcaagagattctcctgcctcagcctcctgagtagctgggattacaggcgtgcaccaccacacccagctaatttttgtattttaaaatacaaaatttcacatgggtagctgagattcaccatgttggccaggctggtctcaaactcctgacctcaagtgatcgatctgcctcggcttcccttgtgagccaccgagcccggccaaagctggaaattacttaagttatgtaacctaatatctttacagatttggaaactaaggtagagaacttttaagacttaaccaaaatcacgtagttagtaacacattcttcattgctgatgtgtcagagtctttaagatacaatttactaggttttattcctttagagtttaacaagtattatatagcagtattctaaattttttcttttcttcgaaaattaggccaggcacagtggctcatgcctttaatcccagcattttggaaggtgggcgaggtgggcctatcacttgagcccaggagttcaagaccagtgtgggcaacatggcaaaaggctggttctactaaaaataaaaatacaaaaattagctgggtgtggtgacatgtgcttgtagtcccagctattctgaaggctgaggcgggagcatcacttgagcccggaggcagaggttgtggtgagtcgatatcacattacgacagcaccactgaactccagcctgggtgacacagtgagacttaaaaaaaaaaaaattaactcaatttagtccttgttttgtataatccaagtggacttaaataaaggatgtaaatatcagttagacctcaggaaaggtgagggaaaggtgaagaagaatgcaaggaggctacatttttaggcattgtagtagttgtcttggcaggtttccctgtgaaaatagcagatcttcctgcactgtgtgtgaaatgtgctagcttgatgctaagaaatggaatatttgggtcttgcttttattttttcccttctacttttctagtgtcagttagtttagaatttgggtgttgctcaaatgccgattcttaaactttaagaatcggaaatattcccatctaataatctgtttcaaaactgccattatagacaactgaacagtggaattgcccaagaacataaaagtgtaaatctctactgttcattgagtgccagtggagagcttcaaggagcatatacgcagaccaagtccccttgaaatcaatgttatataaaccatctttaagtgccttcttgggtatggtactatgtttacatcttataagaagtgagctgaatagatagggtcgttgccctctaggagtttataatcaaaaacagatgatatagctgatatctgttattgtcttaaagtcctacaaataaacatcgattagatccataaataaaagtttgatatcaaagacaagtaaaaacctttttgcttgcctgattaaataagtaaacacacatcttcttccctacactgagactatccatgcgagttgtaaaatgactaaactaaaataatcatgacaccaggatactcctttagattgttattttttttaggggttttaaaagagtgctgacattaatatgatgtcactgatggtgtattgtaagtgggtctggattcagggatgtttttgtctttctggctaggaaattgggatgagattaattttcctccatctctggaatttctttatttctaactattcaatggtagtacttgctgttgtaaaccagcattctagaggacagtttaaaaattttatccagaccctcactgtgattagaaatcatatgtttttaaaattagctgtcccctaagcctctgggaactgcactaaaacaaagatgaggatatgaaattgatgctgtaatgagatgaacttatatatctaaaaggctttgagtggaatattagtccgaaaaggcaggttcagaactttggaatgaacagttctagttgtacgtttgagtaaagctataacaactaaaattaaatgtaaaatgttggcaagagagataggtattgagtttgataaaatattttctttctgcatgcttcaattttagtgcaaggtattataacagtcacttcattttttaagtgtaggggaactaaaacagcaacgctggggagactaaacatgaacccgtctcagagttcaacacattaaaaaaatggctgtccctactgcagtgtaggtgtctggctgtgtaaattaaagcatgtggatgcagaaattaattagaacagtcaaagatataaatcaaacttatttggtacactgatgaaatgatcattgtttatgagattatcttgttatttaatctattctgtataaacctggctggttagccttgtgaagtaataatacaattaatgtgatgtgatgatggtatactttttctcggtacaggcctgatcctgcagatctttcttgactgggacttgtgtatatagaagaccataagaactggaaattttaattagcaagaatgcctccacctctcagttgtatgtgtgtgtgtgtgtgtgtgttttttttttttttaaatctcagaatgttccctgggagtttattctttttgaatcattcatctactcaccctagaagaatgaagtgctttcagatgttatttcctcaaaactgtgcaaagtttattataagagctacctgctgtcttccagctatactgtgctatgctactgggtctcaaataaagagaaagttttacttataaatgaaaccattaggaatttcttgaataaacaaaggtttttctccctttgatatgcagaggaattttgtttgtaattatagtcatataagtctatgtctaatacatgcaagcatcattcattatcttttatatgagaatgcactcctgtcacctaaagagcagaaaacagatacactaagacaaaacaaaataaaaaacccccccaaaactaaacagggattccagctcgtaggaaaattgtcagcgtcattatttactatttgattcaggatttttgcttcgtgttgtttaccctgctttctttccttgtctctattcctttgactccgtgaagttggtttctttatgtccccaaatgagaactttgtttttggaaagttaaagatgtagattttatttaccttgctcttagattgcttcactactccatggtgttctcttactctttagcagaatttggcgacagtgtccaataaagtaactaataaattgtaggaaaaaaatgtcacatgtaatctctcttgtaaaaccttttatgaatggagcctgatggctggagtttgttgttcctacttaatctcataaagagaatggatttagaacaatgttcttttaggattatgcatagggtgattatgagtgtgatacgataaaatcgtaattatgatttcattttgtcctgaacagttaggattttttgctctggattggtctatagttgatgttaaacattttctttttttttgagatggatcttgctctgtcgcccaggctggagtgcagtggcacgatctctgctcactgcaaactctgcctcccgggttcacgccattctcctgcctcagcctcctgagtagctggggctacaggtgcccgccaccatgcccagctaattttttgtatttttagtagagacggggtttcaccgtgttagccaggaccgtctggatctcctgacctcgtgatccgcccgcctcggcctcccaaagtgctgggattacaggcatgagccaccgcgtccggccaatgttaaacattttcaatttgacatgtcagatatttggatgtattattttaaagatcttttgtctcatcttcataggagtgccccagatctccctgtttcacctgtgattatctgtgatgccatagcaacaccccttgctgttagcagagtatgtattatttctgtggttttgtgaatcagtaaccactaaaagatttgtgaccaatcacccatgaatgatttgttcagagtttgcttaatgagagaaactgtggcataagacaaccttacaatgtatgtacaggtatattttcactgttacacttggctctgttctagattatgcaacttgcattttcagtcattgttgagctatgtagatatatttggtggagtttgggtctgttttctgtaagcctttcagaacagtacttgtcaaaccagtgttaaaaccaggatctgctgactggagttcaggcatatggtgaaacaagatgccttctgggttaaagaggtgactaacggtgggccaactgctctcctttacttgccaaccagagcctgcttctcaaatctcatgggaggcaggcttcaatgagctgagtaaacagtatgagctgtatgtccagtttctattttggaagtgatgcataggaccagagctgatgagaaactctgggatatagtctaattttctgtcaaacagaacccctcgtggtaaaggtaaaggctgatgttggggtaaaggcactgtacagagattgtctcctgagtttggcttttccatgggctgcctgttcttttggatgtgaaaggctagatgtgttctccagcctttctgcacttccctagctcttttctttttaccacttatcctttcctttttcctgtgagttatttcattgcttcaccttttcgttcattttgatgcaatcacatattattttatccatacattttaggatgtcttttaggaggagccgatgtgatgtgggcccttatgtaaacagttgagagagtgacttgcatgaaggcattttgtttagggaggatcctagagtagaaatgaaggaccagggaaaaccaacacaaagatgaattactgagatgatcagtgccacaactgatgggttctcattctctctgaggccttctgaggaaatatttaaccattggctctcatttcccttgatccgtatggccgtctgagcatgaacttcccacactttttggcttgtgcatgtgcgtcttcaggttgtcaggaagcatgactcaggtggggcaagctcaggggaaggtgctaattagcgatcagtgggggaagttggttcatgcggctagaataagagacgtgacagagaggatttttaagtagtccaaggaacccatacattgtttttggttttggtctaaaagcatagagagctctggagtatttgctgttctgaatttctcttttcttgcatttattgtagtgtacttctcaggtgagttcacgtatacctttaccatcactttgttacttgaagggattgtttgcatttccttcaataattttatcttacctcttggaacattggtcattcaccattaggaccagaatgatctagaataggtaacgcatttcccttttattaacacaagtctactgctttatccacactaaagcataaaacagttatatcctatgtccttgattttggagtgggagaaagttgtcagctattcagccactcttaatattcttcttaaattggctggatacagtggctcatgcttgtaatcccagcactttgggaggcagaggtgggaagatgacttgagcccagaagttcaagggaacagtgaactatgatcgcgccctgaattccagcctgggtgacagagtgagaccttgtctctaatatattttatttatgtttatattctatatgtatattctaaatagaggtatttagcagaattctgccacagggtaatttggctctttcagatgttcaaaagtagacccaaatctttactggcattttccaatggtcctaggaacccgaataggtatagttaatgcttctattaaaccatgacatatgatagatcagtgaagatttagagaagagtgtaaggaaaaactaaaaatagtacccagtgggattgaaacattatgcatgctttcagtacttatttgatagaagaatctgtttcagaaaccaacttctaacaaaagcagttgaattacacaattattatatgtttttaaattgtagttacatatttttattggagtcatggtccacaaattataaggttaactattatcatgtatcatgcagaggagatgaaaccacatcaaagtttcctaccgtccactctaagctgcagttcaagtttctaacacgtttttgcttcttataagtggatgagctgatcttcatttctttttccgtggtatctgatttctttctggttgtttctgtttaaagaaatatgtactgcttataggaatgataatttaagcagttagagaagaagtagttctctatttgtgcaggtagatggaaggaacaccttgccaatgcataacatagtatctcacatactttaattccctcaataagttattgtattttaaaggtaaaagaccaggacagagaaacaacagagggcctgattctactaagaatttataactgttataagatcctcaaccaattggaagttgctgtctagtgagatgtgcatctcatttgctattttgctccaattcacaatagccagtactgtttcaataaaggaaaaatttagtttactctgctagaactttctcttgatctgagggagttggatagttggattatttgaggttaacataccttagcacctttagggcaaaatgtaacctgggggtgtgatagaatattccatctagaggataaggagttttagattataaggaaaattactcccttagtgggctcttcaggaacaattttttatcttgtggttggtcactttcaatatatggcagttgctttccattatattctcaggctccaatcaatacgtacaatattatgcaacttatagttacattataaccaaaatatgtcaaatgtggtttctgagtggctgatttacagtaagtcttcctcagtccccaaagtgggtattatgactaatttaaactttcatacaccaaagcaatttttttcatatgaaaatcgtgtgtcttgaggggggtggggtctgtagagacagaaggaacagtaaagcactgcgtcaacttactcacatacagattgatccattgtcatctcctttgcatctcatggattgttgtgaattatttgctcaccctgggagagacgtgctctgaattataataatttaaaatctgtgaatctattaaaaccgtatttgtagctctaaaaaaattgatattcactgggcagtttgcccaacaagagaaagtcaaagagattacacacttaccctaggtaacagcaaccaccctgccaattcttcctttgaaagaatacagcagacccaaattatacatctgtggataaggggagacaagaaaagaactcaatatatcaaaatcagaaagtaaattccacaataatggctacaataatgtttcaagatggtattttagcataggcctagtcattgaactaatcatagcttagaggggtttaaaattgtttaaagtacatcctgacgttgttaagtatgtttaccactctcacttgaaatcagaatattcactcatgtatggtataccctgagatcatatcggagaatgacaatgactgcattgtttggtggaaaaagtgaggcccagagtgtcacaatggttttctgatttctcatctaaaggtcttttcataggatacttaattaacacatcgagctcccgcggtatgccaggggctggcagtgtaaagatgcataagaagaagctaggtgcagtggtttgtgactatagtctcagctgctcaggaggctgaggcaggaggatctcttccagactagcctgggcaacacagtgaggtctcccagtgaggtctccttcctttagaagaaaaacaaggtgcataaaaataagctggtctttccatgggagcttcgctaaatgtgatcttcccgaaggacaggtttagtcctgttcatctttcaggtctcagcacttaccattgcgtctggcacttagtaggaacgtacctaataattgcttgatgtgataaatgccaatctttgtgccatggaatcacagaggacaggaaaaccaaggaagaatttaaaaaggggatggagttttagttgagttcttgaatagtgttttggggtgcaaatagagtggagaataggtaagcccacctaaaagatgctctccttgagggcaagaataaagttgtgttgatctttgtatatccttgtatccagcatagtgccccatacatagtaggtcctcaaaacatatgctatatttttttctgtatataaacttgaactatacctttcttaactttcatattacaaatgtggtaaatgttttggtttcaaaacatttcttgtttgattatatctaaataatttatgctagaaagaaaatgctgtcaaaaggctatctcatttaatttaattatgtcaagaagaagttgaaagtattatttgctcagataatcctcactttctgataattggaaatcgactttcttggactgttaaggatgaccacctcaaattactacatttggcactaagtggagagtcccactgttaattttcaattaactacaatgttgattatcttgtcagtaacaatgctttagttgtttttaccacctaatctcagttgaggagatcatggaactaacaagagcttgattgtggattttattcttgtataggccggttaaatttgcaaaaggaaaaactccttgaataaacatagacagcactccaaattttggttagctgttaaataaatggatgctattattacaaaagaggacttggctaaagaaggtagatcatcacatctcattaccatttggataaacaaccaaaacatgtattctagtgacagtacttttataacatcggcgtgtgtgcgtgtgtgcgtgtgtgtgtgtgtgtgtgtgtgtgtgtatgtgtatctgagtgatgtgtgcttttctgaaattagtatttagctttttagtggaaataggaagcctacagtgttctttattggttttaaattttttcagagtgtaatatcactctggtactagttcataactatttgaatttatctgtgaattttttaactgtagactgaagcagaaaaaaaatcaaaatatgtcaggcaaacaaaatgttcaggttgaataatgctaactacatttaagtgaattagcacttcctcaaaacatgaaaaatttgttaagaatatattgcttcaaaacgtgtgtgcatctggctttgtatagattagtgtagactacatttcagatgggcggcaaaacagatatatttgctgtttagataccatgtttaaactaggaaaacaggtctgctggatgtgtgttgaagtgtttagctccagaatcacccagtgagtctcagtaatgaaagctgacctgtggtttcttgaaagatgtttttacttaattgccaagatagcttagatgttgtttactgtgttgtcagttgcattgtagcatttagagaattgatagtgttggtcggtaacctttctgtgcgtgtgtttttaagctgttgtttctctcttttaatgaagcacgttaaatatctttaatgccacctacctgctttattggaggattcatgatgttgagaaaaaccaaataaaatttctatatagagttataggagagaacatttgcagcggacatagcagagatcaagggaatgccaacattaccagagtgaagaaaacagagaactgaagatgagaccaaaatcagatagatagagatgccctctggcaaactatagctctggaggaaagtatgttagaaggtagctcttcatagaaaaaaaaatgtattttatgggaaaaatattctaaaaaacccacatgatctcctatttattgaaatatgaattcaaattttatacaagaaataactcattgaaagtagttgtcaatgaagtagttattaaaattactgtgttttaacaaataaatatctgcattgaaatggcacaaggaaaaaaatggggataatttaccagataaaattttaaagatagtttctttaatatttttaatcctggaagtccttattgcaagtatgactgaaaaactaatcatggaaatatgtgtttttttcaattagttacagatgatttactaggagaggttcaacaggtaggaagtatttgtttacagatcgtttaggattataatttttaagaaatgaaatgcctacttagtaaggatcatgtttgtaatgatactaactccagagtgcctagatccgtgcagttccagggcttggtttcagaggaaataaattttgttctgattagaaaattaacttgcattatgcattttcatatctctgaatcagtcttgactataaattcatgatgctagtcaaatattaaacacactttcatgcttagtagcataaaatagtgtcaaatggtaaaataagatggtaagaactgctcaacctcaaagaatttacaggtctagtttaggaaatttgctgtgatttctctctctctctttctttctttctttctttctttctttctttctttctttctttctttctttcttttctttcctttctttcctttcttttctctctttctctctctctctctctttttttttttttttttgagacagaggttcactcttattgcccaggctggagtacagtggcacggtcttagcttactgcaacctccacctcctaggttcaagcagttctcctgcctcagcctctggagtagctgggattacaggcatgcaccaccatgcctggctaattttttctatttttagtagaaacaggatttcaccttgtttttcaggctggtctcaaactcctgacctcaggtgatccacccgtcttggacttccaaagtgctgggattacaggcgtgagccactgcacccggctgaaagttgctatgatttctaaggtacttccttaatttataaagaagttacaggtctagtttaggatagttgctgtgatatctaaggcacttccctgcttctgccatgaagcattgtgctaatgctgcctataacctgcctattctgaatttaagattcactatattctgaatctaagaataggcagggtgtaggcagcatcagcacaatgcttatggtataggtgaagcattctggtgctcacatttcacgtggacatgaattctgagagtttattccagagcagaacagcgttttcagctgaggacaacaaaaccttctccttattgggtctcttgtagatcccctgtttttttttgtttttgtttttttttgttttttttgtttttgtttttttcctgaatacccttattgcccctacttttattttcctttcatttttatgaatctgtcattgatgagcatcctacccaacaccagaccagattaggatacaggcagtttacaggaatttttaccgcatagaaaccctgaagttgtagttgcttcctacaaggccagaaattctcttcagtgtccccagacagtctcagctaaaaggagagaggccttgagcaaaaacttggtataggcttatgagtcaagaccatggttggatgcaattgtagtggaatttctctggataggaaagttctggacccatgaacttgtggttgggaggggtagtgagagtcagacattctgggcaaagtgcagcattagggaagatttagcatgcctctgagcaacaaaatatgtagatgccagccagggaaggactggcgtggaaaggagggacaaccttgggactctgaagtatgtttaggaaatcaataacgtggagcattccctatcaaattcagtgtttgagatgaaatgaatactgatgtcacaagtccagagtgtcatttttttgtcgtggtatttccctttacattgggaaacaggaggaataaaggcctattatttcgagaagcaggataaaggtggaatcgaggatcaatggagggttaagttttcataactaatctctaataataatggcacgttagttgggttagcccttttcttgccaggggcttacctcctcccttgttttggaccacacatttaatatagcaagactttataggtagactctaggcaagtttctataggtttaacagtacatttattcaatgaggaaattacttattaaggcaaaaatttatttggaaaaatctgttttcatgtgtctgctttcagatttttttctttcttattaagtaaggaaataatattcacacctgactctttaaaattttgttcagtggattagatatcccagcaggcacatttgaattgacgctattggacattattactctttctgagatttttgaaatgctcttttgtgttttttacctgtgtaaagtcaccggaatgcagttacagaaatacataattttagagcaaatattctaagaactagaatattagtaccaagaatatcataatattagagatcatgaagttcagtcccttctttttatagtatagtccagaatcacagagctggaatacataaccttcttggtaaattagaaagaactcatatttgtattagtttgaaaacagagtgggccaggcatggtagctcacgcctgtaatcccagcactttgggaggctgaggccagtggatcatgaggttaggagtttgagacgagccccaagatggtgaaaccctgtctctactaaaaatacaaaaattagccagggacggtggcgggcgcctgtaatcagcccagctactcgggcggctgaggcaggagaatggcttgaacccgggaggtggaggttgcagtgagccgggattgcgccactgcactctagcctgggcaacagggcaagactccgtctccaaaaaaaaaaaaaaaagagtaaacagagtggagtgcctatggatcactggaattgagcgagcgagtaggggaggtgttagggatgttattgatgaaatcacttggctgtatagtgaagcagatgagataatcagaaagggtataaccagaatagactgtaacctccttgagggcagatcataagctttcctttttctattgctactactgtttaaggcacttactgcaggtaatagcaactttaaaagcatttgtttaaaattataataaaaacacattgatttagtaaccttttaagaatggtgtttctagagaaggaagcagtagaaagtctccctgattttatgccatcaaatattcattcctttttctgttttaggtaggatattttctcttgttttattttattttttgagacagtctcactctgtcacccaggctggagtgcagtggcctgatctcagctcactgcaacctccacctcctgggtttaaatgattctcctgcctcagcctcctgagtagctgagactacaggcatgcaccaccatgttcagctaatttttgtatgtttagtggagacgaggtttcaccatattggccaggctggccttgaactcttgacctcaggtgatgcacctgccttggtctcccaaagtgctggaattacagacatgagccactacgctcagcccgggtattttctcttgtgatgagttaaaatctggccaattacctctgaccatgcctcattgtaatcagtatttattttaaggtatgactcctagaatttaaataaagtattggcgatgtggtgtaattagtgtagagtagaatgagaccttgccctgttgtacacttcataggtttgttgtgtttacttttttgagccatatgctctagaatgttttaaatatgtagcatcacatcatctaccatttagaggaccagaatatctattctgagtacacaaagtagactcatgaactaatatgtgaatgttttcccctctgaaggagaaatattgggagtttaacagcttgagtagaaatttccttttgaatggttaaccaaactggtatcacttttaaggtcctaaatcccaatctgtttttctagggaaacatgttggcagctgttcgaaataactagtggtttaaagacaattgttagtgtggttttctacacacttaaagcttagacctgctctgtcacttgtctttgatgctaaggagttgtctaagtagttgagttaaataatttcagattagttttatgcattaaatggtttggttttatttttaaaaacctctgttattatttaactctgtagtagacatttacaaaataatttttcttatgtgtatttacatggacattaaaaacatcttaagaaattaattttattgatgtttttaagttcaggaatgttctcacaacaaatcacacacacacaacacatgtagtctttagaaatagacatgaaaataagatcattagatgttcatgcctgcttaataggagtctccaaagcaatagaaatattaatatattggaactctgatggagggaatccctgagtgcagagaggaaactgataacactaaactttaatggcctcggaaattatgagacagaggactccagagtcttctataatacataccttagctttgttttcatctctggggaactaacatacagctatatagtatactgatcacttccccatatactattgaagtcagtctccaagtaaacttgtgatttagtaagggcaggtggtacatgctgttttataaatgaggaaactggttgagagagtttatgtggtttatccaagtaagttcaaacagttaataaggactagctatagtaagacttaaaacctagggtttttttgttagaagatgagtatattacccattacatctgttcttctgatgatacaggaatgaggtaagggctcacaccttctttctctctaggaatgaagaaaggaacccctaggttgtaaaatcaattttaccacatgacgttgggaaggttaattgcttttcttgagcctcagtttccttacatttaaaatgggaataatggtatatacactttagaatatttaggattaagttagatcatctacagtcatccttcagtatctgtagagaattggttccaggacctccctcaaataccaaaatttgaggacggtttagttccttataaatggcattactatgcatataatctatgtccatcctcccgtacacttgaaatcatctctatattacttacaatacatagtataatataaaatgtaaatactatgtaaataattggtatactgtattgatttttaaattactattatttttattgttgtgttgttatttttttttcctgagtattttcaatctgcagttggttgaattcatggatgcagaacccacagatacagagggcctattgtatagcagtcatattggctggcacattctgtggaaacttagtttttccccctttttgtcctttctctttttctgctatccaataaagtttggctttgtttgtgaaggctaattatagtccgtgctattggataccttaggcagcttatgttctgctaaagagtaggaggtgcacacataaacaaggaactaatacaaagtggtatgtattttttttttttttttgagatggactttcgctcttatggcccagtctggagtgcagtggcacgatctcagctcactgcaacttctgcctcccaggttcaagctattctccttcctcagcctccctagtagctgggattacaggcgtgtgccaccacgcctggttaattttgtatttttagtagagacagagtttctccatgttggacaggctggtcttgaactgccaacctcaggtgatccgcccgactcggcctcccgaagtgctgggattacaggcttgagccaccgcgcccggccccaaagatgtgtaattttcaaggggaagtccaagacattgtgggcaagggatgcaaagtgctagtaaatagtacaattggagaacaactaattatggggtccctagtgtgagtaaaacttatttgggggtgagatgttagatttgtaaaatattttgcagggaataatttggctgaatacagatattaactgaacatataattctgtttcaggcatctatttggttgctggaggtacagtgtaacaaagtcctttccccttggagattatattctagtggagaagacaaatagtaaagaacatataagatagggagtataataagggctatgaagaaaaaagcagagaataaggggatgggaagtgaggctagagaggagcctgttattttacatcgtgtggccaagaaaagcaacgctgaggagatgacagttgagcagagaactgaataaaatgagagagcaagccctgcacagatcaagggaagaatattctagcagagagaacaacaatgacaaagaccctgatgcagaaacaagcttggtaatttttttttttttttttttgagacggagtctcgctctgtcaccgggctggagtgcagtggtgcaatctcggctaacttcaatttccgcctcctgggttcaagcgattctcctgcctcagcctcccgagtagctgggattacaggcatgcaccaccacacacagctaatttttgtgtttttagtagagatggggtttcaccatgttggccaggatggtctcaatctcctgacctcctgatctgcccacctcggccccccaaagtgctgtgattacgcgtgagccactgtgcccgccgcaagcttgggattttgagaagcagcgtggttgccagtgaacaggggtcctgaaattgcagaagggcacgatgaaacggagagcccttttacatggcggtacaatagaatttgactgtaatactattgtcagggccctctgcattaagtcagtgcacgtgtgtgcattcacatgcccccccccgccatccatctgccatttacccacacctgtccatctatccatccattcagccattcagcaaatatttattgagtacctctcttaagttagccactgttctaggacctagctctcaaatgaattcatgcttaagtttaatcacattcaaaaaaagagacagttgcgatgatcaatggtttgtgtatcggcgtaatgtatttttctgatcctagttgatgattttaagacaatgtaaactgtcaccttaaaatctaatgtgtccttcagccattgctttttagagggaaaagagtgtaagagaaaaaagttgggtggggggtgtgggcataagaaagagtgccttcaacatctgggtaaagagagcactggttatttggtagctggattgtctgttctgggatagttggtaaattagctgtgaggcaaagtacagtctttccttaagagacagaccaagttgtttattgatgctggggaggaaaagggctgggcacatgcttataagacctatgatctttcccagaatttggaaggataagagaattgttaagaatttgacattggaactgttccctctaattgtggcttagaccatttgatgggaaaaaaaatattaaggaatccaggaggtgatatgctgaacaatatggggactattcacggtgaaaacaagcatttacccaagcatttgaccagggtaatgtgtgttttagtttcaggtagtagaaactgaagtggctttgtttcacagtgacatttaggaacattgactaaaatatactgggctgtttaaagttttgttttcttttttccccctctcccttacagtactccccctgactccaaattctccagccttatagctgtttccatgttttgagattactgcaaaaacacttaatggcacacatatgaaaatttttgtaaatgtctaaatagtttaacaatgaaaattttcactcattctacatgtattactgatttggagaatttctaaattgctgcacagttttattgcaatgtagagatgtccccattcccttgcaaattagtaaattaggatctccttctacctctgagtgctatggatgccatcccttctcttgtcccgaaattccggtctattattgaacttctgtttattctacttagggggttgattcctttaaaagtgtattattacatatattaaacataagaattttagaaaatcagagattacaaaaagcaggaacatcatctgtaaccctaactggcctgccctaagatcaacacacctatgtatcccaagtagcccccacaaattatgcttcaggtgacatcatagtatgatatataatattgatatgatgtaatgtcattgatgcatttgtgtatttgtatgtctgatattatgaacagccttctatcatctttaagagtctgcacattattccattatatggataaaacagttctcctagagtttatttctaattctttcctattattaatacacgataagcctctttctggtccaagcacattcccttcagcctactgatggccaagtcacacctctgtttccatctggcagtccctttctctcaacttccattcagaactcagcctttagaaagaggacataaaaaatttgtttcctcttctgccttagcctcccacagtctagcttctgtttcttgtcttctccacaacaacagctctggagcgctgacctctcatctgaagcatattgtagaagcgtttctgttttttttacttatttctctgtgacatttgatgccactgaccacttttgctccacctttaagtctttggattttctaactcttcattgttccagttcaatctttatttttctgactccttgttttctagttcatctttgtatccttttaaacataaatcttttccaggtattctatactgggttttcacctgcacacttggggtagttgtactcattcccattattttaaatttctgcagatttgatgttaactgcccacctgtttctccaacccaggcttctctgtagggctccatatttgtatggagctctctcggttgatccacttcaaaactaagccagtcagaagctaaatttttagtgtctacccttgccccactatagtcagcctccaccgttctttaaatagcatcaccatctggctagaaaccagaaagtcagcttagacttgtccttctccctagctcatacctccttccccaattttaaatggcaactgacttctgtttccccattcattattctgcatccccagtgcctctaatcttgtaaagattccctctgtgaggagttgttttgaatgggtataaatttagttatataagatgaataagtcccagagatctgctgtacaacatattgcctacagttaacaatatgatattgtgcatctagaaatttgttaagacagtacttctcatgttaagcattcataccacaaaacaaaaacaaataaaaccctaaaggtccacatggaagcttttggagatgatgaatatgtttattattctggttgtggtgatggtagcatgaatgcatacatatatccaaactcaccaaattgtagacattaattttgtgtggttttttgtataccagttatacctcagcaaatcttgaggtgagggagccttccattatttcttgacttcagactccactttcaacattcttgaggctgtttctcctactggtactgtgaattctgtctctccccacccccgaatcctaccatcagttctcctggtgcatcgaatgagacagaaactcctcagcatgggtggccccattgtcgtccctttgtcctttcttgtaaccacttttcttgtctcctgcttttacgggtgagtagagttctccctttcctccattctcgaggtagaattaagcacattctcttctgtgttccctgagcacctacacacagggttactcagccttggaactggtaacattttgtgttggataattctttgtgctacactgtgggatattcagcagcttcttgacctctactcatagctaccagtaactgtcctccacactcagttgtgacaaccaaaagtgtctccagacattcccagtgtttcctgggtgacaaacctcccctattaagaacactgccttgtatgtgcctcttctgaagtacttacaatgcgtggcgaatatgtccacacgtgtccatcttcattctgtcagaggtcagtacatctgtggcttctagaacagtactgagatcagagtggcccccagtcagcacgtgttctttgctgcctgactgtgcatgccaggacagtcgttcgctgctgctctagacaaatgagaaaggaaagtcagcaattgtggagaattttgccatttggaacagtttggtagtttgataaaaggctttgctttgtaataagtgaattcaaggaaaatattctataataggcacgtgagggaagttgtataatatcttttgttagaattatttcaaaaagagactcgattttttaaaagtctgattcattcatttaattaatttgtcagtaatgcttgaattttgttttgtgctagggactttttttattcctggatgaaatagtcctgcctttttatggccttttagacttttcagatagatagtcaaggaggaactgtaatacagtgagataaaataagtcactgcaggggagatttccaagatagttacctgagtctcatactgtcggcagatgcggcctgcaggtgtgtataggggcaaattccaagtaatcttaatacattgatgctttgtaggatttagcaataagcactgtccccccatatttgcttttattcatctttattttagtgaatttggagaatttgtgttttaagatagtggcttaaaattagcatggtcatgaagcatttaatatttcctttatgctgtatcgtaatgattttccctcccccagttttttcctcctttacttgaatttctgtaatatgaagcataatgtggcaaggattctgatctcgtggcctagtctgtctgcagaggtgtatgtgagtgagaccccttttaatcattcgtataatgattggtggctccctgttgttaaaccacagttattgatctatcatttctgaagtacatggctgaaggaactggtgctgtcaggcattgattgactaggaaggaagtgtagagctattctaactcacttttattttcatcagcaacagttacagtagagacttgtgcaagacctccatgatggaacgtcatttttcctgcattaagaggtgtctgatgtgactgaaattgctgggataactcaaactgctgcatttaaaatatttagaacagaatacactgtccaaaaccttcttatctgacttggctaatggttcaggctctggaaaataaatttgggggcatgggggatgggtaaaaaagaacagatctagtataaaattgttccaaagcaaattgagcaacctatatgttaatattttactgaagaagtatatctacacaaattaactcagacaaaacaagtgtgtttttgtgtaagttaaattgtttaatggctgttcaaataattaagttcaagtcataattaatagctgtcttttggtactgttgttatgttttggtctgtttcaggaggatttgggacctgcatgcgcaaatattttagataaggatataaactgaagatagtaaaggtaattattaaaagtgcctctctttcattagcacaacttacgtacattttaacatctgagatgagcattgtttattttaatggactctttaataatgcttatgttatgccctgaactctagttagaatgaaaatgagcaagaacaacaaaaataaatggtgttggggttcggcagaggaaagatgggaggagtgcattaagagagtgaaaccaaaagagaggacaaaaaatacaatttctactgtagttgcctaagagcctgtgcttttgtccctctctctgaatgttttatttttgctataattacagcatcttgcctgcactttgtccctctgatcctttgttaaagcccagatcactctgtgcagactgcgcttgtaggtgtgatttattgagtgacaagtagctgtagggtagaacacccgcctctgtacctgagtaaagtattagacatcacagagctggggcaggcaggaggggggccgaggaaggagtgggggaggcgaaaagcaaagagcagtaacacagcagctcctggatacagatcagacaagaggttctgccacaaatcacctagaaacatgtcagacgctgcatgtttgttgttttacactgagggcacagccgtagtccaaaagtattgattcttttctttgtacagagacagagactgtcagacctagcaggctgaccttggtatggtgcagacaactattccccaccctgccgaccagatgaaccccacaggagcagcctaggcaagatatgccaatgtccacttcacaggcacagagagaaaccgatgcctgctgaaacggctccttctgtttcccaaacacttcccccgccaggcccccagagtgctccttgtgacagaaaattggaggcaggattcttggagggagcgtgtgtgcttttttgtgtgtgtcttaaaacacacaaaaagaagccctttttatttcatttgtccgtgagataaactgaaggatgtctgggcaatggtgtatatgtgtgcattttgtatttaaggcggcaagaggagatagtttattttctgtttgtacatatcgaaggggagatttctgtgtgtgggcacttacatttgtgagtgcgtgtgtttcccctcttctctatttcaaaagctttggtgagatggggaagagtaatcaactgtcacacttaattgatctgcagttattttaaaagttgtttaacagtaaaactacacagacccatttgtccatatgaatctgcaggtctctttatagtcttaaaattcactgtactcttaagtcattttgcagcatttaaaaaattcatttattctgaaaatcaggtaattttaaactaaaaatactagtttgtaatttggagatcatctaatataaatagaaacatataaccgccaacattttgaaatcaagagttcaaaacttgatcccgtaaaccattagggagtagggcccacagggtgcccttgaggaagtataccctatctcctgttgggcttggtgtgtcaagacttcggtttgccagaaatgcttgcctccaagtagaaggtgtttcagttactctttgctgaagctgagtgttttattttgactaacaataacagggaggatgcctttctccctttcacttttaggaatgttgttgcatgcacaacttctgtccataagattgagctgtccatgaggaaaaactccagtagatttcagatttgcccgaaggaaaatatgaggcacactgatggggaagaaaagtgatgatatcatgtgcacttagggtgtaaaaacctctcctttaaaaacgaggtttctctttttcaagtaaaataatgcagacaggttcaatgtgtgtaatactatattacatttgtataattcactttaaatcttttattaaagtgaatttttcaaaaagtagaccactgaagataaaaataacaagtaaggcattcactttcgtgaaaagccccattattttctacatctccattttcacattcatcctatttgtttaagtgactggtttggcaacctaaaagaaaacccaatggttaaaaaaaaacatttgttttatagttagtttttacttgtttttatagtatgagatctctgtgtagtattgagttttgcagactcctgagagaaaaaaaattctaataaaagtgctattatctgaaaacaatgactcaattaattattttggtttcttatgttgattctaaatatttcttgtttctctttgttgggtctttatgtctcatccaaaacagatttacattttgaggttagaaacagctgaacaagtctgcctttgggtattaacaaaataagcaaactatttaggatatatcaatgtctttacaaaaggatattccacttataaaatgggagctgaggaacacatatgctgtgtaagaaataccatctaagaaaaataatgcatagaatagattaggaatggtttaagatctgaacactcaggattggtatttcttaacactctattttttattttaatatatacatgctaatcgtctttctctcttctccgtatatgttatagtcacttgatttactactgaaattatattgcttttgaaagtgtcagttgagttatcccttgccttgttagtatcatgtttgatttcttggacagagacataaatcactatctcatatgcaggtcttttgaagacgcacccaaggtttattgccagtaacagactagtggccttatgtggactttccatgaataaaacagattgatgagccattttatagcatcgcaagctgtattataaatacatcacccttttcagtaatttaacgtgaggaacagcctaatgagctcccagccatgatcagccagagctgggagttttgtttagcttctaggacaagtgactggtggagggtaagaaacccaaaccctgtattgttttccccagttctgtgacaaaatcttgtaatatgaatcatttgaagtaatagtaaagtaaagatgcatttagaatctgtcagagtaataaagggaaatgtaaagtgggtctgattttgcttatagctgaaatctaaggttaagatgataggctttttaagttacttgtttttcttttactgattgaagtcatcaattgaataaacagattctcattttgaaatatacatgatgtaatatctacctgatagcttggaaaaggaacaggtagatatagttacaacatcgtaacggtctcttttgaaagtatagcttaagatgaccattgtttctgtattcaagccttcttttttgcatagcttacaacactttacctttattttttcattaatccttaaaatatccctgtggaataggatgagtgggtggcatcttagggtaaacagttactatcctttctggtgaggaaaccgaggcatatagaaatggttgtttttaaagagttatctgactagaaagaaaagcaagataaaattaatttttagaagtgaaaaatattttgcattacgtatagcacatgtcaatatttacaaaacttacacaaacataactttgtggacctataattttctaaaagtttggaaagtaggcgacacttaggattggaaaaggcatagctttgtgaataatttttttgctacctggaagctgcaatatattttgagctagaagcttctataagatatttcccttttctgaatgcaattgattatgctatactgcataatactacatttacctatatataatccagttaaagctgtattacatatttatagaagtcagactttggtctgaaatgccattatttataaacacaaatcagtgagtaattagtctactgtgtaaaaaaaataaaaaaaaattttgaaataatcttttctactgtgaaaacagccaggcagtttggtggactctgttattcatatgtcagacgggaattaccttgagtgtacagggaagaatgaagaactgaaaaggctttaattttctttaaagaataggtaaaaacagaatattttaccactaaggcatgaacacatcagtgatgccctaaccagttgagctcagtcctgcctacactgagacacaatgcactttcaatttaaaaatacatctaatttaaatggaatggtcctatttatgccctctgttccttattaaaaatggtcgacaagtaaaattccgtttaagaatacctgcagacagtcaatattgttttgaattttaaagagttcctgtgtcttgtgaatgacattatgcctttaatattccgtattcagggcagagtccttttgaaaccaactgtgcatttatctccatttttgctttcttggtctttgccttcctctgccatgcacccagggttgagtgctgactgcaggtctaagcttatcagattggatgaacctcttcggtgtctccattttggaaactgtgggtgagaatttaatgttcccctagcccacactttgaaaatgcaagattacagaagatttatgaaggcctctgtgtctccatagctctgttctttggggtacctctgaagtttactactgagcgaatgatcttggcatgttagtataggctgagccaaagtttgtgctatattatttatgattctatagcattggcctctcaaacaaatgaagtttattgacgtatcatctggaacaaaattttggctaattcataatttatacatcagaaatagatgcctttctcttatagattgtgccacttgaacataaaataagattttaagattaaaagaaacagaggcctgtagaagtggcttttcaagcttgtagtcactgatggttttttaatccctaaacaacacaaaacaaaggaagacagaatatgcttttccctctcccatacttcccttttctgtctctaattgtaagctcttgtgcaccagtgctcctacttttcctctgagtttagtgatagttcataagaaaagcattaggcttatggaaagaaagatctgtcgccagtggacttgattctcccttgtgatttataagggtctgagaaagcagtcttccaggtcttctcttctcaaggactctgggaaagtcttgttcaaaactaatggttcttaaagaattggtcagctgcagaccactggcctctcaaaacactgggtggttcaggtggatagcacacactgctttgcaactccaagatgcagtgggtgtgctggggcccgtgagtccgtcctggaagacctttggaaattctgtgttagtcaggctcattctctttcacttgatgtgcgcacagatttttgtagaaatcatttgatatcccagtagtgtacaaagcatgggatgatatatgcattcacacacttacatatcaaagatacacttcttctatgtttttgtctttcatacagagtctaaggcgactaagtcgttatgctattttagcacataaagatatcattggttttaactcaaagtgattgactcaaactatatttttatcatagtttgagtacctcatacttgttcactgcccttatgtgcatggtcacctttagagggcataattctgctaaaaaactattcctaatgaattgcaaatggagatgagttaagtaagctgtgttaattatgtcatttgcaagattgtctaatgtggaattggtcaagagactggaaactgcttgtcaaatgtttctcttaactaatgtgatagtttgtggtttgcaggtgacacaatttccataacttatttgatggagcctcattaaccaccccttagttcgccttagcaaaattatgttattaaacatgtcatgataagttctgtcctcattactttgcattcggcacagtgaatagtgtttgtcttgtgacacctctcccaggtccttagtcttcgaggaagccaaaggaattccatgttcagaattgtgtttttaagctgctttccagcattacacacatctctcttgacttggctaatagaacctggatgtgttctcaatcactgctatcaccatgcagtccttatttagccctctgtcatttctcctcagagcttggtgtcctgatgttctactgtcttaaatagaaacccaaagaatctctgaaccatatagttttagttaaaaacagccaagtgtatggcagtagtaactgtgatgataattccagtagtggagcagttttcgtttttcatagcatctgcctcatctaggaaatcttcacattagcagcagagcatttatctctctagtgaataatttttatgtttgcccatgtttgttgcttagtgctgagaaacttcatatgtctttttttaaacacacacacacacatattttattgcgtacattggtgactctctgtaattttgtcttcaaagggaccagtctcagagatactttacagtgattgccttttagtatttagtttctgtcacttaattttttctggtggtgggaattcatttttgttaatgtataaaatttttcaaaattgggagatggttgaataagattagaaatatagttcatggcagtggaatagactagctaatccacaagtgaactggaatagcatattgatctaaatgtataagatacctttattaaacctgcctaagaggatcatatttaatatttattttctagtgagcagtattgtacttactaaattgatgggaatacacatattgatgaatctcttatattttacttgaaaaattctgttgaaggctactttatcctttaacctgataaaccctctctctccctcattctcaaaaatctcatcatggttgcacttggatcaagcttcttcataaagtcattgtcatcttacacttttcccagaagcgtcaccctaggggaaaaatgattgtgtaatagaaaaactctctctgcattctatgcattgaccattcattatcttccatttggctaccctttgacctcctttccctgagccacatagctaaccaggtcggcctctgtcaaagtctgtctaaggatgttattcttcctgtggtctccctttttctttctaccttctaccggcccccacccgtaccacacacattccgccaattctctgtgcagacttgacataagattccaccccaatccttgttatgtaacctaccacctacccctttttggcaagggacacccgagtcagcaagttgcaacaaagagtggagttaattggaacatgtgctgtgcccaaatctcaacaaagaagggctgatagacatcaggaaaacacaaccatatgtagatgtttgcttgaggaatatgagtgtacatgggaaatatcatctacaaccaggttgcatttaaataaaatcaaccatcattctcctctttgtcttccgacacccctttcccccacatgtaatacttttaacttgctctctcatgtctgctcatgggtgggcatggtctactaaactgacaaatgaaacagatctgtctgtgatacttcatatggggaaccttatgtaacttatgcgggggactcagctatggatgacatcccagtagaccctctatggattcccagctgttacaatatctcataccctttgtgaccttttcttctatttttgcatcccttttagaaatttaggatttttttaatttaaccccgaatttcttaaatgtgggtacaatttacacagaatgaaatagacccattttaagtgtacagtttatgagttgtgacaaaatgtgtatactcatattaaactatcgccccaaccaaagtacgtatcattttctttaccccataatgttcccttatgccttttccagttaatctcctttcccctaaggcaaccattattttgatttgtcacaatagattcattttacctgttcaagaactttatataaattggatcatacagtatgtactatgttgtgtctggctttttttgtttgtttttctcatattgttgtgtgtattagtagtttgtgtcttctttattaccaagtagtatttcactgtaaacaacagccatttaaaaaatgaatatttagacatattttatgagttgtttctatatagtggagacatcttaaaattgcagcaactcttgagtttaacaaatagttgactgtcatcagactttcacttttttactacttccctgcccaagggtgctggaattccccagctgtgggctgaatgcccatcccaaattctcaggcttctgggtattcttggttcacatcctgaacttcagaaggaatggtgacctccagttcactgagatggtttagaacatcttaaaacttttgctatcctcacttacgttgtgaaactgttttgctaactggaaggtagacgtgttgctgtgtacaagtgaggattctgaaacaatacgaaggccttttcagaaccctgtggaatgacctgaaaggaactttgtctttgagcgtctcctgatgtgtattttcgataatgtatcctgccctcagtgtttttctctgtaggttttaaaggcctcagaagtcccagaatggttctggacctgagttgctacttgagaggatcttgtaatcctgctggtctctagatacctttaggacagaagtgctgggtgattaggttaataatacttattctttattaaactatttaaccattataagcaatatgctaagaatttatgtacattaatttatatataatctaacatcctgtttatgttaatactgttattattcccacttgctagctgaggaaactaagcctaaataacttacccatggttatacaactcttgtgctgtgatgggacaaggatgtgattccagatctgacatccagtcccaccaacattctattctaagtcccacaaatactttctggacatctcctcccaagtataaaatagacagtgtggtaatgtacatgtgtttagtattgggtataaaatatccagtgtaatataattgttaagctattgaatattatgaaaagtataaaaatgtgacgtgaactggagcctctaactgcattgaattcttttcatttaagggtcttagaacatgtgaaaaggcagaaaataataattttttataaagaatagtagtaagaactgttgtgcacattttgaaggtgaagattttgagacaagattctttaacttttccacagcaatatagagttagaagaaacctagactgtctccctgtgcctcttcctctactctttcaaatcttctttttctcttatccaagccaaggttcaaggaacattattaattgttatcttttttacctgcaagtcatagacaaggactagagaaattcttgtatgtgttaagagtttacctaagagactattatgacagcagtcaggaatgatttctttaaagtatgtaaatgtagcgtcttcattatggcttagatttacaatgctgacgactttgtgaagcagagaaagttgaagagttaggggctgctttacgaagtgtactttggaacagtttctagtttctttcaaactttgaattgaaagagaaaaagcaaagtaagtacctaaatcagcactagccaaaagaaaagaaagagaaagagaaaagaaacctgcacaaggcagcagctactctccattgggaagctcatcccctccttgacagttgctgggctggctgtgcaatgtttgatatgtgctacttatttactgtctttctgtttctctcttgatgctcttagactgacactgtgttaactgtcttatgccactgattacatctttcctttcatctttgttatgactagtttaaaggataaatggtgattttctataaacacaatacataagcttaaagaaaaagatgaacattttagagaatttgggattattcagaatccctatgactataaatgacttagcatatctagaatgcaccgagttgatttatttttttctattaatagtcatcatgattagatagtaccagctttaattttaagttttgttgcctgtgaagtttattttcaatgctcaataccatccaagagagaatcttgtttaaaaattttaatcaaaacatatttaaggtgcttggaacctaagggatcacttgattcaaccttgtcatttctctgttcatcttgcaataacttgagggggccacctaaggttattctagatatctagattcttttcctcttcttgccccttgactccattgataaattgagaatgaaaatatctctctggaatatcttttgatttggtatgtataggaaactttgatatcattgtagaaaggcagaatagaaataaaagatatttcaaagtcttttgatgtaggttaccatttgtaaatctgtgaatctctgctttgacttcctgaaaggttatcagaaagctcttctaaggttctcttggggtacttattacaggcgtataggtgtagccctaccccattccacacctcccataggttcttctgaaagtttatggtgttaagagaactcaagatttttaaaactggctacttgttcctattgttcttgaggaaaattgtgctgaagacagctgtttgaagatttctttaatataaaatctttaatcttaaaccatgctgaggaaggtcagtttggggcagaaaaagagccatgtatttgtcccatttactccagaagaagctaaaaatgatttttgaatagcagctacccttataagtaccaagaaacatcagatgtgattgctgcttttcacatgcttagaatataatttctccatattttttcatgcaaaaaaagcaaagaattctagaattaaaaataagagggacctaagatcatatatggtgcagctcctaagatgctacaccataaccagtgtaaaagttgaatctttgctggagggggctatgcgtggatatttttttcactttccgtaggtgattcaaatgtatagccaaggttgaaaaccaggaatgtggattccagaccagcctttcttacttatgtttggggttgctgagacttacagaaagtaaaattattctgtgagtagataactaattatttgagacccaaattctggtctcccagaatttggtacctcatttttttttttttttttgagacagagtcttgctctttcacccaggctggagtgcattgtcgtgatcttggctcactgcaacctccacttcccaggttcaagcgattctcctgcctcagcctcccgagtagctgggattataggtacgcaccaccatgcccggctaacctcatacgttttaatcccaaattaatgccagctctatatagaaaagacaggtctgtgatcattattcatctgtgtagttttctttctactgtgataatcatagctcagtttagggagcacttactgttggcctggcaccatgacagcagttttacagggttactttcttaattaagtatactcatattctcgtttcacaaatgaggaaacaggcccaaagagaaagtaacttgtctacatttttagagcaagagtaagtggaggtgctggaattggaaccctgatagttagattccagaactgtgactcttgaactacttaactgtaccttctcctagaaggatttgattattgcttttcattccaaaacaaagttttgtgtagactatttaagccatagggactgtagactgtattttgaaagccaaaattaagaaaacaaaaaatgtggccccaaggcactcactgtttttcttccttgattcttgaatcttaagacagcatgggatattagtgatgacagtcttcctactgccaaatggacgcttggccactagttgtagatttgcttcaaagattttgtgtcctcagaagtgaaagaaaaattttagtgaggcacatgctgtgggaagggtggtttggtcagtggttttgtagtatggtttgtgttgttttctcagtgtggagaaaataaggaaagctatatagtaaggaagaatatgttaaaatatgtactctacctttcaaagaagagtccagggtgagtagcaatgctagtgccacctgaaagaactttggagatgtttcttaggtcagaatgaaaagctgttgcagtattgcctaaaatagaatttataaaacagaacgctattgagacttgttaatgtttacagatactgttttctttctccttttccttaaaaaaatccttatgtgctcactttaaagtataaaagtaaacaacaaaacttgtattatattaggtgtaatttcaaggataacgaagtggaaggagcatgttggcaaggtaattttctagtatcaggtgagtgttttagaagaagggtcactacttattttggcttatagaacatgatggtaaatcagatgataaatgttgcttaataacttgctgcattgggtgtttactgaattgcgaaggaaaaatctttaaccagtacgttagtagatatttgcctgtgacttttaattaaatgttaacagcaaacagaaaaatggccattccattaaatagcatcatcttacatggtattttgattatttcttggcatcttccaaaaaaagggaattctcatgtgggaatgatggctgtagcttagagagaaagagagtttacatatttgattacatatttgatacatatttaacatggccatatctttgtatatatgctttatttcatttaatccatatgcccccattgaaatgtaacatttatttggactagaagttttggaatcttagctggaaccactgatttcagacacttatgtgatagcaggattgtttagtccaatatgtaatttgcatccgaatactttattaatctagaaatttttagtggtgaaattaagttatcttttgaaacagtctagcaaattagactaaacaatcaggaaattaattaaatagaggcaacagattgggatagtaaacctatttgtaatattaataatagctcactttaaaatatctgagaaagtgcctcagcaaatttatttggtgtagatttttgtgtttcccagacatgggaaagggaaggttcttgaaggagagaagaaatgtcccactcatctgaccacttcctttctgttataatttaagatcttttccatgattttattttaatcttctcactgactttttcaatgatttacaatctgaagtattttgaaaaattatcatactgtgcatactgtacatagtgtgattacttttgtgcagggatttaaaaaagtaatcagtggtctttctttgagaatgaacttttctggtaatgatttctacaacatagaacaaagccttcattctttgtattttccagtagttactttatccagtaattctcatgcatttctctgtgagcatttctaaggtcttgttctgagggtccaatttcctatattcacatcctggcacatctgtaaatgctcacagtgatggtgtcttaactctttctagagctgtgaacgtactgcttcttgagttcttagacacctctctttctaaagtaacaggatcctagtgttagtttcactgtaagaactgaaatccagaacctggatgtcctgtgaccacaaggggcagagccaggtcttggttgcagctgttctgatgcccagtttggactcttccctagctagtctgttatgctgcaagctgaagtttacaaatttgatgcctcctgttggggtatttctgaagggtgtatagggttatcaaacactcttaaaatacatgcctaaggtcatgcttaatgtatacggcaaaccatccctcacagtttcttgcataaacttgaatatgttctacatgttttctcagcctaatagaatgaccgcttaattgagttgtataatttgaaatgttgaagtgcaataagaacaggaggactctctgctttctttggaaactattaaccagtaaatgaaaatttagttgaaaactagtagttaataattgccattttctaacatgaaaggattttatccctcatgtgttttgttaaacattgtaaaagtgtcaaaattagctgaactctcatgtatttgtatttaatataatctgtttagatgatctggatatgaaatgtgataggaatgatggttgtagcttagagagaaagagagagagattgagaccctctctgaatatttggtttctggatttaatcaccaatgcacttattttattactcttggcttttgtagtctgaggactttgttttcttcttttgcttaattttcttaacctgaaatgtgacttggcaaaattaaggacagaggtgtatcaaattctttgctagtctctatttttttttttgtgaagaagagatttgtattactacgttttatttataatctttagaagagctataatagaaatgggttcatagatctgtaaaaatcaaaatcactcttaaaaaatccctcaagctgtctgtcactaatgggggaaaaaatgtaatccactttggagatttttttttttaatgagacagggtctcactctgttgcccaggctagaatgtagtggtgcgatcatagctcactgaagccttgaactcctgggcttacgcagtcctcctgcttcagccttccaagtagctaggatggtaggcatgcatcaccacacctggctaagtattaaaaaaaatttttgtagagatggaggtcttgctgtgttgccgaggctggtctgaaactcttgggctcaagcggtcttcctgcctcagcctctcaaagcactgggattacaggcatgagccagtgtgcctgacttgagatttttttttttcctgtgttttcacatgtgttgttgtaaggttcatttggttttgttgttattgttgttaataaggacataaaaaaatttgatatgagaattaacgaagaggcactaacataaagataatagaaaagaatatagtggtagcattcaacagtggtgtattgagattgcaattatttcttaaaacttgaaatcatttttgaaatacatatgttagacctatgtctacagaaacaaacatgccagacactgagcttttcttctttctagatgttggtaattagtaagcaaatgctaaaatttaatattagaataaaatgaccagattttttccattgcttaacagagaccaataacaacattgttatgaatataaattttcattatttctgttattgaactaaaatttggttttgataaaatgtctcctaaagtgtcatccaagaatactttattaacttctgtttttaaaaaataagtacagtaatttttttgataacctcaaacttattaagttcacattaaggaaaagtttcttttgagggaaaatagcctattacacatgacatcctttttcttcttatgagagtttcttaaaccttggacttttagaatgtattttcaaatcaataataattgaatcattattcttacattacattgctatgctagacattattactttctaattattatctttaacttttgcaatttatattatcattgtgtttagatgttacattccctactgagaatcataaatcctatccagtggttttaagtgaggcaatttatgtgcgtttagaaagagactcaattttactcatttaaaataaatggagagaaggaaacattaaaaatagtattatcgtactctatttgtagtttgccattttctgtttagtgtattttcgtagatgaaggtttttttttcttttaaaggttgtctatctctaggactatagttttatgagtggaatgtcacataatgcatgataacataacctatatgtaagggttttacaggtaattagagccatacaggccatttgaggggtacaggggagaacctgagcctgaagaatcatgtgtaggaaaaatccttgtaatcttaagactttttttgggtgtttaacttactaaaatgtcttaattattaaactttcttaatgctggacagttaggagaatattaaaaaatataaaattatttttatccaagttttctgttttatccagtaatcagtaatgatctgccttgattcttcaaagtactattgatgaatttcatttgagttgatttagaaacaactttgttgatgaaaagtttgcttatgtatgtattttcaacatttttatgtctatgcacttggtttcagatgagataggaaatggaaataacaaaacactgttagaaaatcttgtttctgtagacggctcaaccttgccagaaaccacgaggcagtggaaatatcacgagaaagcttgttcctacaagactcccagactgattaccagaccaaagaagttcccagaaatttagcttgaagcaatcatttaaaatttaggaggcggatccaatcctgctcggagtcatccattgctaattatagttgcctatgatgtcccagtgattttgttatcagccacacctaagtatatttctgattttttgcatgttccctccaaaatatattcttgctgggcacttaaaatctgtttatttcactgtatgtatattacaccacaatactgttcgcattttgaatctatgcatttttttttctttgcctgatatatcttgttcaaccttgatgagacagatggctttttttcttttaatctagtttcatttgtatcttaaaatttctagtagctggggcactctcctcacccaggtgaggcctgctttgccctacaggtgtgttagatgcatggttgtgtgtacacatctttgaaatacatgaggctgctgccttttagaaaagttactgtttttgcttttttttaaataaatattttggccagcctcagaaatttagtaatggctttgaacacttggaattagcatgataaagccagagtttattatatactgttgtgatttaaatcacacactggttattttggggagttagagcaatctacttgacacagacaggtcttccctggcggaggcttgcccctgcatgttctggatagatggctttgatgttgggtgaacatcacaacttgaactgctgtgtttacactgtaagaatgcttgctgaatctctcactgcatctctcacataattccaacttcactttagttctgaatacatgaacagtaaagggggcagtttgcttttaaattttgcttgtcagttaggcactttaagagtcttatttctttatgtgatttcctgtaagagctcatatatggggattgttattgagtaattttgaacacaaaattaattctataccctttgatgtggctaataaaagccataagggtatggtaggaaaagaagataagaagatagagaaaaaaaaattgcctctttctatatggcaagaagaagaaaaaaaaaattaagagcagttgtctttgaaccacagcagggtttactcttaagggtcttctagcttgtttttcccattagctaggaaagcactatgtgagctttaaaaaaaaaatacatatatatatatatttaaatcatggaataatataggacaaatgatttaaattgaatctagattttgcatgaacactcttctagtttattggttaaataaatgctgtagtttcaaataacatcccacctgtttgccttgtttgaggatctggtgagatgtagaattccagtagcttggctaaaaaaggaagaaataaaagatagaataacctggaagttctccacttcccttcaggtattttcttgttgttctttagatttggaatctgttactggattcttctttcatccatgcttcatggcatatagatatgtaggcattatacaaaaagcttatctagctgggtgtggcggctcacacctgtaatcctagcactttgggaggccgaggtaggaggatcgcatgagctcaggagttcaagaccaccctaggcaacatagtgagaccttatctctacaaaaaattaaaaaattagctgggtgtggttgcctgctcttatagtcccagctacttgggaggctgaggtgagaggatcgcttgagtccaggagtttgaagctgcagtgagctgtgattgtgccactgcactccagtttgggtgacagagcaagaccctgtctccaaaaaaaaaagaaagtcttcacctaaaaacttgcatcttctagaaccatgaactatggatggtcagaccttcttatttttatgttagcagatttttttttctgtagataatttttcagcattatgattatatgaccaacatgcgaatgtaatttcacattttagcctttgagtgtctgctggttcactcatcttaacagtctccatattctaaaattctggagtagtccaaggaacattcctaagattattttgccatatgctttgtgcagattttgagtctttttcaatcttaagtttaaattgtttccagtttctgaatattaataaaacaaacaaaccaaccctcttaatgtatcccctgttctacacattcccttactttttgggaactcttttgtcccctgccctcaccaccatcctaccctttgccatatggagtgtgggatgtattgtttgttaggttttaaataagcaaatttgccttctctgtgttgaagaaacctttacttttaaaaactgattatggcctctaggcaccaaatcttaaacatttctgtagcttatctgttgagtttattatagatcgtatctagaaatttatttagcttgtttgagttgccaacaaaagttggccaagaaatctgtataatagaattgtctgtccaattttgaaatatgacttctaattatatcttttgcatacacacaaaaatctgcagtattaatttgagctctgtcctaatcacaattattttttgttactttccagtaaaatagctttttcttgtaaatttttgacataaacaccagaccacatttattaaaatgaaaaaatacttgctgttatcaaggtattcaaaagtattataaaatattaaataaagttagagtttgtggcacattgactaacaaattttatctgacagagaccaagaaaaaaatacataaaattataaagtaaataaacaaaatcagtaatttccacaaacaagtatgtttatgcaggagcactgttaacctactagtgttcagagtaatttctgaatcaagataatttctgatggtgcttttaaagagtctagttatcttgtaactaatatgacatgggattaaagttaatctctttttaactacagtgagaaaatttaaaagccttggcttcatagactaaatacctgaacagacaaattgctgaaataatgcagctaagactgcaagagaaactgcaaaagataccccaagttatgtttgttattaagcataggttattttgaaaataggtttccatatggagtatacggtatgtaatttatacagaccacattactaatagattctgtcaagtggcactgaattcaagctacaatgtccataatggaatatgtaaggaaattgctggtgttattgggttggattaaaagaaaaaaaaaaacacctttattagtatgtgttccccctcccctcagtgtacactgcttcttgggctcagactttggggtttaagaatgaggtatttgggccgggcgcggttgttcacgcctgtaatcccagcattttgggaggctgaggcgggtagatcacaaggtcaggagatcgagaccatcctggctaacacaatgaaaccccatctctactaaaaatacaaaaaattagccaggtgtggtggcaggtgcctgtagccccagctactcggaaggctgaggcactagaatggtgtgaatccgggaggcagagcttgcagtgagcagagattgcgccactgcactccagcctgggtgacagaatgagactctgtctcaaaaaaaaaaaaaaaaagatatttgaaggtctaattataggataaatttggtgactaagaggttactcttaataacaataatcatatttggtttacctatttgtcaccagacagtatccagacttcatgtgactaatggtgacaactgtattttgagaaatttggaaaatcacataagctgttggtgatactttcaaatcagaatgttttaaatagcggacaaggtaaagcaagctcagaacttaataatagaggaatagatacagtatattgaaggaaaaaaatacattgacatttgcaaagagaaagatgctgtttctatagcatacctaagtccattgaatttgcacagtggacaaattgcaattggggaatattattcatataaatagtcctgtcagaacacgggatgagtagagtcttgtggaacagtttgtttagagaagtactagttaggaatcacttgtattagctggtaagcatcaagagaaacgcttggatagggtagtttaataaacagtgtcagcacatttacatggattgtgacagttttatcttttgctaaatagcctagagtaagcattattttagcatgttatcaaaaataattataatatatttggcacccactgaaattctgacttacctgttggggtatgtttttggtaattcagaacagattgattgaagaatcttctttaaaagttgcattttagatgttttctttgggtggttcttgtagccatcacagaaataaacataccttagtttgcaaaccgctatttacttggatctgaataggaaacattgtcacgatgttacgatatactgtatttccggataccttaacaattattagataaacacgatgaagatggaaaatattgaagaaataatgatattataaaaacttttgaatggttttagttgaaaacaaaccaagaatatattggtatagacataattgcaaagtagagctaccgcactaccaaaaaaagttatttgaggtagttgctggaagcagaattttcacggttagaaatgcttaaaaagaggctcttttaagtagaaaagaatgtgagactttagttattgtaacagtaggcttcagagtagccataaatgaagtttagctggagtaagactaacagggttttaatctgttgtttttctagttaaggcttattaataacatttatgtatggccttgttcatttgtgcactgggacagaactagaaccttgggctccccattttgttctttggtacagggccatcgtatttcagtaaatagagagttttttctcttcttagacgtctaaacaatggcaataatttataactaactgctcttcgttatgttgcagaggcaaattgcgcagaaaattatggataattttaaaaagatgaaatacaggtggctcatctaaaacagactccaattaaaaccacattgtattaaatagagcctgctttagataggctcctcttcatgctaaatatgaatgaagcaacaattttagatataatagctggtatctggattttaatatgatcagttctcatgcttcggggcccaaatattgccagctggtattaagaaacctaccctcctataaaactcgattatattgttttccctaagagtattgctttaggaattattgagaaagtggtttttacagggtatagacttttgcataaaagttggtgctaaaatttgactcatcaaaatttgcatcacactcttgcatctggaatattaccagatggcgttaaattagaccttgggatgggtgtctcattcagagacatggcagtctgtactcagtgtaatgggtgagcaaagatgtgttctagacctaagtgtatgctgtctgcattatggcttatataaaatggccacatctgttattttatcaagagaataagttttctaagttttggttggtctgatatgctaatatctgcaattagcagagccttgacaaattgttcccttaaattaagagttcatcagtttggcagaatgtgacctgataaaatgatttgggaatatggtgcttttacatacacagattttttttttttcccgttttagtctttcttagccatcagactccagaagatgtacaaggctatgccagtttttttgtttgtgcttttaaagaaattattaccgaatgtgggggatccacggaaagtgaactcctggagggacagaggaggagcaagactgtctgatcctgagatctcagtgcctaaaacatagaaggggttcagtaaatacttgtttgaaataaaaataacgattaaaaaaaaggagggaatagttcctaccatcatatgcaagatgacatgggtagtcctgactcttctggagtaaggagactgagcattctcactgctgaattaggtgaagggaaacttagaatctccttaaaagggacaaacaagaccctacatgattggacctgccccttaccctgtctgccattcttgtcatttcttgcctcagccttattgccccagcaacacagatcagctggtagttctttgccgattttgtgctatttcctatcgtggaacattctcccatgttgttctccctagtccttatcttgcctggttggctactaaacttgtatttaagcttcattatgttctgtctttttttctgaagttgttctaaagccctacctgagttggtgccttcttctgtttctctggaaatctctgtgtgtttctgctcttctgcacaacgtgataaattatttgaattttctccttcactagatggtttttatgtcaagatgcttttccttatatttgttcaaacccaaacattggacacgatggtaggccacggaaatcagttaataagtatttgccaaatgattgttcataccagccctctcagttgcagaatgaaaaactttgaatgcttctttaataataaatcttcttgactattggctgtgattctaagtcccttgttataggagtatggttattaacctagttatttctgccatgtttcaatgtggataagcgtatttaacagattcgctctgttgcattgatcctgtgatggtgttatatactactccagtgccctggactgtgcgctacagggcagcctctagactttgggattaagtaatggtgattcggtgggggtatgggttcttattttatgggagtgttttggcaattaagtgctatttaaaggtattatttttgttagaaagataaggatttagatctgtggttcattaattatgtaaaagttgaattagcaaaggctagtttttggctcaaattatgaaagaatactcttgggaaactgggtatcggggagaggataagtaagtttggttatttgtcttgagattttatagagaacacacacgtaccccataaatgtagttttaaagaattgttcaaagtaaatcaatttttgattttaagaaaagctccaggccggacatggtggctcatgcctataatctcaccaccttgggaagcctaggtgggctgatcacctgagatcaggagttcgagaccagcctgaccaacgtggagaaaccccgtctctactaaaaatacaaaattagctgggcgtggtggcgcatgcctgtaatcccagctactcgagaggctgaggcaggagaatcgcttgaacccgggaggcggaggttgcagtgagccgagatcgcaccgttgccctccagcctgggcaacaagagtgaaactctgtttcaaaaaaagaaacgctccacatttttaaataatacacaggttttgcagtgtaactactggtgaggaccagaaatctagttactagatttcttaaaaataaaatttctcacactgtttaaaaaaaggaaaagaagtacacttatttttcctatgtgtagtttatacatgctaaataaataaagtttagaaaatggaatttaagaagagtaaaagcatcgccaatagttccttccacacaggtgttaatcattttttgttttcacttgtcttttgtattcattttaaaaatagaggaccatattgcgtacactgctttgtaagctgctttttgcttatcaacattttgtaactatctttccatgttattaataactgagttttaatgcttttatcataatttaatcataattttggctcagccatattagctctttcttgatagattttactgtgtaatttaataatccagttttggacttttcccacttagactagtattctttattagatttaacatgaactaagtgctataaatgagtcaatatttttttaaaattatatgtctgtttatcagtgtactgtttcaagtctatgtattagttaagtctgttcttcaggcttgaacataggcatacctccttttattgcacttggctttactgcactctgcagatactgcatttcttttacaaattgaagcagtggcagagtttgaaagaattgactccaattttgaaagaagtcctagtgtggataacatgctatccaaagcatcaatgctacagagaaatcttttctgaatggaagagtcaattgatgcggcaaaccgtctattttatgagtagacaccacagccacccgtcttcatcaaccaccaccctgatcaatcagcagccatcaacatctaggcaagaccctctgccagcaaaaagattacacctcactgaaggctcagacgattgttagcattttttagcaataaagtattttagatgtatgtatgctgttttttttagacataatgctattgcacacttaatagactacagcatcgaataaacaaattttatatgcactgggaaaccaaaaaaaaatcatgtgacttggtttatgtggtggtttggagtggaacctgagttcgtccgatgtttgcctgcagatgctcatcctttactctttccccactactgttggtgctcccagttctgctgtctgcctttatccaattgtaagcctcaatgtgatttctagattcaccctaagtacttgcccttgatcagcccagcactgaactcccccaaacacacaaacattaaagttcatttagaaagagtgaattttaggaagaaaccacagaggccaagatcttctctaattaatgtagtgaatcttctgaatgtagtgagtcttctggccattttttgagtattacattgatagctcattcaaaacgaaaattattcacacaactatggtgtaaataaaaagatgtgatgttaatataatttttggattagattattgccgaatcaagcatctttacaacattatagtttagagtaatgtgtttggctaaattaggcaataaaagtaaacataaaaggtaaaccttcccgattagtccttacatttgacttctctgtatgtgaaacactgacaaaaaccaaaaataatttcactactctgtatttatttttctgattgagactttggaaaagtcaagaatgacaacggtaggtatttcttttttgcagaacaagcctgagatggtacttaggtgcttacatacaagctactgatcacttaatgacattaaaaaaattttaattacttattgccttcagacactacagaagtttaaaaatcctactatttccacttaaatttctagaccaatgctgttggactttctttccctttaacagcaatgattatccagttgaatgttgtttcacagaaaggaaaagtgcatttgtgtaaaaatatctggggcttgccagggaatctttttcagaatgctttgtggttacaaatgaagcttattgttgtataaatggcaagtttaaaatcatagaacttttttgcagtagctcatggcatgagttgataatctgcgaattgctctgcgtgtgtgtttgtgtgtgttcgcatgcatgcctcagcccatctgtaagtagctggatcctgtgccgttcctccccctgtttcccacctcacttatttagatacataaatacgcacacttttacatctaaggcaaaccccaaaagatgcatgtggaaggctggatgtgggagagaggtgttttcctttaattgacctctcacggcgttccacttgataaagtgacaacattttctgaaaacttaaggtttttgaatgtgtggattttctccctaccactgtaatttctgaaactttctctaaacaagatggctggcacattatggggacagagcagagacatagaacagagacaaagccgccctgagaaggcagacacacttatattgcttgtggtttttcagtacagctgctttcagatgagccggcttgttctaagctggtcccactgccaaagcaagactgtcacacagctggtagtacttactgtacttgcgggaaagtatgtgattcattagttggaaccgtatgtttttcaccagttctggtcatgtttttgttaggatgtggtaaaaacacaagcagggggtgaagggacaatggaaacatgtgacttcttaaggattggcctgaacccgttattagctaaattgtacaccgtaaaatgtcctttgtacctcataagacaaatgacttaattttttattcctcagttgaggtcattcagtcataagtggtaaaaattatcaacactgagctctttttctctttttactttctgcaaagtattatgatccgtttaaaccccaaattataatatgaagggaagtcatgcaagtaaaagacattaatttgctgaaaaatgcccatgacgggtgaagaactttaactggagtgaactcttgctactgataaaatatgagtatggtattacagctcataagaaacacttctaataccacagggtgtgaggagaacaataaatgggagtttctttgtctacacatgatcaagcagactcaaattgtatggctggaggattgagagactagtcttttaagtaattttggtgtcattaatgggcttgcatcacagtatctctgtaatgctcaatcctggtattgtgcagaactgctggtgtgagccgcattgaatattggcctgttatcaccaggtttttgagcttgtgaatattttacaactgcacaggccgaaccatattctttggaaaatgaatgccattgctgctgtgttgtgttctccttacataggaatatgctttgacatttgcttgcttctgcttcattctgacactggagttgttttacttttgtccccactcccatagcctgctattgagacaggtggtattttcaaagtctaagtaaaatattggcagattatgcctctaccctcagactctgtttttcaactgttcccttctaaagttctgcaccgttcatgcctcactacatacactccagcagttgctggactctgcagaattagaaccaggtctgtctctgacaattagctcaactggctgcaggataaataaaggaatgcgctcaggggctgtagtctgtgacacagtgtaacagagcgtaaaaaggtgcatctgttccatgccctgattcagtcgcctcactgtcactgggaagttaccgacacggagacatgcccgtgctgtttggtaaacaagcggcaggtattaaattaacagggctgtgagtgtgcaaacgtgctgctttattaaaagccctgctatcttggctcactgctgggtcacaggcagttgctagagcatctagtaagatgactcatggcactgcatacttcaataccctgttctcgcttccttccagaggggaccgttgacatttgagagcctgattacggaaggaaaaaaaggagaaagaaaagagaatacagggtgtgtgtgtgtgtgtgtgtgtttgccttttacgtttcgtaggctaggcaagaaggagatgagggccagcaccccagagccaggttttagtttaaattgggcttctgaatccaatactaaattgcaaccaggtctctgtctttgttgttgtttattttctctgcctttctgtctcaccctcctcatgactgctacttgatttgtggttgaaataatgaggggataactgagagatgaaagttttgctctgtctgcctgcactgggtgggcaccatgcatcttgcaaatgtacttgcaggaaaaaacacttcgacttttattatattctttaagcatttatcgcctttgcatttaatatttttaatgaaaaactcgcattttaaagactttctgctttcattcagcaatgtcatgatttttgaagtttgttttcccttcagcttcaggaatgctttacacagggtcatgtgtggttgccttgttgaattgttcctcacttttgtggtcttatctttgaggagtcctctttagatataccaaggtctgtaggcaaacattacaagacaattttcagtacacatgtctgtgctaaagagactggcatttctgaaggtttcctgctcccctccaagttgtgtttcttttaagggccccaactagctcctcatccattagaagatgatgtaatgctaatggtatctagctccacacagcttggaccaaaaatgattccagttggctgtatttgaatgtgaatgaccagaaggtgctagacattctccactgtaattgcaagtgcttaccttggaaatctcttttggttgtagaggtcctttggtcctcatactagagatcataccgccacacatgcattcctactgtccagacccatctttattgttggctgtctttttatagtgatgtctaggtagaggagtgcgatgcccagggtcggggatagggagggtggagaggaagcagcctttctcattgtttgctcagaaaggaaagtatcccactatctagagagttagtgatgcctcagaatctctttatctttgtaacctcttttctgtatgaagtttaataagccggctgtgcagtttttaaaacgccagtggattccgcttttcacttggaccgccccccgccttttgctctgagcattcactccctgtttccttatttcccccgttctcttttcctttatctcaggggagttccctgagtagcaagactgaaaaagagctgaggtttatgttagaagaaattaaggttaatgatcattggctcattttcatattctgtgggtgtggatggaggagtaatcagtgcaggtggccctgccagttgggagtttttctttgtcatcaagaaaataaggagagtgcagggattgaattaccacaactatttcaggactaaacatatttcatttcccgatcgggtctggtttaaggacgcaaagctgacattaattttatccaaagaaagcacagcattttttttgtttcataatttgactaatgcatagggtagatgcatgttcaaatttaattctagtataatcttacaaataattctctgaaaagcaaaggggttttgattcagtttgacagtttatgtttctgtgtccaattaccacttagttattgaatgttaaaaagctgctttctaaaatgtgcactccgactgcaccaattggcttcccagctgcctgctattacatgcgaggtgctctcttctaactttttaaaggatgtacacagttgaagtagttatgtttagctagcaaaggaagtgggggatttggttaggaagtgcttgctggccttgaaaaactatcatgtgtgcattctcatttcagccacataaagatcattctttaaataaatacttgttggattaaaaaaaccttaaatgctccgataaactagagaaataactttgattttttttaaaaacatgacttccatttggatcaactttttaaagttttcaatatgcttttaataccactgatgtaactttctacaagtgaggtattctgattccatgcttggaaaaagaagatctacaggttgaccagagacaataaaagtcattgaggaagagtgtcaacacttgccatgcatggtaggttttgctttcttagcggaatgcagcagacgactcaagtgacctgatctgtttttaaagcacaaggtttatttggctgttacagtgtgagtataatattaatgatactaatgtaaaattaacttttatgttgtgtgagcagtttttcttgtttccccctttaaaattgcagatatttccttgtgcatacatctggtgttgttgccatagtgaacatttatataactttgtttaagccatgaaaagtttggtataatcgggtagtttggcaagtccacgtgaaggtggttttcggttttcatagccctgtggtatgagtccacatgcagttgaatattcattgtatggccattaatataaatacttcgtctagcttattaataacacatgaagagaccatgcccagacattcaaagggcaagaatgttttagtggtttctggaagctccttgctgtgaagaaataaggcttttaaaaaacattgtagtttagagttttgaagtagcactttaaaatattttaaaatacatttggtatatcttaagaaattcttgactaggctaaaacttaatattgaacgaagtgatcttttgagatcaatatgatttccaagtttgacatttaagcaaatcatgttctctgttttaagaaacattaaacaaggagacaaaaatacacaatacatcagtttctaaggtaacattatttcctaccttctgctttgctttttactgaatcctttttacctttcctgctactgatagatctcaaaactggcctcacggggttttcccaaaggcttttggaaagatccatttactttatgacccacatacatctggtattagagcaactatgaattaatccagcctcacttcagtgtttatctgttatgcattaggaatatttaaaaagcaaataatttaaactaatgtttttcttgcatgtaagttagatccttaaaatcagctacacatcatattaacttgaaatttttaaatagtcgactgaattgctttacaaagtgtagttgtttaagccattctgatggttttctctgcaggctccttagctttgacaatactgttctactccttcacttgcatctacttgttagtgccttttactttggtcttttcgtttctttagaaagttcttccttttggatacatagaatataacgtcatttattgatctctcttttctgctacctttgtattagaattttaaacacgtcatgacaggaaataattcagtctggtacaatatgccctctctctcctagtttttaagtcctgagtcttgtatgccgcactttcaatctctggtggctaacctgactactttgtgtctcgtttactggaatacgtccataaagcaaggatacatgtgtgtcttacatgtccaacaacgtattccaacaaaggctttcagtgagccaggatgtgtggcttagtttcaccatcattttggtaaaaatacatgtattaaacagatactgaatttctgacttgcatttaatcttctcctcctgttttatgttttctttctttgattcagacagcaaactgattcaaatcttcagtataacctataaaaccaaaggtttattaatattagggtacccagagaataaagttgttcatcgttttttaacagtagagaaataaaaataataaggtttttttagtatataattaagcacttaaattgtcacctgaaattgttgttctttacatgcgtttcccttagccctttgtaattacctaacactgccagttagcgccagttgtgggagcaacaggcttctaaaaataccctcctcctggcctggccacccacctaagaaccatgtgaagaggtgttttgtgaattatcagaaagttaggtataactgatgcaatctgtgcagctatttctgtcaaaaattgtgcctccaagagggatcagctacattatatcttgtaatttcagatacactttcttggatttagtggaaaaaccttctctgaggctttggtaaccttctgaccaaatggattgcaatcaagtgtacctgtgatagtgagcttgaattcacaaaacaagcaactcgattcattgctttgttaatccacatccacttaaggcatagatattctttatttgatacgtcatcttggtttattcatcatgattagtaagtttgtctacattaaaaatattacacaaatcctgaaaaattttagtctaaaagtcatcagagggagctataggttcttaaattaattgactaatgaataaaacctattttcctattgggtgttcttcactgcttcttttagagtgggcgcagatgaaaatgaatcatggagtttaggaatgaaagtgtgaaaagtaactagataaaattttataatttggggagctataaaatttagaatccatttccttgattttcatccctctcatttggaaatgatgaagctcaggaggttaagaagaccacggtcatcacaaccaacaagagattgaaatggacaagaatcctagtgtccagaccagtactgtgcaatagaaataattctgcaagccacatatgcaatttaaaattttctagtagccacactacaaaagtaaaaagaaacaggtgaaattgattttaataatgtatttcatttgacccagtatatcaaaaattatgatttccatgtataataaatataaaaaatatataatcaatatgagtgtttatcgagacattttcttttcttttttcattctgagccttcaaaattcagtgtattttacactttcagcacatctcaacttggactagccacatttcacgtggtcaatacccacatgtggctagtggctaccatattggatggcttaggtctagacaccagtccaattttctttccaccacagcagtgtagtagcttttaaagggttgacttggattttcaaagtcttattttggttaatttaggagacctggtgtctttgatatacaagtgaaaaagtaactgaaaccttatataagtcgttataatagaagcacattgctctagaatcatctttctcattaacatttttgattccttggcaaatgcttagtaatacttcaagtaaatattttcaagttacttgtagacttttttccttcgtcactttactccctgtgaagccatactgtctcagttttgctaaccacagacacattacaggcagtgttgtgggagaagaaaaagtttccctctgtttctccttttggaggttgaaggcagtataccctggtgctgccctggactgaggctgtccaccatctgtgtaaggaattcacaatcccagacaaaagaaattggcaaagtcttccctctgtctgctctccagatcctcaagatagccataaaacacctggacaaaatcagcaggtgatggcaagggaaaaagaatgatcagtcacaggcgttgttgaatcctttgaacattacttacggcctggacattgctgtcaccaggctcaatttgatcttgggtgagttttctggaagagctttattccctggctctgtgacaacagcggaaccagataacattgtggatagaggagagaagtggaaagtcgaggtttccctgccttaaggtatagcagttccaggtggtgttacctctgtgtgtgtaagaacatcctacagaaataagtcatatcaccagatgcataaagtgtgctatttagatcagtgttcttactgtaatcctgctcaaggagtttaaatattcactcatctacttatagtttataaattgttttcagaatgatcagcattgttcatatgctgaattttaaaatgtagtttaaaatctgttttctgcacttaacactgaaaaaagggagttggcactatggtatttataggcttttacaaatcttttcttatggtggctctacataagaaactttgctacatactcattttgtgtcacatggtttgcttccatatcttttgttttgatgctgtatgtagaagtttcagtagctactaagtcatcatttgggttgtctgaaatttttataatgatatcagatggtggcagaattgcatatcatgaagtctggtagtgaaggggcacatttttaatggatcaggaatttagccatgaagaaataacacttttgccagtaaaagctccgagcaaagtccgttagctgttgcctctttgtcagtcagtaagagagtttaatacagtggtatttagctttctttgctgctgccagttttaagggtcatattttagctctgatctttatttccagtgagagggctaaaccaaagcagaagcagcactatttaactcggaattcagaatgattttttctctccctttggctctgtctacaaatgtagccctttttcatatcaatggcgtcaagcttcattgaatttagctctgtcttgttaagtacattaatgctgtgttctgtcattcattacatgagaattagttgtctattacaaagtgggggtttttgtttggagcctgatcttcacgggaagaaggccatacgtggcttaatttcctgagtgcattgaatgctggacttatttttctgtgacttgtatgtccactgaaagcatcatgcaaaatgttgattctaccgttgggaggcccactgtattttaagcaaggaaacttaaaagagaagaacacttaccacctttcttttttaaaatcccctttcccccatgcattttgtcacatttttcagtgatctatacagtgcccttagagtgtgttacagaaagtgttaatatcttagagcagcagtaataataatccttttactcagggtaatcatgtgctaatcctctggtaagtcaaaagtattagatcatttgaaattcattgtgtcagctcagttgaaataactggtatggtgctataaacatttagagaaagggagtctttgaacccaaataataatgtcaaatagtttgttagtgttacatgttcatgtttaagggtttcataagctcaacccatggacaagagcatttcagtttacatcagtgtgtaatatattattttaactgaaggtttatttttattttgttatttggggaaagtttcttttcctctggcacttgtggactggatttttatggtacagttttcactctgcaatcacaggaagcctgctgtgccagaagggtgctttttggtattttttttttgttttttgtttttaaagaaaactatttttgtttttctaaagcattatgttgggtttgaattttctccttgctcccttctttcgtattcttgagaaaaacattgatggtgtacatatttatttttctgtgaatattttaaccaggaattttggcttcatgtttcccttttcctcctgaacagagtcacctcttccttggaatttttataattttcttgaattattctctttccctctctcactctaagtccccaggggatagagagcccttagattcttggttttagtgatctttgcacccagcataccttaggtgttcaataaagaatgctttgaattgcttcacttatagaaatgctggtaaatttggtgacttagctaaagttgttcccatgtcagaaaatgaatatttttggtgacaaatcattttcatttcttctttcctgaaagtcgtttgagttttagaagggcgccttttcttagagcttcaggactgtttgagctgcaactgttgtcctccacctttatgaaaccactcagctgttgacaaagccggtgttagagcttcagagagcaccagcacaattaattggttttctgagaatgcataacttaacttaagtaattgtgcaatcaaggctcatgtggaaaggatgagtatctgtcctttctggacctcttgttatcactccttgtttccacctgatctttgattcatagttttggagaacttgtagattcttttatcctagggtatattaagtactgtaatgtgaagtcctactcctcttttttgaagatgaaatttacagatcttgctgctgattgcattctgtaaataaagggagagctctgaacatgatgtttgatgttgtgtccctagtccgtggccatgctcgatatagctttcttcctcctggcgtcctcccgtgaacagattctggtaatgagaaggttcatcatctaaaaagcagtccacaggatagctttctctatgctgttatagaatgaactgaaatctacgtagaatagctctagagctaaaattgggtagagagaagaggtgttaaatgcaacctgaacattttttttcagggataacccagctcagagaataaggtgtccagatgatctggtttaagtcacagagccagtgtagccaaccagtccccaaggcactggcctcactgagagggtagctggcgttccattgggtatgggatcagggattattgatggcattgttacaggtctgtcagtgagggcacgtagaataggtagccccgaaagttgcttttagtcaccgtaaagtggcgctccattttagagttcagtccaggcatggctttactgccattgctgggaaagtacagcatgtcacagtggcagagaacatggactgtggagccaggctgcttaggtttgaatcctgtttccaccacttgtactgtctctgtgatactggacaggtttctgaagtgtctgggcacccaagttcatcatcagtgaaatgggataatacctacttcctgcatagctgaagttaattgtgaggatttaatgaatgtatggtgcctagaacagtgcctgaaacataataaatgctgcatacatgtttatgtagtaaaataaaactgggtgctgagagctgctgatgcttcagaaaaccattagtgaaacctaacccctggaacctgacccttcattaaggccccaaggttttactaaactttgtgcctgccacaaaaaccatacttatatgtgccttgtatagaagctcctatagataatcgtggtttttttttttttttttcctccatctgtacgtaaaatttggaggagctggctctacagggctttgtggggattctcttgggtgacagtgtagctgaggaaactctactttgaactaaaaatagggccattttcataattcttttcatattccgctttgttttctttgggtgatacattctttatcaggtataatttgtcatagaatgatgttttcaattgtattttttcgtaaccaaagtgattaattttcaatttacatgtggctaagaagatatatctgataatcaagtttagttcaaaagtaggtttttttgtttgtttgtttgttctataagaagtacctcattttgattgcagggccacggttaaagtggacttgacagtaaactgaaatttacgtttatcgatgatgatcatgaccccatatcaatttctgtgttctcaaatgcattatatggttgtctgaatagttactccagattgccaacactgtgatttaagcctttcacaaattacctgttgtaattcacaaaactgggtttcatattatctgtggcaactattttttttaaagattcctcaaagatgtaataatacttgcacaagtggtggcaactaggacagaatggttcaaaacaagaggaaagaacatactatgaaatgctatagagagccacctacgaaattcccacgtgtcagtagaacttccttccttccttcctttcttccttccttccttccttccttccttccctccttcctcccctcccctcccatccctgtcttcctgccctccttcctttccccctttcttcctttctttcattcattaatttttaatttttttttttttttgagagaggatctcactctgttgcccaggctggagtgaagtgccacaatctcagctccctgtagccttgatctcctgggctcaagtagagattctcctgcctcagcctcccaagttgctgagaccatggggctggctaatttaaaaaattttttttgtagagacagggtcttgcaatattgcccacactggtcttgaactcctgggctcaagtgatccacctgcctgggcttcccaaagtgctgggattacaggtgtgagctaccatgtctggcctcttttattttattttattttgcgagacagggtctctctccgtcacccaggctggagtgcagtggtgtgatcatggctcactgcagtctcaacatccgaggctcaagcaatcctgctgcctcagcctcccaaggagctgggactataggtatgcactaccaggcccacctaatttatttattttttattatgtagagacagtgtcttactttgttgcccaggctgatctccaactcctggactcaaatgatcctcccaccccagcctcccaaagtgctgagattataggtgtgagctaccatgcctggcccggaacattttcaatatggttatggaaacattatcaactggacacagttgcttgatttctcagcttaattggagttatcttgatgtaatggaattgaacaaatgtgaccattgagctctcagacttggttttgaattccactttttccattgaccagctatgaggccttagtcaagttccttaatctccttgacccttagtctccttatctgtaaaatggcgatataatagtaccaatcatgctcaattgtcatgaaaattaaattaattcatgcatgtgaagtatttacattatagaggaagaaaaatttattttccttccactcgtctaagttcttggctgctaactctgtaacaaaagacaaattaacaaagaaaagcatacaaatttatttaatataaattttatgtgacacatttccttcataaggaaatgaagacttgaggaaacaattaaagctgaatgtttttataggttcgatgaagaatggacagtcctggaaaaatgtgataagacaaaaaagagtatgtgctaagagtagtaaaccgaaggaaacgtagcaaggccttcttatttagattccttttgatgtccttccattttcagatatacagttgcttttttcctctgggttttgggaagggcacctctcacatgacgatcttatggcctgcttctggggaaaaggatggggaaatgtcagagagtccttgcatatatcatctctcaaaactcttaatcttaaatattcagtatgtcaaggtgccatattttggggtagcatgtcctgagctccatcaacattaatgtaaaaatatttagcctaatgcctggcacatatcaagagcttaagaaatgctgactctaaaattatgacatctaggaagatgtggggcagaattgtaaacttacctgctaaattacctatgagctgcccaccattcgttaattatggcaataataatgggtttatcatgctgtatcctcactcttgcaagcagtgttccttgtgcttagcagtaaatgttgcctaatttggggcatgctggtgtgtctgcagactgttcttgtatgtggaaaggtaactggcctgcttggcttttttttttttttttttttttttttttttttttttttttttttttaaagagacagagtctcactctgtcatccaagctggaatacagtggcccgatgacagctaactgcagccttgacctccagagatcaagtaatctttccacctcgacttcccaagtagttggggccacaggcatgtgccaccacacccagctattttatttttatttttatttttttgtagagacagggcttccctgtgttgccaaggctggtcttgaattcctgagctcaagggatcctcctgcctcagcctctcaaagtgctggaattacaggcatgagccaccactcctggccattttttttaacttcatgcatgtagctcttccatatcaccttactgtataaaagggaacaataccccagaaacctttcttttaaatagtacctggaaactctaaccttgctttctttttatttagagaaaaggtgcattttaccatgatagtgaaggcatttacatggattagatggagttttttggatttttttttttttcaagaaaaggtttttccaagtggttttgttggcttttaaaacaaaagcaatcacagtaaactgaatctgtttctcttttgaagcatacatgtgttgattgctaactctgtgctaggtactgtcttggattttggaggctgtgatgagtaagacccccatccttgctaataaggtctttatgacagtaatattatagaaagatttctaagttttggccaatggccaactatttctactagaagttcttccgtagatctcagggtgtacccctacgtctgttgcttttgtattttttcttcaggcttgtgacagtgaaatttaacatttttgggtttcaatcccaagcgttaatttctggttaatttcattcccaagtgttaatatataggacatgctgtaatttggttttgagccttgtttcattaggtttggctccaaggacacacaaaccagaaaacaacttattttcattcctttcttttgtggctgttatccatatggtactgctcatctccctcttgtgactgttacctttcttttgtaatcgagttgtctcatgatgtcatcgaggcaattaattgaaaatacactgcctgtctggaatcagagacaactcagaaaattttgcagtcttccatgacatgcccagtgacagctgtgcttgtcactatttcttctgggaaatcccagggaattgtcatagtctgctgtcctggttacccaggatttctcacttaaagctgaattggtggttggattcaaggatgcaggggcgcccaaattatggtaagaggtctaagaggctcctccttacatttacctgttgtcactcaggaaaagtagcagggggatcttcttgcgcacaatctcagtaattgaaaaatgaaggtagtagctgatctccttttcagaaaaggtacaggtgttggcgtttgttataaatacctattctgagaagcctgcacagcagtaatggggaatactccataacctgctgtccccagtgattttcaataacatgtggcatttggggccacctttccttttgactttgtcttttacatttaaaatttattaaagcaacatttttctgggttgcaagcacaaaatggatttttttcctagaagttttgcatatttcttgttatttctttaacacagtacgttttccttcccttgtgtgatctgcattttaaaattggaaaagtacactgggtatttgcttattcaaactggcacaataggcatacaggctctaataattagtcatatgcttggaaattgtcagtgttccccatggttcacaaatttaaaataaaactcactgctatcttttattttgatccagttgatttttcagactacctttctaaccttatggtcctaggtattctccttgctataactcatatgttctttgaacaagccccatgctgctttacctccgtaccattggcagtacttgtccatcttcttggatgatcttctttccccatcttggcttgttgaaatcacttaaataggtttgtcataagtgatgatggtccagcactgagctaggagatatgtgtgggtgccaagtaaaacaagacatggtctctgaccttgaggacctttgagtccagtgcctcttgaaagcctatccatcttccaaaccacttccttcactaagctttttctcattacctcaatagaagtagtctgtctcccctgaaccctaaagcattttgtttatgcctgtcttgtcacattgatcacattccactttatagtatagttatttgtggtcaggtttatctccctactcagttgtaaattcctcaaggacatatttatgtttacatgtcagggtttagaattctgttttctacatagtaggtatttgataaatatttattgaattgatggggccacaagaataaaaatccatgctaagaattggtgaggggatcttgtcatataatattttgtatttcttattcagtacagttaagggaatttaattttcaaattctactctaataaaaggatggaaaatggaaatatgaatgcctagttctctaagtttggtatgagaaagtggctggggaaggggtgggtgtgtgagactgtttcatgtgtacagtattgtatcatgaggcagatacttaatttcaggaaacagcctaatgaatatgaacacttggaaaattagttgcccattctattaattgtttatttgtgaatgaaaggggctagtcaggctggaggattgcatggtttctggaagtcggtatactaaactatctccagatgtggggagaaagaaagacgtccacattttattgcatataacactttgttgcacaattcacaatttgagcttagaggttttttttttttgcttctgttttctagttatttattttagtgttagatctctgttctctcttctacctcttacaaattaactaatagaataatttaaaggaaacatttagtaatgtgcttttattgaagttaggtggtctagttagaagaaagagactaggttatttttatatggaggaatatttgttcttcctcgagttatttattttgtttggagacatttatatgataaatttacttgtatatgaattttcaaaaattttgttaaatcaagaattgttcctttactctgcaggtagaatattttaaaattgagcttaatcattattccagagaatttgataaacacatttagtgaaacttggatggcatagccttacaagctggtcttacaagttattattttcatggctgaatgctaacagactgcatgtcttgctttatcagagtgtaaagtgagaccttttttttaccttgaatttttttgttgttgttctttatgcaatcatttaaacaatagctctggcatcacttgattgtgctattagcctcaccttttcagcaacaagtattctaaattcctatcttgggagctgcttgggaacctggatttttgtatgataaccagtcaaaaaataacataagattgatgtccagggttggatttttatgtgtcatttaaaaatggcatttgtgccacagttcactttacagccgttttccagataattcaaaatactagaaaaatccatctggtcctttagaaaactatcctggagcccttcccttcatgtgcaggttatagaaaaaactctggctggatggatgctttggtgactaatttaaagtatctggcaggacgattgatagcgcctttcctttgtgttgtaacaaatatatttcggctgcagtttattaacataattcagcacaaccacagacatattgtacatattaaagcatagaattagaaccattttttgcacatcacagtcttctcttgcttgtactttttttttgacaaggatctggataattgcttcaacaaatgaactgctgtgttcagtctgtttctataatttcataaattgttttcatgctaaaaccaagcaagctttcactgagttaatataaagaaccgcagtgtaattacaggagctgtattattaaaaagtatgacagcagtggcagcctaagtgacagctactttctccttgctttatcatgacaaattaaaaaactcttttaagtgccagggagcaacagaatttgctatatacacgtcatcttgaaaatgggtatgcactcatgactaattattttaagtgtgtgtatgatgttgtacccctggaaagactccatgtacctaatgatcttctgagtgttgcgtttcttcaactgtgaagcaaggaaaggtgaaataccatgtatgagaatgagagttaagttaccacagggtagatgacattttaaaagcagataggagttttttaagatctactttgtattttcttcactgattgcgtttaaattctgttgggccaactgatcagagactacctatctctgtttcaattcatagacccttataaccctgataaattatagtaatttaaatattttgtcagtttatcattccttcaaacttgtatctgtagtctgctttcttgtcatacatacattgttgggaacctcggattccttctgggggtatttaaggaaagatgttactcactggccgttcctttcaagttttactgaatttaattatagtggtgcatctggcaggcatgaaaaccattagatgagcaaagggggctcccaaatgccactctatgagcataatttaaaatgcttcggattcagcaatcctccttcagttgcgttattaggtacattgccttgtactgttatccttctggttgtggttacatggtgcgcccagtttttgccaccccttttcccttccctcatcactgcattgtgtgatatctatattatgttgctgggcctttcctttagaatttgtggaaataatggtatatttatccataatatggatgagatacaaatgatttggtattaagggacataagtgatttgccttcttaagagcttgtgattatcagacagaagatggcagagaagaataagagcaaaacaaagccaaacctgtttcttctattgtcaattcagtcaaaatggaggatactaagagacaggagtcctgagaggagggggtaccaagggaaaggtaagaagggcaggtaagggattcaagacctactggagacaagggggaagagcaacagttttgtcaaaaagaaaaagatcagtgatctttctggaagtccagcagagaagacctttcttgagattagtttaaattaagaactagaatagaaatatgtcccatagataaattccataaagcacactcctgggattctgctgtccaggtacctgaatagtttgtagccatcttctacatacctttattacctgtaacataaggaagcataggagatacaaggatgaagttcggtcttctccttagcaggctggacacagttttagcagttatttctatatgctcatatttagcttgttttccagctgagctccaatttttgttgtcctggagcagctcaagctttcacctttgggcctgtagattcctatctcagttcacctccatgaagcaagactaggttggtgcgccttctcttcatatcataacaccctatggtttccccccctctattggaaattgcttatttactttccttgcagctcaagcttcttgaggatactgtgggttttatactatgtatacaatccccagcacagagtaggcattcacaaaatacttgttgtagtaatgatttcatgtctgagacttttgttataaaagctctctgagcctttgaaaagtggctccgaaaggtcccctggggtgcacttttctctaggcaatcagtgatcagagttagccaagcctgctgtatcccctttcattcaaacagcccatgttgcgcatctttcacaaggctgtgttctaggtgctaaagaaacacagaaaaatcccaagatcccttcctgtacaggagactgaacttaggttggcaaggtatgatgtttaggaaccttaagtacataataaaaacattataaaatatggaaacctagagctttgaagaaatgttgagcatattgaaacttatgcatgtaatggaagaggaagtggagtttgacttttgcctatttcaagtttgcatgcttctgccgggctttggaaacagtacctctatttttcagatctcactgactccctgtcaggttatcttttcatgacatcaacttatctattaagtaattagggcatattttaacatgtaaagtgtatgtctgggagccatatattttggaaatgtacagtgtgcacctgtggtcccaggtacttgggaggctgaggcaggaagatcccttgagcccaggagttcaaggctgcagtgagctatgatcttgccactgagtccagcctgagtgacacaacaagagtctatctctttaaaacaaaatttaaaaaattgattatttttaaatgcttattttgtctaagaattaataatcataataaactttttttttcttttagttttaaggagcagggagtttaatagacaagaaagaagggggaagaaagaaaaaagaagctcccctgtacagagacagagggagggggaagaaacgtttttatttaccatttactctgtgtctatcactgtgcttagctttttaagcaaaatatttctaatgtgtacaaaattgctgtgtgaaaagtagtaccattcagttgttacaagtgaggaattggggtctcagggaaaataaataacttaaaaataggaagtaggaagtacccctaaggaatctttttctgctcatggaaagtagaggataagggtagatttagttaatcacaagctttctactctttttgagcctgccctcccctgacgtaaatttgatgtctcaaatttcttgaaggctttatttaaacagtgctttgtggtcccttctggcagtgtgactgatgcttgtaccatgggggtttttggatacctggaactccatattggtcataagagtaaattggggatcctgggaaccctgtcttactctttaaaaactgtgttcacacattaatgtttcaggagagtcaaatttattttgcctgttttgtgtttttaaaaaagagatcaattttgttaatctataagttaggtcactagagttggaactacagtattaaggggccttccatctggaagtcttaactgcctagacagggtaggaaaacatcaccttagatttcaaaaagacttaaaatgaacctcatctgaaaatgaaagcatccgtgtagcatatacaaatacattagcacactatgctatgttcaagtagagttgttaatttctctgtgtattattttaaacaagattggtaaagtaggaaaaccaaaactttttttgctttgaaaatttattctgtaagaatataataaaattgtttacttaccctaaagtgtagccgttatcaaaactctttcctttagacgtgtttagtttaaccacctgcctaaaggaccactgagtttgaattgttacagccaagtttacaagtgtggacttggtcctgtgtttcttttaaatgccacttcataagaccacccctttttttctacattccctaattattttctccgtctctccttgttgtctgtttttttctttctctgaggttttgcattacttttatcaaaacgaatcccctttttaaaactggataccacagcgcactgtggctcacgcactttgggaggccaagacagaatgattgcctgagcacaggagtttgagatcagcctgggcaacatggtgagactctgtttctataaattttttttttttttaaagtcagccaagtgtggtggcacactcctgtggttccagctacttgggaggctgagacaggaagatcgcccgagcccaggaggttgaggctgcagtgagctgtggtcacaccactgcactccagcctgggtgacagagtgagaccctgcctcaataaatgtgttagtccgtttagaagcaagtcacacattatgtggatggccgcaggccaaaggagcttgtgcagataaattcctgtttttaaaaaccatcagatcgccggccaggcgtggtggctcacacctctaatcccagcacgttgggaggcccaggtgagtggatcacctgaagtcaggtgtttgagaccagcctggccaacgtggcgaaacctcgtctctgctaaaaatacaaaagttagctgggcatggtggcgggagcctataatcccagctactcgggaggctgaggctggagaattgcttgaggctggggctggagaattgcttgaacgttgtggggtggaggttgcagtgagctgagattgcgccacttcactccagcctgggtgaaagagtgaaactccgtccccctacccacaaaaaaaaaaaagctatcagatcttgtgagacccattcactgtcaagagaatagcatgggaaagacctgccctgatgattcagccatctcccatgggtctgtcccacaacatgtgggaattatgggagctacaagatgagatttggttggggacacagagccaaaccatataaataaattaataaataaaattgaatgcctatatatttctcccctctaatccattcctcagagtctctgacagagtgaacttttttctttattattaacttttaaagctaatcctttaaaaaatattttttctattctctcaagtttttgtcttttatacatgtttgaattaagtcattgttctaaatatacatgtaagctggtttataaatactataattacttctcttacttaggactcaaatgttgctcataattgaaattgtaagcccttattttctgttctagcagcaggcactctaaatggcttgtttaaaaaaagttcttgactgggcgccatgggtcacgcctgtaatcccagcactttgggaggccaaggtgagtgggtcacttgaggccaggggtttgaaaaggttagccaggcatggtggtgtgcacctgtagtcccagctacttgggaggctgaggtgggaggatcacctgagcctgggagggttaaggttacagtgaaccgtggttgtgccactatgctccagcctgggtgacagaacgggaccatgtctcaaaaaaaaaaaaaaaaaaaaaagaattcttgaaaggttggactctttattagttatcactaattatatcacagactctgaactctaagaatgcttgttttcatggctctggtctctgttgtgctgtaataaacttccatttcatattttctgaagttgtcactttgagttctttctttggcaataagaaaagcttccattcagtccatcttaaatgtggaaaacagttttatgtagcacttgttacttaacagtagtcatgggacttaaagaaaaatgttgaagcttagaggtggtaaagcatagtggtttagagagtaggtagtgaagttgatcggaagtcctggctctgccttggcaaaggtggttaatgtctgtgctttgttgttgtttttacctgtaaaattgagataatgatagcgtgataccctcctaagagggaaaagtcaggataagctgagtttgtccattcagagtgtttagaacactgcttgatagtaagtgcgtaagaagcgttgccagtatttttaaacttaactttgcagataatatatgaaatatgcaaataagtagaaatatatacttgaaaacatgaaatctttaggataatttcctcttttcattctctactaatttattgttggtgaattagatagaggtcacaatctagtcatgtgttttacagaaagtagttacaatgttgtgttccttttgaaatactgacttattctttggcgtgtatgaggggacatcacatgaagtcattgttgaaaaagatgtgtccattaagaaagttggtgctctatttgtgtaattcccgagagtggagggatttgtttggtacagtagccttattagctttactaaaacaaacacacaaaaacagactgacacccacaagtatttttgtcttgttttacaaggtctggtttctttattgaagtaaaattcacatagcataaaaattaatcatttttaaccttttcttttcttttcttttttcttgagttggaatctctctctgttgcccaggctggagtgtagtgacgcgatctcggctcactgcaacctcatctcctgggttcaagtgattcttctgcctcagcctccaagtagctgggattacgggcgcccaccaccacgcccggctaattgtgtttttttgtattttttagtagagctgcggttttgccatgttggccaggctggtctcaaactcctggcctcaagtgatccacccagctcagtgtccctaagtgctggggttacaggcatgagccaccgtgcccagcccattttaaccattttaaagtatataattcagtggcttttagcgtaggtttagcatagttttgtagccatctgtctctcaagatctttctaattgaaaaggatttatatttaaagttttatgagttttgctttgcatttaaattatgtcatgcagcttttctaaaataaacatagcagttctgtgtttcacaaaattaaacaaaagttggcatttaattaatatgaatggggcattgcttctcttttataaagtgttttttaaaaaatctctcttacagagagagagagaaagaggttctaattaagatgggtcccagatgtttgctttgtattggtttgtattgtacttctgttgactaagcaggtagttgttagtggttttaaaattgtgaactaattagaacaatacgaagagaattgaacatctatcttgccaacatccagatcaaataaaatttagacttttattattatttaggatgttatttagtatacaaactcatgtaaagttttatttactagagtttacattcttttgtatctttttgatttgaggaaagaaaaaaatggacaatttatatgaaatttctaacattttaagcagtactgtgacagaatgtttttttataaaatacctaatttttaagagaatatttgagagaggtttgaaaatatacctaaacagaaaaaaaattaaagaaaagtgtatatttttctgggcattaataaaatcagccaaggttatgagcagaaatactaacagcaggtttgggatgttgatagtgaagcttacctaaaaatcttaagttaaaagttttaagttattgccagatttcatggcacttgcaacctcctttttagttttgcctaaagtgaagcatcttagaccagaaaggatgctctaattgttgagtctttattatggcatttgagagctgcttattgctgataaatagtgtttatgtactatatgtttagcgtctcaaaattattttcttcaatggagcaattttgcacacagacaaaaaatttgtgacttttggtgtgtgatgttagggtgaacctgattgttaaaagtttaacaaatatttgcattggtagcagttaatgtgtattaaatgtttatttttaaaatcatatgttttaaataatatgaaaaatgtaattttaactggttacaagttttcttgtataacattagcattctacctgacactgtgtagaagtaaattttgattttagctctgtaaccacataaatacaatgctggattaaagcctttggccctgacttatctgctagtgtgtgaacatttctgtttgcagtgcctgacttcattgcttcctggaccaaggaaggattacttttgcttcttgatagatttaacctaatctattactggtttgacaattggaggcataaagggtaaccatcagcatcttttcgaagcatgtaatgctacttggagaacaatattccagtaaggaaatttcttgttttcggaaattcccaaaaattcagtggataactcatagaatgcttttaatatatacagtaagatggcatcttctatttctaaagtatttagtttatcattttattagtcaaggaatactatagaaaagagcagtagatgaaatgagggtttggcagcatcaaatgataaaaatccatgttcctggatgcagttaaaacagaaatgtaaaaatgttcccatctgtctaagccatcagtttctgatacagtccctggaggaagtggctgaaaagtcatttccacctaatgggttgttaggttgcttctgtacagtaagttggtggttgcagcccacttcctctaagacaaaggtccatgtctccaaaaccccatcacaactgacactaattggcattgctctcggcccagggctgtgaaagcgggcctgagtgggcatagagtggggagcactgagggggtatgtggcaccactgaaaagacattgtagattttcctagtataccacatttagatttttgttttctgacccctgttcatgcaatttatatcatttttatgctgtcatctggcttgggaaaaatttttccaaagccccattggtgaataccatgtcattagaaagtattttcaccttacctaatgttgggacttccaaatactaagttacctatgaaaatctctatgaagtaattaagatgattagtagtaaatacaataaataagtacacatttttacctcacatttttacacatctaataaactaacattttgttttccttttttcttaaataagaaaccagaagagggcatattagtctttcagaaatcactttgggagccacttggcccagttcagttacaattaccataaattaggcaaagaacctgctttgtattcataagggtcaggagtgaaggatttagttcctgcaagggggttagaatgacaaaaattatgaaagcagaatggtaccctcctcttaacaacttttaactatgtcaaagcttgattgctgtatatggctccatactttgacgattatgtagaagacagggaagagaaacattactgagcacttattatattggaggggttgtgctgggtactttccagaacattatcttttaaactttagagatattaccagactcctggttatagaaaagtgtgactgcagttacggccagttgtacgcaatctctctactttcctaaatgcgtattgaaaaattagtgagtggtggcagtggggaggaagggaattactaagggaattgattagtcatattaatcatttatatcttttctcctgcatccatttaaaatgaaaatggatagccatttaggtacccagaccctgccctccctggcttcctcttcccctctccatcattttcaggctcaggagtgtgtagtaggatcttgcttcaacagttggcttggactcagctccctctgagaagctctgctttcaaatcttggaaaagctcatgaggccctcctcaggaaactgcttacttctcttgcaatgtcccaggggattcgaaacaagtttgggatttccctttacccctgaagtcctttaaacagagcatcttcttgcatttgtgtctgttcgtttagatctcagcacagttccctgcctcttctggtaccacaagtgttaacaatatagggccaggagtagggtgagccaaatgaggtgcccgaggtacaaaatttgaggaggcacttcttctcgggttgtgcaagtggactggaagttgcgattccccgattctggagtgtggtcctggatatctgtacttatgtaaagcaccacagatgattctgacatatacctgttcttttttatatttaataggtaagagttttcttttgctgaaggaagtggagacatttggttcatagctaaagaagatgagattgtgctgtggaaccttgttttcgcagcacgtgataaatctcacctttaatttacagactcctcttgccccttccaagatgtttaaataataaaagatgtatcatcatcattttctgtgatcccaaattaaagcaagaggcactttcacattgaaggcgttattagcacatattttacatttctaccctttgttgtgcattattatttcagatgaaaggtaggacacctgacaactgtgtacagagatcctcaggttactagctcaggtgtaattccttcatacacaaactaactttattcatgtataaccctagctctttatattacttctaacaccagaagactctcgccacccgccgcacccccgcatcattacctttttaaaataaaacaagtaggttgatttaggggagggagagttactattttaactaattgaaacacaaaactgaaatattaaatataggtaaacattaaaaatgatgtttttcagctagaatatggttaggtgaggaagcatgtataccttaactttaaaatctgttattttctgattaaggaataaaatgctgaatttgtcaatagactggaaatctaaagaaaataatactgtacaaatacacacccacttaaaattgtactacgtctgctttacttttttaggagacataccatctggcagctgtgtctcagtgttaaacaacttgagcacaggtaatatatttgacaattaaaataatagcctcacatttattggatatgatcaaagtattaaagcatgcttatcaccagctctatggatattcagataatgtttcagtgaaaaatcatattgaattgtgctttccttatctatttatgattcactcaagtagaacacactaattgtgcaaatagggtaggaaacagccatctcacaaacttacaaggtactttacagaaatccaactgatgttcagtgtcataaatagcagtatttgtggtcatcaatgtagggcccctcttggattacttaaagtacataccgtagtctagatataggtttcttatatatcagggttttaaatatgagtgagtgatacagtaaaaccgttggttgcccctgttttcctttatcattcttcgtagaccagcaaagctggtttgtgtgtatttggtcatccgataatatattggcttgtcctatggtgcttgtatggaagaagtggaagcaccacaacacatgggcatgcgctgttatcaatttatcaatgaaaaatgcagatgtatgaaagtattaagcatatcttaatatattacttttttttgacatggagactcgctctttcgcctaggtgggagtgcagtggcgtgatctcggttcactgcaacctctgcctccgggttcaagtgattctcctgcctcagcctcccgagtagctgggattataggcatgtgccaccacgcctggcttatttttgtatttttaatagagatggggtttcaccgtgttggccaggctggtgttgaacttctgacctcaggtgatccacctacctcggcctcccaaagtgctgggattacaggcgtgagccactgcgcctggcctcaaactgctttttacctttacttaaagacaagttgagggaaccattcatttgaagaaggtgttagaagggtgtgtgtgttttgttatgacacgtttttgtacctaggcttccgttcacagccatctctgccttgcagcaagagagagtattgaatttctacttctttccttttgatcctatgaaagttgtaaatctctgtagtatgtaagttatgacctaactctccaaattacttgaatatgattgacattaagctcatattccaaatcactttgctccacagttcagttatttgtaggcaggaagcatatttgtttatgagggagcaggaagtatatttgtttatgtttttatatttcataatttctagcattgtctttggagtagtcaaatcttagcaaatgaagggatgaatgctttgtgataggctacatacattttaatgttcagttgtttttatatgggtgaatggatattggagagactaaagttttacatgtccttgaagtatacttttgttgttaatttattcatatttaaggcacaaccctatttaatattttgtgcaaaaaccaactttaaggaaatagaagtgaaaaatacatattttgatgtttggctttttcaaaaatgcaaagcatctcatttaatttccaggtagaaggaataggtattgcccaggatatatacactgcctgtgagccagtgcccgcctcttaagctgtgatgagtctgttttcctattttgggtttcaggtacagtatggtaaaagtagcctttggtggtagagatgagaatggtggaggggaacatatgcttttctataatgacagggagatctaaggttagaatgttactagcgttgcctggaagaatagtaaggcatgtggacttagaagaaggtacttatttctagtgtatccaaaacgtctcttccccgtagtggtgagttcattctgccacagccaagcctaccaggaatgattatcttttgtctctcttatgtgaagttggatgactaaggcagtgatttctgaacagcaacttttgcatattctgctagtaaatacatgctaaatatttcatgtgaattttatagtttctatttttagaaagttgtccctggaatttgtagataatactcagtaatagacattttagcaacttcatcacttttattttttaattcacataattttacaaaagttatgtccacttaaaagctttatctgcttttattttttccccagtcagatcatacttagaaaacctgaggttaacataaattatatattgatagcttcttagcagtctagcagatttcaatttcttagaaagatgttatggaaccaaaaatttgacagataaatgtaaagtgtctagcacgtgatgtgaatagtaacaaagattttatttcatttctatcaattatgctactattatgaatattacagtatatggttcttactcttcaggcatgcacatagggtctctttcatcaagaagcacatatacctggactgagagacaaattactgatttgcagtccttaattatttaatgagaaattacagtgagatcccaatatatggatttaactcttcaaaactgccccgaaaaccaggcacggaatgaaagaatatcatctttatacgataaataaataaattatatttaaaatagataaatttatattttaaatcacaactagctttgtacaaataggagcagatttattttgtacacttaagattatgggggaaatgacataaaagctcatgcaggtaaagcttatgccttctcatgtgtaaaacaaatatctaaatatatgtctatttgtgtccacatacagagttaaaggacacttttccatgaaataacacattcctttagaattgctgtagattttcataattttttaaaaacatttctattgtaacctacatcaaaagggcagccagcgttttttttgtctggctatacatatgcattataaaaaagtgagtctactgtaattaccagtttgcagagcaaattcctgcagggtttgtactctccccattagtaaaagtgataagttgaaatgtattaaaatttcactgtacaactgggagtttttgttcacagtaaatgtgttaatgtttcttcattgcttgactgtttgtgtttaaatttaggcagcgtgcccaacagggacaaaattataggataaagctatgtataaaagaaaatccttcagagagcaccagtaaggctctttttaaaaataagcagttacatacaatagtacatggctgtagccacagagaaaagttttatctgtctagttcagaattattggaatttttctttcccttgtgtaaaagttaagaggaccgagcttatgtcaatagctaatatactttgatgtaaaaacatccattattttattcagtgtcacttctataaaaagaaaaagaaatgatttctttttgttgttcctatgatgaagagaagctaatagcattttgagagagaggtgatagatcacattttcttcccgagtaaaggaattctttcttgttaagaattctaattacagcctgttatatttttggagtatttttctctgcttttcttcgttgccatgaacttagtaaatacaattattcatgtagataggcttattttttaaaaaattaatctacaaccacaatcacctagcatgaatatgtaatgaaattcacaatcacagggtaaaggctcctgtttctctgcagtctagagagggcagaagttgcagttatctgaaaatgctggctgtataatcgttggccagccagggaatcaactctcctctttctcttaaatgttcaaaatatattgtagtttttactgtttaccttttgtagtttcttctgcctgcttctctgtaagtgaaaatgaaagaatttgccagtatccatattctgtcccaaatgtctccatagatccacaaacaaatggtgtaaagaggtaaaaataaaatacgaattttcattttgcattgttgctatcttagaaatcgggttttgcaatttacctagtgtgtgtagatatctggaggggagagagagaaaaatatgaatgtatatgtgtatgtattttagtggtttgtatttgtacattcacgtacctataggaaaacataaaaagccccttggatatttcatactgtatattagctttccttcagaaaatatatttttccccttaaataggttgatctcccctgccccaagatgtttaatttttatttcttcctctacactgttctttaaaacatgaatttgtagctgataaaccttaaagtccttcatagccattactttcttttgactaatttgtagaaaggcaccatatgaaaattggatttttgatctgatggagtgattcttgagttcttacgagccatttatagtctatcaagtaaatccttcttagttcacggattattgacccaatggaccatattagctgcttcgaagctgttatagcccattatgttgattcagctgacacacatgtgaacccagtccacatgcccaagatgacattaacgttgttctagaagactttttttttctccacaaggctttgtatttatttcttaattttcaagagttagctcaaagttcctgacaaccattacataggtctcttgctttgctcagtgatgttgaagcatttgtttttagctagtcagtctgttttttcctgtctttctctttatgtctgtttttaaaaaccatctaatctttaaaagaaaaaagagaataattttttttcagcatactagcacacattttaccttcagattcatatagatgtcatagaaatttgtggaatttctctgagcatatgaatttagccctttgaatttgagaaaaccaccttttagaagaaatggtaacattgtatttgtgttttttaaaaatgtattacctgagaggtttcacttgaaaaattccagtgactctagccactggtaaaatcaagatgtgccttcattgatttatgtgaagcgctaatgaagccagtccaggtctcagcacagacccctggggaatctatgacctaacataaataacgtataagggggcacatagactgttcatcatatcactattattatttgtaacaggtatgattcctttgctgatacctgcttttaagtgaagaaacatattcttttataatcagagataattatgatacacagttagatgtacaatagaaggtattaaaatgtttgttgagatgtgtcgctgatggacagtcccaagacaggtataagtaaaatgctgtagaataaaccaagtgttcctgggaatatcttgtctcactgttttcagattttgacatttcttaatataaccatataaagactataaaatactgtgctgggtcactttctttatttaaaagtgtaccactttttggcagaaaatcctagtatatatggttaactgcttacttagcattttcacttttcaagttgcttaaacctttacccatccctctccctttttgtgtagttttgttcacatctcctatttggttataagctcctattggaactgaaaacatatctgaggaaatctcagatttgtttgaggaggaggggaacaagggggattatcaggctcctttcctcccatgcccaggctgagtagaaagagccctggattagtagctgtggccatttagggacatctcagagcctcattttctgctgtttgaaaaaatctctaattttagggattttgatgattaaatacaagaatgtatttgaaatgttatgcaagcttcatagcactgtacaaacatgggatattattagtcttacagtctgtctcaattggcctgggtaatcagttgtcatctgaaatgttaaattctaaaacgtaacaacttttctcccctgttgctttactggggtaaattttatcacaaacctagaggagtaaatttagttaaaaggtcacctacctatgctcttgcttaggaaatggattgattacagtgctttggcatttgaaataaggtgggcagctccttttataaagagggtaaagatttagaggaactcctttctttagggagcccttcacattgcatctgggaagggaaagatactgacttaggatgaggtgttatatttggcacaacttgggacaacttttgtgttacttctgtacatctttgcttcgtcaccaaagtgtgtgataatcatgcaaatcgattgttctttctaggattggaggtgcttttgaaacataccagaatttaagcttcatcttgtcttgcttcttgcttaatgaggaatagtttctttgtaaagtgcttaaaggtttataagtctttttgcatctcattataaatcctgtccttattaatgtcttctctatcatattatattagtaattgttttcatgaatgccacagagaaatgtaatcacattaccatctttcaaattgcattagtgaaaatgaataaaatatatatcaatggaatacaaaattgctgattcaacattaagatgaaatgagattattattacttagcatcatcagatatgagaagtgctttgcctccttctataaagttaggtgttctggtaaatatagactgagttaaaatgtgtgtttttctttttttaatggcgagctaaccccttattttcaattaggtgataggtctgttcatggaaggactatttactttctatttatgttattacagctgcctaagtagcctgtaaaatttgtaagtatacaggcaataaatggagtatcttaattgttaaatgttaggtaagaaaataaaatgtttttgcctaaattgaaatgccttttcatttcatgtttctttaatattactaattgcctaacaaaatcgcatgtattatcataggcctaatttaattgaaacacacacacacacacgcactccaaagcttgcgtatgctttgatgccatagaagcatgggtattttccttatataattggctatatcccgctgttgatttttactctgaacttctaaattatttaaatggggcctttcttatatcgattgatagtaggttgtgatagtaggtaatgactatggatgcttattggatctctgtctgggaaaatttatatgcctgtgtgtgtccctttctccctgtttgtatttatatattcacacagttgtagaaacatttacactcatatataaacatatgcccagaagtttctggttttccctctttgcctattccccctaagccaaatttgtatcttggcttttgctgaaataatttttttcatcacagtaaattgaggatttttttttttgctggtatacatgacagaattcagcattgtcaatttttaacaaattatcttagaatttttttaatactttgatattaatattgctgagcatcataactgagaagttttgtttttgtttttgcttttgcttttttgccccgcaaatatttgaaagatgtactggatttttccggatagaaaaatggcagtggatttttaaatggatatattaggttttaatattttcaaagtagaaaggattttcaaatataagcaacagtaaaatttctttgttcaccgtccgtgtattaactcacttagcatttgtgtattggagacctactgggcaaaagatgtgctgcattatgtctcctggggaatgatatcttatgggattaaatggttttaacaccactaaaagaaagtaggtggggcagtgggattcctcccaccctttccctgttttaaacagcttgattgagatatgtttcacttaccatacattccacccatttaaaatactcactgtattttactatatttatggttaggttcagttatcactgaacatttttatcacctcaaaaagaaactccatgccctttagctgtcaccctaagcctcatcccccacaaggcagccactaatctactttttatcattacatatttccctcttctgaacatttcatctgaatggaataataatatttggtcttttatgactggctcctgcaactcagcttagtgtttttcatgttcattcatgttgtagtatgtatccgtggttcattcctttttatggccaaataaaatttcattatattaatatactgaattttgtttatccatttgtcagtggatggagggatagcgttttataaaatgaagttttaaatctcctgatttttaacatcatttgatgttcaaaggtcaacttttcccagtgaatctctttcgattattttggatgtgtttattgtgaagatgatgtatttctttggttcataacatttttctcaaggttttttttggggggaggggaggggtggttaaccatctttaaattgcccagctttttgtcttttaccatgttgcctgcagtttaaaccaatggtacctggccttttagtgagtccagcaaacccaggctcttgcgaatctcctgtctcagttataagatctaatgtgttttttcgttgagaagacaccaagaaatttcagaacacattaagtacaacaaaataatcattttttaccagcttgctatttcttcatatgacattaaaaacaattagacaaatgtaaggacctttctttgaattgttaattaatttttaattttctggttaccaccaaataagagacatacttttaggtataattttccatcatatgaatgtttgagtagatttttttaaggagacagaataacttcattgtttctcatttgctgctgttactattacattaggagtagtgacatttgcactatggtttaacatgcttgtggacccttaacatttataatcagttttataatcactgataatcatagcatgtaaattctgtgtgcattgttcattcagacttagatttatgtatttctttgtataaatggagaaaacatacccaccttactaaaactatagatttatattaatactctcatggtcagaattagatagacgttttaggttgttaataaagcttttttgtgggatgtttaaaaccgtagatcttttgacccatgttctgtatctttctgactcacctcttccttgtctccttttgatacttggttgcaaaactcttcagtacaacaggtggatattcttttacattcgtcatagatgagttttgtaatcaagtacaagtgaaattgatatgtagtcttgtagttcatgctggtcttaagtaagcttagtagttgtccaccgtgcaagaaaaaatgcagaattttttcgctcaagctgtattgtgatgtggccagttaggaagctgatttcttctcccaaggcagtattatataaattctgaaaattatacagggagatatttgctgacttaatcaccattactatcatgtgagttttttagtctttgtggcaatgtttgaagtactgtcttagcatatcatacacaacctatataaaagtgcttgtttcatctttttggtcatgtttataagatcactctctgcatccacaatgctagcaagccattagtttgtttattgcagtgtattctatggcaatcctggaataattagctttcagattcattacagataatttgctattccagattttcgtccactaggatagacgtcttttgtgtgtgtgtgtgagatgaaggtctcactcttccatccaggctgggagtgcagtggtatgatcatggtttactgcatccttgacctctgaggctcaagcagtcttcccgcctcagcctcccgcgtagctagaaccacaggtgcatgccaccacgcccggcgaatttttcatatttttatagagacgaggtttcgccatgttgtccaggctggtctttggctcaagctatgtgctctcctcggcctcccaaattgctgagattacaggcatgagccactattccctgctaggatagaaatgtctttgaagaacaaattttctttttttaagccaggcacagtggctcatgcctgtaatcctagcactttgggaggccgaggcaggtggatcacatgaggtcaagaattcaagaacagcctggccaacatggtgaaaccctgtctctactaaaaataccaaaattagccagccatgatggtgggcgcctgaaatcccagctacgtgggaggctgaggcaggagaatctcttgaacctgggaggcggaggttgcagcgagccaagattgtgccattgcactctagcctgggcaacaagagcaaaactctgtctcaaaaagaaaaattaaaaaaaaatttcttcttttccctccattagagcattttattaattattgtgatgcattttcttttaccgctgtacatactggctaatttttatattttttgtagagaccgggttttgccatgttgcccaggctggtctcgaactcctgggctcaagccatcctcctgcctcagcctcccaaagtgctgggattacaggtttaagccaccacacctgagtggctgcttatgttaatgactagctttttctataatttaatattaatgtaggtcatgtacttaactattaagcattttaaaatattttaaaatttcataattcatattgtaaatcttgctatactctccagaaattaacaaggggaaagaagagttaaaaaggtttttagggccaggcaccgtggcttacgcctgtaattccagcactttgagaggccgaggcgggtggatcacgaagtcaggagtttgagaccagcctgaccaacatggtgaaaccctgtctctactaaaaatataaaaaattagcccggtgtggtggtgcgtgcatgtaatcccagctactcaggaggctgaggtgggagaatcacttgaaccctggaggcggaggttgcagtgagctgagattgcaccaccgtactccagcctgggtgacagagtgagattccgtctcaaaaacaaacaaacaaacaaacaaacaaaaaatggcttttaggccaggtgcaatgactcacacctataatcccagcactttgggaggctgaggcgggcaaatcgcttgagcttaggagtttgagaccagtctgggcaacatggtgagaccctgtctctactgaaaatacaaaaattagccagaagtggtggtgtgcacctgtagtcccagctacttgggaggctgaggtgggaggattgtttgagcccaagaggcagaggttgcagtgagccgagattatgccactgcactccagcctcggtaacagagcgagatctgtctcagaaaaaaacaacaaaatttttttttttagttatgtatgggagattggtgaaggttaatgaacccatgaagggagctccttgtgaatagttgtttttggttttgtttgtgtgtggaacaccaaaacccagaaccggaatcagttttttcccctctcattatgattagtcgttcagaatatgtgctttatgcttctatttgcccaaaggccatattttgcatttttaaatttgcgtcagataactgggataagtgtccctaaacaactgctaataggagttttatcagttagccttgtgtgtagttcttttgtgaagtaccctatatatttactgaaacaacaatttgtgctttcctgagaaatatgatttggtcagaagattggggttcaattcacataaacttgcagaattggaaccaactgtagagctagagacctcagctttagtgataacagaacctatcctctgtattagagctttggaatgcatccaaaatactttcaaatgtacttttatttaatattcagatataaaagtgttactgaccaaacattgattagtttttttactaaattattcttctttgtatattttagatgtacttttgcatatgaatatttataattatttttattgtaagttttctttagttttctacaggtaatggaaataaactgagtcataattgggagatttgtcttcttctccactagatcatttaagagccgtgtaaaacacataaacgtttctgaaccataatagtaaaacagaaataataatctgtgtgcctaccttagaggactatagtatgaataatatggtattatgtatgtcaaagtgttcatttatttattaagactaaatatgtgttaagcaatttgcaaggtgttggagtaaaacaatacattgggaagaatcataagagagaaaacaatcatttaaatgtaatatgtggaaagtttcttgtggccataaatggttgtcatttattgagcttttcctgttgccggataggttaacacttactttttcttcattatttcatttgagtgttttgccactgttgcaatgtcattgttactatcattttacagatgaggaagcgggctcagagaatcatgtatttttaaagtgccttttgagcacctgttatttgccactatacattgaaagcccaacagacatgtctatcctgccctcatggaacttaaattctagaggggaaaacaaacccatatcgataatcacaccaataaatataatattcacaacctgtactaagcattatgacagatcaattatgatacagaagtctagtggggaacttgtcttgaatgggagacagggcagctgccctgggaaatgagtggtacttgaactccaaagaataagtagccgttaacaacttaagcaggacttggaaggagggaagctagagagcacggtgttggagaagtagggattgagaatttggatagcagaggagtcagctgtccaaccaaggagaatggacagccactgtttctactctagtaggcagaatctgacaggagggtgaaaataacctcagtcaagcaaatagcaatcaaccgtgtggatctcttaagaagagagaatgttcatgcagatggggagagaagagaaacgtgtaggttaattaggagacagtttaaatagtctagaaaaaaagactggaattatggtagtaaccgtgagaataaaagacaggaaaggaagggatacataatctttggagaaaggcagaatatcagtgaaaactctgccctataacttgctgtgaatggaatcgtagctcaggattcttagctcaacgtgatggtgcacgcctgtagtcccagctactggggaagctgaggtgggaggattgcttgaacctgaaaggttgaggctgcagtgagccatgatctcaccactgtactccagcctgggtgacagagctagactctgtctctttgaaaaacagaaggaaaaaaaaaaaaaaaagattcctagtcagtggaatggagagttgtttctgatttatagatctgtgactttactagttgattgactttaggtaagttagtaaattatctctaccttagtttcctctgtgaaataaaagtaatagtagtaacaactttatgctattttctgagaactaagaatgctgatgtttgtaaactctgtagcacagtgtctggaaaatggaagatattcaatacatctagctattattataacaggtaataatttactattgtaaataaataaattaaaatcctgaggtttggtagaggaggaataatgcataggagatagtcctccaatctgtgtaagggtttcatttatgttcttagttagggtctctcctctaaactcactgcccccaaaccccaaactatcaagtccttgatcacagggacactgccatccacttcccaccacttaagaggcagtgcctggctccacagtgacggtttttgcttagtggtgatatttgaagctgtaggagggcgtgaagttgccaaattaaagaatgaagagcttggccatgggaaacacctgtatttatttacagtggagagagagagagagagaggagagagcagttgatgccagaaaaactaggatagtcagtctctacagcccaggaatgaaggagagttagtgcagcaagctgcatcacagtctgggaggacaaggagactagaaaaaaggaccagatgggatgagaacattgcctctcagagagacagtttcaggcacgtgtggggcagaatctggattgtagagttaaaatgtaggtggtggtgaggaagtgggagcactggttgctgggtgcatggatttctctttcaagaagtcaatggtaaaggtaagcagaaggaataattactttcaataaggtgcagacttaagaaaatgtatggttgttgttatggttgttcttggggagttgggatatgctgatcatcttcactgctgcctccattcagctcatgtctgagagcctccaaccctcttctgggcactcggaacaagaccaagctgtatgtggtacattctgtgaacgacaaactttgaaaatgcaggtataaagaaaagagcagacagtttccaataatggaaattgaggaaagaattacaaggcaccctggcacccttgttaggctgggtcctggaggcctgctttacccagacctgaatactaatctctgcatagataggtgggaacactctgactgaactctctgctcctttctgcatacctgcattttcaaagtgtgtagttcagagaatataacagcttggtcttgtcccgagtgcccagaagagggttggaggcactcagacatgagctgaatggaggcagctgtgaacatgctcacaagaatgaaagcatattcatttcgactcttcccaactgtctccttgtaatgcatgtacatttttgaggcttaactggttttgatagttttatgataacttatgttatttgcgtgtgggtgagttggccagtgatcacgttggttctattttgttgtgaataaatagtatgtcaaagttttatgctgtttcaaaaatgttatttagaataaaacttcctttgaagcggcaatagtctcttactcaaaatatttatttagaccatattgtttaaatatatataattctcttaagggaaaattgtagtctatataaatctgaatttaaaacaaatagaccttctggaattcatagatatacaaaatggatattctagtgcttaagtgtttatatacaaaaggagttgaggtgttccagtgtttgcatgtttaggtacaaaaagaatagaattcataaaaaggaataatgatctaaaaagttgaattcccgaatgtaccaaatgtgtaaagttatttaggaagacaaaatatttgaatcataaacttgttcagagtaagtgaatgaatgattcaaccagtaaaaaaaataaatacacataaaaataaatcaaatccacagtctgttaatttgttctcgtcttaaatatggctgtaattaaagttgatgaaagtgtgctttaaagacaatacaaaattaggatatttttataaaataattaaatattatcaaattaatgatttaaatatttgtgtcttttgtgctggagtttatattaactgtccttgaaataccatctcattttattggccctcccttgatttcggtaaagcagagctattttttttaaagcatttatgaaagcttttattattgcacttcaaattatatgaatgttttaatgtcaacatagttcccgtatctgaatttataattagataatttgtaaagttcttgtttttagtggaaatgctgtcctctaagctctttttattttggtcacagtacaatcaagttttgagttcattaactaatgaacatgttatttaaataaactatttctgacttgggatgttctgatatatttctcagttaacaaattattgaaatttaagaacttctggaagaaacgtttctccttatagtctacaaattaatcacttctatatacaacaaagtttacaacctagctacaattggaccatgtttggaagagagatcctgaaatatcagggagattatacaattaaatatttccctagtgctaaattgaagcacaaattaaagatgggggtgaagtatgaatggagtctacagtgaggactccaacatctgaaaccaatagggatccatagatttaatattaattaatggaagagaaatattttacacttgcctgatctaaagcatagggaatggtaaaagcctgctcagtcttattctctgtgaatggaatttgtcccagtcatgttaacaatatccaaaatactgcctgttacaaatgagacagtttctataaaaatcctaatggttccagaaatatgagcatctggagctgtgtgagtgagcatggctttcaggcacagagctgcagtttcaggtatccccatgcccacccctccaccccagaatcagtaatcattgattgcatctaaatctgcagagagatcttttcctggcagttcaagtagttacagtagattgttaatctgcgaatgatcagactaaatcccttctgtcttcagaatttctatgcaaattagaattaactgtatgagataaatttattaactgtagtccgggagcttaggtcagctttagcactattcttaaacataggtttttattcataaaaagttacactccatttatgctaattttctatggattcattttataatattaactggtgagatggttttttaaagtggttataaggaaatgaaagatttttaagtgtgtttttcagttttctgcaatacaggtgtactgttccagatataaaatattcacataaatgattttttctgttccatgtctgatctgaaaccaaaatttaaacttattttctttcttatgtcactgttgaaataagaggaggattgttttttatttttcaaaacaggaacgaaaatagaataaaaaatattcaaggaattgggatgtgattaaataataatagaaatatgttaggtcttattgagcacaggagtgtctttaaaatatatttgagagtttagcacaacatttaattgaaattcagcagaagaaaagtaatattctaataataatatttgtgtgccatattttactttcacaaacatttcacttgaatattattttgttacagtgtattttttgctttattgacaagtagagaaatttaagtggaaatatatattagcagcaatatacttttttcttttttggatttgtgatgtcgtaaatccggtatcttatcgaatatgtaatcctttatttttattctaagtttgtaatttaaaggttactgtgaatgacctaaaacattgtattagtgaatgagcttttgttttctttaccttttttaataagagattttggtgatatctaaatttatttttaaaactctccaggcccctaccatcataaaatctttaaaaatagaagtgggcaatatttattgaaatggtgaaaagagtatagtatctttgaacagatgctgacctttttttcctcctttatttttcaggccatccgttgcacactggtaaactgcacatgtgaatgttttcagccagggaagattaacctgaggacttgtgatcagtgtaaacatggctgggtggcacatggtgaggaaaatctgggcttttcttcccgttcttattatgttcatgttcgtgtgtgtgtgtgtgtgtgtgtgtgtgtgtgtgtgtgtgtgtctgtttagaggagtcactggcctggagaagagagaggtcagctgtgctccaagtgttagttaagattcagcctgcggctctaaaacagcatattctcagctccaaggagctaggcgagcagctctcagcagaaggccaagatgtttataggacagttgggctgtgaagttcttactgagcatgggcgcagccagcaagcaccaggcctgatggaaactcaaacataccacagttggcctttcagggcctggacctcagagggaagctggcaaatcctccttgcttgagaactcctcgatgactgctcacccttgtcgtatgtgctcggggctgagcttatccttctagatgttaaatgttgtatggtctcaggtggacgagagagtgaacgggaacattatttggctggtatctgaaaatataacctgtaaatactccctttcagtgtgcatggggattggaggtggtcgacgtaggtagagtgtgagctctgtgtaggtgtgtgctggggtggggagaccccacgcgaaggatatgagtgttgagggtttttgccaggtgcacagagccgttctgtcagtgtgccctgaccgagcgttcagcatattcctgtgtatggtttatgtttattctgtttaagtaaaaggagacttggaaataagcagacgtttttttttccacctcccagactgtagaatttaaaaagataggtaatgtttataaaaagaaatcctggcttgagattttttgacagccccgggtattgcctcttaagtggacatattcttcattcccaagcagtgccaaacatccagtgggttgtatttttataaatgtcatgttattctagcaacatctgaggtaacaacactgggccatgcctcgaaatgcttttaatttatcatgtaccttgcttgtgagggcgtgtgtgatggagttgcggggacatttcagccatgtttctgtgagagagagtactctgagaggaatacccgggaaggggtatgtttccaccatgcagccacaatcctgcagtccttcatgcccacagggatagagcgctttcctgctttattaacaaggcccaaatcagcaacaggtctcagtccagtcttgaacaacagatgagctgcatttacttctgcagtctctttatgttactacattcaatgatttcgtctctcttcatatattagtttgctagggctgccataacaaaatgccacaggctgggtggcttagagagcagaaatttatatcctcaaagctctggaggctagaattccaagatcaaagtgttggcagggttggtttcattctgaggcttctcctcctcatttgtagatggtcacctttacatggtctctcctctgtgggagcatgccctggtgtctgcaacctccaactcccgggttcaagcggttctccttcctcagccttctgagtagctgggattacaggcatgcgccaccacacccagctaatttttgtatttttagtagagacgggttttcaccaggttggccaggctggtctcgaactcccgacctcatgatctgccagcctcggcctcccagagtgctgggattataggtgtgagccactgtgcccagcactggtgtcttcttgtgcatccagatttcctctaataaggacaccagtcagattggattagggcccaccctaagggcctcattttaacttaatcacctctttaaataccctatattcaaatatagtcacattctgaggtagtaggggttatgacttcaacatagtaattttgggagaacacaagcccataacagttcccaaatatcctttttttctctgaagaagtattggttttgctgggtaataggtacagagcttatatcctaaactcatcagaaccatatgaatattggaggcagtttggttgtagactgttctgaggtcaaatcctggctctgtcacctcatgacatgttaatattgctggacttcagttttcttgcctgtaaaataggattaatagttcctactttacagtcttattatgaaaattaaagagaaaatatatgaagcctttctaactaatacatattaaaagtaaaatggacagtagatgagcactaaaggggaggccagtcgttgaacaaaggcgtttcatttattcgctctcatttttgccaaagccatcttgtattatcattatctatctactatggtagccttggagtataaaagttaactgtgtcaccagtttgttttatctatttaatgtccatgtgcatattacattagtaatgtaaaggaaaaagcaatgttttttccttcttgaacaacataaattattcctggccagtgattgtttcgaggactttctgaagaatgtcatttttcacccaacttgaataagatgtttttgttacaccagactgtgctttttctactgtaccattaaaaattctatgtttctaggatattaattttggtgtttctcagaccttagcaaaatgtattctaattctttcctttacaattatcaccttgacctcttttttcccacaacagggagatatctgtatacagctcaaaatgcatacacccaagcatgtgaatcccacactctccccattcatgaggccaaatacagcagtgaggggttggcctctagccttggagttggcagtgggatgacagcacccactctttttgcccctagcattacaactaattgcttcattccctctctctgcacagaaaccctgaaatcgtgtctccaatgacttctgctcagaggtgaaacacagcattctttccggctgccttatactgtgcagtgtcctgggtgtggggcaatgaggaagtgacttgggttttctagtgtgtaattttcctctgaaatgcatggaacagcaacaaaactaccaagatacattgcccagaatggtttcatggtagcactgaatgcattctacctgtcattatgtcaataaaaaaatttttaatatctgctgctaaaaaataaccaaatgccaaaatcatgtattctctctaaaacagatttttagaaatttgttgacctcctttcttgaataaattatccttgttaacagcattttcagttcattcctaagatgttggatttcatgggtcattatctaccatatatatgcacatatgtgtgtctctgtatatgtacacacacagaaacacacgcacattctctctgttgacttacagattgcttactaaagctgcgtaagttgttgacgttaactactttacaaaaatctttagaaatgtgtttctaaaaaattaaaagctgggtgtggtgtgtctgacagcctgtattcccagcactttgcgaggttgagacaggtggatcgcttgagcccaggagttcaagaccaacctgggcaacatggcaaaatcttgtctctacaaaaagtacaaaaattagtccggtgtgtttgcgtgtgctctcggtcccaactactttgaaggctggggtgggaggtttgattgagcctaagaggtcaaggctgcagtgagctgagatcatgccaccacattccaatctgggtgacagagcaagactctgtctcaaaaataaaaaaaaaataataaattaaagagtgattaattcattatactgcaacacctgggttttgaaattattaatacttagtgggctgtgttacttttcacagagtattttcttaaaatccttagcactattgagttaagggaggaaggaatctcagagcagttctgaataccagtaggtatttcccactaaattaataaaggatttcctaccttaccaccaccctgcccacattaaggaatcttagctctttcactctgataatagaaagcagggcttattgaatttacttaaacatttttttttctcttggtaaaagatggccatacctagtctgtaataatttagttgatgggccagaaatggctcagaatttctaattctgtcaagtctctgtaaaaggactccagtttactgccactacttcactgaaatactataaatactatattttttactttcccttgtttgctttatcttctcagtgcgtttccttcattcacctaaaacaatctgagtatggcttgaaaaacaataacaacaaaagttttttagagctctttttggttcgaaagtggcaaaataagattaagatatcaggataagagcagtaatgggctccttttctggtgatgtaatttttttttttctttttaccctttgcctccacactagagtagcaatttggccattcacagaattcagacttcagccaaatattttacagaatgttaaaaattagctggtacaactagaatacactcagcattgggtgcaggtgggagtgagtcctacttactattctcccttgaagaatacctgcttctaacaggaagcattaccaataggagtttgctgtcttcgtgaaaaaaaacaggaggcatgatgtaaaggttgaggactgctgcacgaaaccatttttattgtttaatatttgcaagttagttttaatgtccatagtttagatgaggactttatttctaaaccattaagatgaaggtaaataaaatagtaaaaataagaaagaaaacaaactgaattctaaggcgttttaggaaatatttaatgataatccagtacaactggaaaattgtttttatcccatgatatttgatttgtgtatttgataaaagaggtgggcagattttacagaggtaattcatttagaatttttttttaaactagatcagtaactttttcttctgatgaagctcatttgttaagaccatctcttttttggaaaaaaacaaaaaaaaatttttttttaattccactgtttcctaggtatgtgaggtgagcatttggcaagaatatgagacttgatgaataaaaaatacattttatagcttaacgcacccacagcagctttctctgtgcaaattattttctttttttttctttgactttaaatgaaaggatataccattccaacaagctgcatgaatactagaatcttcattcactttcaagagatctgaattaataccagtgttatttcctttggctgaggtctgcctgcaagaatgcttgttgcactggaattttgagacctttcttttattatgttctgtaaatgtgatttccttttactgcatgcatttcattcgaggaaaagatagttttacattattactttaattatttactaattaagccagcttttttcctgcctatattttctccaaactcctgatttttttttaatgtaaagtaagcagacctggtctacatcatccagatcatcagtcagtagatatttattaaacctatctcatacatgaaggattgtgccaggtagccttcagttcttccacggaaatgatgagaagtataaagttaatttagtatcatataccaaccagctttatggtttaatgtactgtaagacttaatatgcatataacccattaatttcaaacctttttttttgtattcactggatataatttttcttttttttttctcagcatggttgaatttgaattttcagcttgtacttgatatgtcttatcagaccaggggtatttatagagaccttcacccaaatagaaaatatagaatttttgattgaatctgaatatcaataaacaataaatgattttaaatataaatattaccatgcaaatttaggtgagagtcctttatgtttatttgctaaatctggcaagcccatacctaaaagaaaatcctattcagactcaatttgcataaatcctaaatcagggctattggtcataagcatcctataatcaaaaaggttttgggccaggcgcggtggctcacgcctgtaatcccagcactttgggaggccgaggcaggtggatcaggaggtcaggagattgagaccatcctggccaacatggtgaaaccccgtctctactaaaaatacaaaaattagctgggtgtggtggtgcgtacctgtaatcccagctactcgggaggctgaagcatgagaatcgcttaaacccaggaggtggaggttgcagtgagccgagattgtgccattgcactccagcatggcgacagagcgagactccatctcaacaacaacaacaaaaaaagctgttgattatatcagtcctacatttagaatcatgagatctcagtattttatttacaaattcctcaagttcgttggaggcatggtagtttgtaaggacttacaagcaaggcagatcaaaacaagtaatttttcattttgtcctatgaaagttcacatgtctttattatttgtcccagtctatgttcttataaattgtctaaatatctgtgaaagtggtttgttcccaactggtaactctctaatattctccctgacttgagtccaaaacctagcataactaaagtagtccagtcttttccttgccaatctcttttcttccctagtcttctctccttcccactccgcatagaaattcctttatcataagaataaagcatgacatttctgtgatatcatgctcattctgagtgactccacaacagtgtccatatgataatttgtaaatgtgtcaagataaagagaggagactaaaaaacaactaagtttcgtctgacaaagggagataatgttcccagcaagctctggcttggagactatcccaacgaaaacaacattttctttcgtagaaatttttttccagaggggtgtttagggtttggtgaacagtagcacaggcactaatttgagtcctcaggggaagggaagtacatgcttagcagtggcaaagtaagaaccagatccttaggggaaatgtttctagggctttgttcagaaacacaaggatagaaacactatcgtcttcttcccttggtgcactcgtttggaaaaagcggaagctggtgcagtatctgcttaaagaatttgtctttctagtggacttagtttttccagattgtaaatgctgaaacccggctttgcctagctgcaaaattctcttttgctcagggaaaacagcttttagctgcctcctagttttggtgaggcagctggattctggtctctccatgagcaaagtccttggacttttttcttcgttttagagagcaaaagcaaggccattttcctgcctggcacaggaggcttttttgggcttgacctgagggcacagtgccctcttctgcctctctcctttacttgctgatcactgctgataagctctaaagggaagacatcctcataaatgcaaaggtttggtgcttgattaatggcactaagtattttcttattgtgtctctgagcagcttttgatttgtttctcagcctgcacactttttggatggtgctttgcactccttaaattttctttaaacccagcgcaaacagtgcctccccttcaaagtcctgggctgtctgcctattagctccccagattttctttttttcctagctatgttttattcagatggaacataaagtgaggctggcaagacctggcctccagtgtagtcactgctggtctgctggtaaggagtttcgtgggagggtgttgagaatgaaacacacagagctgtatcccgcttcgggtgaatgaatgggaggcaatatacaaaataggtaagaatgttgttcttgaatgagactgtttacattcacgtcgcggctctgtcacctactgtaggtagaatcttgccaagttgtataatctctctgttctgtcatctgtgaaatgtgagtgatgatagctcctagctcatagtgttcttctaagattaaatgagataatccagatgcctcatacatagtatacacttaataagtgttagttgctgttatcactaacttcctataaaagtaagacttcaacactgtggacatgatagacatgttttagcaaagtagagtgattaaaagttgggtgtggccaggccagtggtcaaatcccttctctgccttttgttagtaatgccttctctaagactcagttatttcatcgagaaattcggataataatagcaatgcatctaaataacacagattcattttgagagaggattacatgaaagagtagggttagcccaatattctggcacaacaattttaggagctagtattgttattgctaagtcaataaaataatattaaacatcaatattaatgataatatctagtgtctcccttaaggtacgaatgtggaatgtgttgggatgaaactatttctccttccagggaaggttttcttcagtatgcagttgcagaggtcaggtcaccagttcttttggctgttggaccaagtgttccgtaggtgaaattgttttcccaagcaaatccagtatagttccataccttccatttcccctaaaatgtcatttgagcccttatttgaacacagtaaggaatattttacaccaaaagtcattttgagaattgcgccagttaaaataaattatagtaatatttacctgctaaaaatccaaaagctataagtaggtgaattttaggtaggattaaggctacttttacctattttcacacctgtctttttgcatgtgaagtgcttcgatgggctcgccactttatcattttattgcattttattacatcataaatttttatatcttgctaacgatcctacaggaagcttaattgtttataggagcatcttaattaactggagttcaccaggttaagcagaacacaaattgaagggtttataaatgaaacacactcaactcctctccttttactcaggataaactaggagattcggctgggtcgtaaggaccccatatgcctcagcaatatcatgttgatcctttcaaccactcttccttctctattatgtcataaatggtgacttctaactcctctcccctctttactgaagtgtgaaattgctggataagtacagtatttcaaagataactctgaattgtattctgggagccctaaaatgttgtttatacatcccatttcttaccaggttttgcctttgtagatgtttatatatcttcaaaaggttcttgaattaatttgttattagttcgcatatacccaaagaattgtataagaagtgctttaagtattactttaagtattaccacaactggatagacttgtaaccagtatttgttaaaaggcccagtagtgagattcctctcttcgttcagctgctccctggtacccagggagatccccactttgacctcatgggcctctttgccttctgtacagtcaagtgacgctacaaatttaaatgcaaacccatctaattgaaaggacagtcttgggccttagattctactcgccaagaaatgtaaaggcaactctacacctggctgtccaataaggaagccactgttatggctttgaacacttgaaatgtggctagtccaaattgagatgtgatgtaggtataaagtgtacaccaaattttggagctgtcatcttatttaaaaaaagaatgtaaaatagtcattaagagttgttcttccatatatttttgatttatcatgtcaaatacgtttttaaacatcacttttttactattttacttgaaactagaaaaattaaaattctgtatcttggcttgaattatatttctttctttttctttttctgttttttttttttttttgagacagggtcttgctctgtcacccagatgcaatggtgcaatgtcatctcattgcaacttccccttcctgggttcaagcaatcctcccacctcagcctcctgagtagctgggaccacaggtgtgcgctaccacgcccagctaatttttgtattttttgtagagatagggtttcgtcttgttgcccaggctggtctcaagctcctagatgcaaatgatcttcccgcactggctcccaaagcactgagattacagctgtgagcctccgtgcccggccataaattatatttccattagacgtggtaatcgtaggctctaggtatgagagaatatatttggagagctaaagcctaggttaaagtggtttggtggcagagtagttagaattggtgtgataatcctaacaccctaaatccaggctcttgtcccttgagtcaccactgtaaactctttcccagtttttcgtactttgacgcttgctgcactattgatcctggccagtttttcctgtgccttgttcatcaagaaagtgggattcccacccctttactcccctctgcaccaccactccccacccccggagcaattaagtgctcccttctttattttctcaatacactttgctgagaccagaggtttctgggtaatactgatccttccactaacttgaaaagctcaggaagggcacttcacctttgtgtgctggaacatactgcagcatctcatgtggtgcatggaacaaaggtttattgaaactctaagcttatggaaaagtctcactcagattcctaattgccatttgcttttccagcagcctcttcccattttaaggtataagcacagcccacaaacaccttgtctttatgcccatttgtgcgtttttcttttccagttctcattctattttcacctttgctgtttccctctgtcttcagacaacaaaataagtgaaaggtaagtgggaggttttagcagcccaaacatccaggaagtaaattttagagaagttaaatttgtttaatcattaacagatgttggtgtttttgttttattcagaagataagatcttgagtgaaataccttcggctttccagtttttttatattcctttgcctgcaaaaatctgagggtaagacattacccacccgcctccttttggctaatcgtgttttccactatcagtaaaaattaaaaaacaaatcaacctctaacataaaagaaaacacctgtttggcttggagaacttggctagggaggtgttttttctgacatgccaaaagcgaccatcacaaggccccttaaaaaaaaagtcatttttttttctatatttcatgtgagcattggcagaaactctgacaagcagttcttcatattttattatgttcttgtctgcagaatctgtgtcaggcaaaaaccttgtcagcggaaaacctgtcgtaggatcagaggagacaaaaacaggtgtcacacaggcagtcaaaactgaaggaaaaaaaagattaggctaaagagagagaggcagacaattacattaatgccattgcttttatcttatagatgtgtgttattatctcggggtgctgagtgcgcaattgcctcaaagaaaagtagacaggagacaaggggaaacttgatagttattaactgaagaggcagtgtgtcaaagctggatggggttcaaagttttgcaaaggaaaaaaactgcaggcagcaagcaacggctgtgtggttctgctttcggctacataaaccgagtagctatctaacattttctacttggaaacagatcatagaaggaaaaattaatgaaagatttcatttggagttcttgggggataacatttatcctatatatatgtgaatgaatcatataaccttttctctcttacaaaatcttgctacaatgtgagacatggtgaggcatgaagacaggcatttgtcagttcagctgtgttgtttggatatatttaaaacacctattatcaacacacttttaattaaaaaaagctattaagaagcccttttactaagtgtgaacatctgtatgtgcaagctgtaaattaggagatcacatatgtgtgcctcagtcagagactaaatgaatttggcaagtgttttcttttactggtttttaaatacagtaaaatatctcaaggaaaaattgctacattttacaatttgtattgactcttttgattgtgcccgttggtactgattaattgaacttatctaattagaaattttctaattagaaattagggttactatcatgatcaaattagtaaacagaattcaaagcactaaccaatatatcccctctgtttctttattcacattatttcagatgtcacttcttttctgaaagtttgcgctccattaaatatgtgtgatggtataaaatactttcgttttgccaatggtctaaatcccaaaagagtttttgccttgttgataactcatacatgtcaaacagcccactaatagagaatgggatggtaactttaggtttccctatctgctcaatgatatgttgatcacattagtggaaaaatcggcagatactgctttagttcttaacattttctacttgtgcatttaagatttcgttaggttagacttttcctaagccctaggactgccctcttaacccgtttttatgaggaaatctttacatagggtctttttatcccaccggttactgatacaaagcagtttgatacttgatatatgcattaagcaaatccagcagtccagaagaaaacacacgtcagtgccaaaagtgtgtgtgatagcctagagattttaagggattacagtggggaaaacagattgattatagatttagagtgagatttcagcctgaattactgggggaaggaggaaaaattacttgtgacacaaaggtgacattcatttttctttttcaagactgagtataataatttctttcttttagatatttccctaccagatgctggctttttataccacgactctcaattttgaaatattttttcacatgtgatagtttaaagcatatattttatcaaatagtaaatatgccttgcctttgcactttttgcttaatgaaattcttatatagatatatgttcctttaagaaaattaagtctttaaagtgaataactggggggtagggtgattattttcttacagaagaattcgtatttttgtttaataaaaggatgtacatagttaattcaggtagcaaatctcaatagttacttttaaaatgagatatgttttatagtcagtgtactgtgtattaaatccattggtacataaactggataaagcagggtttgtgtagccaactttaagctggctgaggcaactggagattggatagaacagcagtggcaataataataattcccaaacctggtttcagcaagtagattcagttactaaatctcttcttagatctactgtcaaatttgcagataaaattttctctttgcctgttaccaccttcatgtggagttgctgcaaaagagcaaaggcatgcccccaaaagtgggccatgtaagaaagaagaagcgggagaataagtataaccaaggacctgtttaatctactagccaggagagagagcttctgaacaaccgagtggtgaaatacttttatgtgtgcctcagtcagactttaatgcttttcaaagtctgttttgaggactttattatgcgtaaggccacagggggaaatgccattcagtttgaaatattggctgtatagtctcgagtggagctcagtgtctaccctggactaattgtgggtgtttatatgtgtatgtatatccacataccctgaaagctacatgtcaactgaggttgattaaaatccgtaggacagtggggcttaactggaactacttttgtccctcttccctccctacagtttggaattacattcataataaaccatgagagtatttatacattatccctcatgtattaagagatgagaaaaaaaatcaagggccattcacataatgtatataaggtatagtaatgtaatgaggatttgtagaggttcagtggagtttattcattttaaaaaacactgacacactatttgttgaagaaaaaaaaaaaaaccctttgtacataagggttgacagtttttatcaccacacttggggatcaactcttttagctaaataccattcgttttcttcttctctttaaaaaaaaaaaaaaaactctagaagcaagccttggtattaaatatcctaattaattcaaccttgacagttacagttagaaagttgtgacttaaatggaacatgagttattttgtacttaacttgctcccagttacatagttctttcccccagaagtagtgaataaaatgtgcagatctaaatattacttcacgtcataagaaatttttctcttaatcacaattgttgcctgccttcacgatctcctgattcactaaaaagttttaatgtgtcatcattgccctatattaatgttctccccaagtgttaaggcttttattaggatctagcttacaatctaagagtagactaagtctttgccttgagccctgatgcttttgcctggtaagagagctgagtcttacaatgggaaaggattgatgtgataatgattccaaagggcccctttatgatgaaattctaaatacgcaaaatcccattaaacctgtggaagtgcatgggctaggtacattgaaatgacatatcattatattgggtatagtgtgcttattatgaagtgtggtataattgaaaattattggtcgtattagcaaaaatgaagagccaccaccctcataaattcagaggttatggcctggacatttgagataggagtggtaaaaatattctgtttataaataatgaaaactttaaaatctgaccccagaaattgctccaataaaaatctcatcgctaacaacttttagaactcttaaagtaatcgtggaaagagtttcataaaaacaatccctaaagacgtgtgttaaatgttaatctattggaaattcaaatagtagtctaggatccagagctcctaaaagctgaccacttgatgcttgtaatttggaattctaaagggagttgaggcaagagacccagagttctcgaaacaattagccttgtaatttaaggctcacttggctttctcccaaaataaaagaataagccttcttttttaacttgtaaaattacttcaaattagcattaaaaattttgaaatatccagggcaggactgaaaattagtgaaataacaggtttccatttagacccttttcgtacagatttttaattgttttattctacaaagtaagtggttttgaaaaatcattgtacttcacatacttcttatcttattgaatggctgctagcttcacactgccatgcctgaacagctagatggactccactggacctcaggacctgaaatgagcatattcctgtggaaaccaactgagtcacttgaatttgacttttaaggaaagttgtgtttaaaaaaagttgtggaaaactaagaactataaactatcactgagagccaattttgtaggatcagtgaaaagcacttttatactcttacattaagaaaaaaaagtatctgaatatgttcttatttctgtgaccttcacagaaaatattggaagtgaagtctgtagaattacaggtttacatttattttaatttatttgaaggtttgaggagcaattcctgttatttaaaatagaaataaaaaattgttattcgcatttcatgtgatagatgtgttcttttataactacccctcacccacccccagcactattttatacatttgaaaactgaattttataaaggacattactttgttctttaagttagcagtatagttaaaagtacatattactttacatttattacccattttgcattatgttttatgctcattttacatttatattacatacattaatgaagcacagaaatctcagctgttgtccttatggcaattctgttcccacataaatgagttttcttcattcagactcaagtgtcattttggggtcctgtggcttagccaccatgttcctttggaaaactatagatcttatcaaaatatttattgaaattatatccaggcctcaatttctcctttgttttgtagccataaaattgccagtttaggcctctgtttctagcattttaggaaatccaagtaaattatgtcccatcagtaacctcattcacagtttaaggagcttgtattgtatgaatttttttccttttttctaatatctttatcttgcagttaaagcttttgctttttccagatgaaattctgcatactaaaaagagattaattgaccctttgtttgtttttcctccaggtcttttacaaaagaaaaataatcctgtctttatagatgctcttcttacagtcttactgtgtgactattctctgacgactttccagggtctatactacacctttttctatagctataaggccatcagtctagcgtattgatcacaaatctagtgatttgtgctaccattatggatgattttcataaagtctgtgtattatgattcagtctgtgtaccttgcaattaagattctttttcttaaccatattagacttctatcctgtttttctactaaaagtgcattgtaatctcccaagtaatacttgacctagtaagaaagaaaatatgccaagtttactcaggattcctgcttagctagcagcgccaccttaccctccaaattgccttaattacccaccttcacttattctgtgagggggtgctgtctagaacaaaagaagggttgagaaagggacatggatgaaattaagaatttggtggcatggtggaatcatacatttaccccttccattgaaaatagaataatggctttttattctattatatacacttaactgtgttcatccatccaacagtatgattactcaacactctttagtgattttgtttcaggtatggttgctgctcaaaatcaaggtcttgagataagtaggaacataagtgatcccaggaaatggtagagtccatttcctcttatatgagggagcctctctaggctacatggaaaaagaaaatagaatataaatcgaaacgggaaagaaaaggtagttagaggagttaataagaaagaagaaagacacttgaacagcgttgaaagtaaacgttctgagaaaatacagctttacggatggaacctcgcttatctctctggcgtcatcttggttcttctcttgttcatgtcctggccgaattggctttgcctggaatacccgactcccaccccattgaaattatgttctcatgtcacatatccagtttgtaattttgtgtgttaatgtgtttgtttatttgtttgttgctttttttttttttgagatggggctcattcttttgcttaggctggagtgcagtggcgcaatcttggctcactgcagcctcgacctcccaggctcaagtgatcctcccatctcagcctcccaaggatctgagattataggtgtgcaccacaatgcctggctaatttttgtattttttgtagagacagggtctcaccgtgttgcttaggctgatctcaaactcgagctcaagtgacccacccacctcagcctcccagagtgctggattacaggcatgagccactgtgccctgcagtgtaatttttaaaagtctgttttcttcactagtgtattaacttcaagtgggcccaaatcatagctgttttgttcttcactaaatctctaaaacttagcatgggacaggaaatacacatttagtgaccaaatagtaaagtgctagtaatatgtgaaggtgctgggaaccttactttgggcagatcagagggcccatgtcagagagttactagactggaaagtaaatcaatctgtccaaggtcttctgacccaggttaaggattttgtgtgtgggtgagagagaagtggggcagttatgtgtgtgaagaggctggggacgtcattggaaattttgaacagaggaaagactaagcagtattttgagaagattgacttggttttctttagcatataataggccagtgagaacagagagagaccaaatcagttaggagcccttgtagtaatgaagttatgaaggtctaaaagcctgctctaaaatggtataaattagactagaaagaagaaattgatccaggaaaaactgcaatggaagagtttaaagtgattaaggatgacgatgacctacggaagcaagggaaagtagtcagagataattttgaatgttcgtgctagataatgttaagggagacaacaccgccaccaagatagaaacttttatctacagtatgacctcaactatataaagttatgtattgaaaaaagtagatgtagatacatcttaacatgtggacaatcattgttttgggtggtgggattatgggtaattgtctttttgttttcctttttcttgaatttagaacattttgtcaataagcacctatgagaaaatgacacacaaagaagtctgatttcaaatattttggcctagtttcccagttctacctttcacagcaaaaggagtcaagtatgtgtttggagttgagcttgggcagagcgaaatttaaaggttagggatcatctgcatagtgtaggaatagttggattcctaggggcaaatgatcacaggtgggcaggtggagaggcagtttgtctggaaacctgatgtttcctctgaatctcgttgattttgcctccagatcttccaaactggaaaatcccaatcattttgtagctgtgcctcatctttactacaagcatctgtttttcctcctacttcttagcttggtcttgattttatgctttcttctcctttctccttacattaagattgtagtcttcaggtcactggcttgcttatacttaaaataattttgaaaactaaggactaccctaacattctcatatgctgagttacttacgaatatcttacagcaagtaagtggcagagctgggattagactctggccctagagactctgtctttaatctggaagacaacgagcatcttttaaaaacactggaaacatgaaattgttgctttctgtcattattttttaaccttaactgttgtttccactccttttcccccaaataacattaccataaatgttcactggaaagtcttttatcactcaacatgcatgcctacaatgaaaattaataaaatatttagaaatagaaattttattttaaaaactgtcatcacagtgataaaatccaagcgatataaatattactaattttaacaatttgttaaacataaagtgggtttttgttagaaatgtatctgtcagtgaagtatctgccggtgaaatagttgggactataaatttttttcttctcagattagttcatgtatccatggatgaatagtacttattacaaaaaagagaaaaggtacactatcagttctagtcccaattttcatttctacagctgtaactgctgagacatctgttcacatgaatacatgggactaggaggtttgttaccacattgtcattcatttcttagaagtcatttcaagttatatgccaaaaattacacagcacttgattggtttgctaaaagctaagaaattgaaaccatcctacgtattactcagatattgttatagtcatttctttttcaatttatggaaaagggctttaagaaattatatcaaataatgatttataatttttttttttggtagatacagggtttcgctctgttggccaggctggtctcgaactcttggcctcaagtgatctgtcctcctaggcctcccaaagtgctaggattataggcatgagcgaccaagtcctgccctataaatttaatcgttagtcttcagtttagaggcatgttgtttatccctgtatacccagaaaagattgagaaaataaaaatactgtattagtttttaattcaaataacttctgcaatttttttttaacaaaatgcttttatcttactgttgcagacttagctatcttaattgatgaaaatttccaccaggtagcctaatttgcaaatccaatgatatggtcaaatgatcatatttgatcagtgggactgacaaatttgacttaatttttattagaaaaagctgagttcacatttcacttcaaataaatgcactttgtgaaaacttataaaaacatatcaataagttatggaatgcatcttttatgatacattactaaaacagtccagaataaaatgtggtgctagtaaaatttatttattcagcttataatacacatgctatttctctttacttaattagtaattatgtactataatatataacttatttatgaaatgagaagtatgttagaagtcatgatatcactttgataaatacggttccatgtgtatcacacaatttagtgttggactttaggaaaaaattaggtaagagtaatatataaaaatatttatcaattttgctaggtatcatgaccaaactgtttttatatgcttaatgaaagaggaacttacatacttgctaaaaattaagtgctttgacatttggattataatttattctgttaattttattagcagtatgtagaaggtattcaaaatcttttaagatgaaaatgatgattaatggtaaatattttgctattatttgattatgtaggctgtaactaccttactaaatgataaacatagtttctgaaagaaattaggtaacatttctatccacaccttttattcagtgtgttctacaaattttgtagggacaggaaaatattcaaactaaaattaaaagagtgggcatcacttacatttgcttaggggcttttcttcccaggtgaagacgcctcctagggatgaatgagtgttgaggatagttgaaaagaatatcttagctttgaatatgtggggttcgaggagggagaccattttcattattggacactcatgctttgctcccataggatgctttctaaagagcaatacattactaaaatagataagaatgtaagaggagagttcattatcattgcccattttacatgatgtctgaattctgaacattccagcatagtcctaaatcctgtatgagatctagctacactttactcatctgtgtatagtcagggaaatatgagcctttattaattgttttttttgtttgtttattttttgagacagggtctcactctgttgctcaggctggagtgtagtggctcagtcacggctcactgcagcttcgacctccgtgggctcaagtgatcctcccacctcagcctcccgagtagctgggactacaggcacgtgccaccatgctcagctaatttttgtattttttgtagagatggggtttcaccacgttgcccaggctggtgtcgaactcctaggctcaaacaatccacctggctcagcttctcaaaagtgctggatttacaggtgtgagccaccacagctggcctattaattcttttaataatcaaattgtgaattattttagcactcagaagagttttacaccctgggctagtgtaccatatagaatataagccaagtatctacctttattttgtaaagaaggaagggtacaattttcagaagagaaacaagaatgaattcatgtacttggaggcccattctcaagtggatcagttttagagtaaatatggaactgcaagatctggaaattgggtccttgtgtttgcatacctcatggaaggcctttttataccctgagcttaggcatactctactgagaagtccactgaattaagtcatgtcccagtggagtaatgcaaaaatgccctgctctcttcacttggctctaagccatccctccccgtttctatctccaattttcagtgtggtatgtgagtgggggcatatgtgtcatgatcatctggggcaattttcaaaggctgtgggttttgtttttttttttttgaggcggagtttcactcttgttgcccaggcggagtgcaatagggcagtcttggctcactgccacctctgcctcccgggttcaagagattctcctatctcagcctcctgagtagctgggattacaggtgcccaccaccatgcctggctaatttttgtagttttaatagagatgtggtttcactatattcgccaggctggtcacaaactcctgacctctggtgatcccaaagtgctgggcctcccaaagtgctgggattacaggcatgagccaccatgcctggccacaattttcaaagttaaaacaaccctcttacttctgaactttcctgcgttggttggttctggctctgtggccaaggttcatccagtaccttcaccagcttttgttcctgctggataggtgtcatgtctcccatgtgacaactattgctttaattaaatttctgcactcttatcagaattttacatctaaaactaaaaatcatttttatcttttaatcttttgctgtttagagatgcggtctcattctgtcatccacgctggagtatagtgcaggatcatagctcactgcagcctggaactcctgggctcaagtgatcctcctgtctctgttgcttcaagtaactgggactataggcttgctctaccacacttgtccttgcctggctcgttaattttttattttttttttgtggacatggtttcactgtgttgtccaggcagatctccaattcctatcttcaagtgatcctcccatcttagcctcccaaagcattgagatttcaggcatgtaccaccacacctacccattttcctcttataaaatgtttaatactttcctaatcctattaacaagaaataaaattataagctttccacaggtctttgcctttataaatacagctccttacttacagtctgctaatctgatctttttggactaatttccaactattttgctgcaagtgttacattctttagatggttccctaacacatacccattaattcagtgattctcagagtatggtcctggccagtagcatcagcatcttctggagacttgttagaaatgcagattcttgatgcccagacccagtgaatcagaaactctgggggaggtggcccagcagtctgtttcaacaggtcctccacttgattctgatgcacacaatgagtgagaatcactgccttagttccgtctacctacagtagtctcctcctcctttcttgcctgctgacttccgagttaggagactgcattcccggcagcattgccctctcttctgtgtcccacagtactttgtcaaatcttttttatggcatttatattgcctacatctgtctgcttttgaaggtggaggccacaacataaattacttttgcatctgcatacagcacgtacctcagagataagttaataggtgctggtggataaatgaatgtatgcatgaatgaaggaggagagcattttaggaggagtggtgatcaataaggtcagctgctatggagagactgtggagaataatgaaggaaaaaagctattggatttcacagaaaggcaggtgttggtgacctttgaaatgcttgcttcagcagagtgatgggcaagtagcccagattgctggcagttagggacttccgacatgatgaggacttgcaggtttcatattgactatttattcgaacatgtggtgaaaacagaattttcttgaatgaagttgctaagtgaccttaggccagttacctaacctgattgagcctataatctcagaataagcaataataataatactgtgtttgtatgctttttaattgaaggattaaatgagctaatagcccctagaacagggatgtccaatcttttggcttccctgggccacaatggaagaagaattggcttgggccacacataaaatacactaacacactaacgatagctgataaactaaaaataaatggcaaaaaaaaatctcatttaagaaagtttatgaatttgtattgggccgcattcaaagccatcctgggccatggtttggacaaatttgctctagaatgatgcctgatatatagttgatacttaaagggttattttctttatactcttcctcaccattatttttccttattaatgctgttgaaggcattcgtccctctttgtaaatccgtataagatgtgaaattgtttagaatactcttcattccattcattgcagaaattgtgaattgcattcagcctggaactaacatacttttagttgaacaccgaccactactttgaaattacttttttttttttttttttgagacggagtcttgctctgtcacccaggctggagtgcagtggcacaatctcagctcactgcaacctctgcttcccgggttcaagtgattctcctgcttcagcctcctgagtagagtagctgggactacaggtgcgcgccaccgtgcctggacaatttttgtatttttagtagagacgtggtttcaccatgttggccaggttggtctcgaactcctaacctcatgatccgcccgcctcaacctcccaaagtgctgggatgacaggcatgagccaccgcacctgacgttgaaattactttttaatcagctagaaaagtacctcaaagggtagttgtaatagaactcttttagttccaacttacagaatgtgacttcaagtagacagtgagaaaatggcagaggggacagggagaggtagtggagggacaaggaaatacagattttgttggctcatgtaacagaagattccagggatagtaccagcctcaaagcactgccaaatcttctcaatcaaacaatattatcagtactagatatttgtcagattgtcttgcagcctagatcttcttcatatgatttgcattctcaagcatattcattaggtacaaatttagaggaaagagaagaaattcccagtagttctaagtaagttcctggattcaattgcactgtccagacttaggtcacttgcctattcttgaaccagttgttatgctcagggtgctgggagcagactggttttctaggcctggctaaggagtattcagttctatgaaatactggtattgtctgagtatggtggctcatgcctgtaatcccaacactttgggaggccgaggcaggtggatcacttgagcccagaagttcgagaccaggctgaacaacatggggaaaccccatctctacaaaaaaaatacagaaaaattagctgggtatggtggcatgcacctctagtcctagctgcttgggagactgagtcccaggagatggaggctgtggggagccgcgatcctgccactgcactccaacgtgggtcatagagttagaacctgtctcaaaaaaaaacaaacaaacaacaacaaaaaaaaaacagaaaagaaagaaatactggtgttgagtgtaagggacaagttcccaaaaggaaatgtagcttctattaccagagtgaaggggagtggacacaagtcaggcaaaaaattggtatcaactcactatagagaaaagggcttttcaaactgtacttaagcaagtacagttcagcccactgagatacttaagcaagttgaagagaaaaagggagtaatacctgattggatgttctctgacccatgattactccagcttcacctagaacagcttcacttttatatattttgtatatgcaacttctggttagattgcatttggaaatgaatttttttttttttttaaatcctgtgacagagtctcactctgtcgcccaggctagagtgcagtggtacgatctcagctcactgcaaccttcgcctcctgggttcaggtgattctcttgcctcagccttccaagtagctgggactacaggcgtgtgccaccatgcccggcttatttttgtgtttttagtaaaggtggagtttccccatgttggccagcctggtctcaaactcctgacctcgggttattcgcccactgcaacctcccaaagtgctgggattacaggtgtgagccacggtgcctggcctgaaaatgaatcttaacaataccattggtatgggacacatcagcagatggttaggcccataatatattaaagtaggtgacatcttttcccactccatcctgataaatgagttcttgacctaccttttccacagcgccattggcctaactcatattcctaaccctacaagatccagacctgactcctccacagtcagatatgtgaagatcatgaaattaggcagcagtctagttctcagcttacagattttatgacacttaaaaaatcatcatgtatcatagttccatggatacttccccaaaagttgtcacaacttggtgactcgatatgatctagtaattataaagcagaaaattttgatatattcaagaaatttgacagatcataatctttgatgatatgtttatgctgaaatttgcaagttaggcagtttaatttttttttttttttgagttagagtctcgctctgtcgccaggctggagtgcagtggcatgatcttggctcattgtaacctccacctcccaggttccagcgattctcctgcctcagcctcctgagtaactgggactacaggcgcgcaccatcatgcccagctaatttttgtatttttagtagaaacagggtttcaccatattggccagaatggtcttgatctcttgacctcatgatccacccgcctcagcctcccaaagtgctgggattacaggtgtgagccactgtgcctggcccagtttaatattttttaagtcttcatctatggctcatctcctaggtaactgcttcctaaaccacactcttagagcttttttgtgatctactattgacttccattaaatatctagtccgccttttcatcgtcctcagggcccaaacaaagctggtgaggtgtctgtttgtgtaaataaagtttgtttgtttgtttttggagacagggtcttactcttctacccaggctgaagtgcagtggcacaatcattgctccactgcagccttgacccccagggcccaagcagtcctcccccatcagcctcccaagtagctgggactacaggtatgcctgcctaatattttatttttttgtagagacagggtttcaatgtgttgcctaagctgatctcaaactcttgggctcaagcaattctcctgccttggcctcccacagcgctgggattacaggtgtgagccactgcacctggcctaagtacagttttattggaacattgacacacctaatagtttaagtcttatctgtgtatggctgctttcttgctataacaacagaggtgaataggtgtgaaagagaatgcataacccacaaacctaaaatatttaatatctggcctttatagaataagttgttgacctttgctctatatttatgtggtttataacagtttttctacttttttctttttttttgagacagggtctcactctgttgcccaggctggagtacagtgatacaatcatggctcactgcagcctggatctcccctgggctcagataatcctcctactccagcatcccgagtagctgggaccacaggtgggcgccaccatgtccagctaatttttccattttttgtagaggtgggagtttcaccgcattgcccaggccggtcttgaactcttggcttaggcaatctgccgtctcgcctcccaaagtgctgggattacaggtgtgagccaccttgcccagctgtattcatacttactaacatatggtacacttatgaagaagaatcaactagtgtccttataatatcctcagtctcaggtgttctcgaaagcatatctagggaaatatttttgttctttctgtgctcttttaattctcttttcttctgtacccttaacagtttagtgctcttcatctttaaaacaaccaaccttggccgggtgtggtggctcatgcctgtaatcccggcactttgggaggccgaggcgggtggatcacgaggtcaggagatcgagaccatcctggctaacatggtgaaaccccgtctctaccaaaaatacaaaaaaaaaaattagtcaggcgtggtggtgggcgcctgagtcccagctagtctggaggctgaggcaggagaatggcgtgaaactgggaggcggagcttgcagtgagccgagatcgcgccactgccctccagcctgggcgacagagcgagactccgtcttaaaaaataatacaaaataaaacaaccaaccttttttaatgagtgggagggagagtgattgtggtttttttcacctacaatttgaacgcatttgcacacacacctgcatgtatttaatgcagacatgcaaggtgccaagtacacacacaaaaatcaggattttgtgtcattttatttcctttctactgactcctgtcagtttcatatttgctgttgtcatagaagtctgttttgtaaagaactatctgaaacggttgaggagagctgatgaagggaaatggaggaggagcagatcgcccccgatctggtcactggattctgttagcagagcagccactcatcagaaggctgagtagttaagctgtacttgaagaagaacagggatagtaataccccatccctgcttttttgcagtctaaatgccctgtggagtgagagaaaacttcaatccctaggcttgtgaagcccttatctttcccaaacgttaaattaatttttaaggctatttattcaaagttgacttaaccactagaatagggaagatcagacaaatcagctgcaagaaatgaagtatgagaaaacccgaactctttgacaaagtattcctgggagtaaatgtgttgaatgaagccagcgggtaaatgataagggcctttacactgtggatgtaagaaagcaatttatcaagagtacatgaactctctagtgaccacaagtcaggaggaaatgagagtggaggaggagccctgaaaaaatacatatgaaatactaaaaaatctgtgtgcacgcacttttaaattcctccatgattatgcagtaatattggtgtagtaaaataggagttgctgagaatgcacgtgtagtgtagcccgtaccattagggataaggtgttaggaaaagccgctgagaaaggccacactgtagtttagaatttgcagaaaccttaggttcataacttaggtgtagttatgacttgagcctagatgttggctgatacccatttgcctgactcatgaggttagatgaccatccttcaggcttatgtgttcatcttgtttaattcctaaatgggcatatgcatataattctgacagttttgaatgccttttgtgttctcttaaggagtttagagtgcctctcactcgttatctcactaatctttgcagcatctctttaagccctacagataagacagtgttattgcttgagaaactgaggcaaaatgtaattatattatcagcaatagggtgtgcagtaactcagatatggatggggactggaatttatgaccttattttggcctttagttctagagaagagatggcgtttcttaaatttgaggagaaaaagcacccaattgttgaacttttcattttattaaaagtgtttactctgagaatggtcatcctcagctttttctactgagataatacagttagctgaaatacaccagaaattctcaaatgttggtttgtcatttgtttccattttcatctgtacccttagagctattaacaaagtgacttgttatttctttctttttaaaattatgactttaattttcttttttatcctgaataactttcagaaaacatgccaatgaacacaaaagctatctaacaggtgactaacgagagaaattgagagaactaagtttttggataaccccctatagctaatatgacttgacttaaattactagccctccacacagatgtcagctttccttattccctccaaattaggtctttcacccctgtcgtctaaagaacactctcttcctcctctttaaccattcaggtattataaggggtgaatcttattcagaaaagtgatattcactgagcctgcccatatggcatgagttaggaattgttttgttttgtttttggtggggggtaggggacaccatcgtcactcgggttgaaacacagttcagttaacaaatcaatgaggtttttagcaccagccacggtcatttgaaaaccccctcagtgactctttatctgaaagttgaatgtgttttctatttgttgttgcctgcaatttataaacacatccaattaaaaaaataggaaagaaaaggggtaaaacagaaaggaggtgtcagagaactattttctttgcaagatcttgcttaaacacctatggcgaacattcatgtgtagaaatggagccctggtaacttccagcaatatttctaactcctgttctctctctttatcttattcccaacacccccatctctggaactttggcgggaccaccacagccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggtagggagaggacttgaacgccgcccgtgtccggggccgactgtgggtggggaagggtgagagtccttgacaaacctcgcaggaagggctgcacaccctcctctggttaaagtggtcgtttcagcaggcttgtcagggaaggggaaaggagagagacaaagcaggccaccatcgggcctcaggctgtattagaaggaaaacttggcctcttgacttgcgttacctttgtttgcacctttttgaattcaactctttctctacatcatgggctttctggcttcttcaacaagtcttattataaccctattaaaaaggagggctctttgaggcgggtaatgggtgtgtgaaaatctgagattacccttcatttgggtttattagggctttttctcatactcagtttgcaggtacggtgtttttcttggttgtctttgtacctaaaggtacacattttactatttattgttttttcagccaactcaaaggtagaactataatccatataaacttatataaccagtaaaccctcacatgatagccttcagatttctaccttctgaaacacacagacatgattttagatttcgtctttgcagaacctgttcttccagccttgagtgtctcctttgtgtcaatggcacttctgacctggtaagggctctaagagttttctgggaggcccacagccttcatgcacccccatctcccatccctctctttcttcatctcatttttgcaatgtgtcatgtgttatttgcactgtatactttgcctctgaaatgtgtttatggctatctgtcttcctgtaacccttgaggggtcaatgttgagaacagcattttgggagatcccaggatccaaagaggctacactggatgatgaagaaatacccctctcgccgaaggacatctcaatttgagaaggtagaatctgaagcaatttttcaaatttcccatgaggataataccaggagacatgaccccttcaaaaacaattggttttggctgtgccagccttgtatagtgctagacatatctccactgtttattccctgagctactgtgtgttacatgaagggcattagctgccagcttggcatgtgaggagtggggagcctcagtctacctctcgttttaacctggcatcagaacacacagattcttgtcattttcctgtgtggtacctccagctgttagctgggacaggagagcagtggaaggatagaaagtagaagtagggaaagggaagggagttggaataacctgtctgctctcagaatagaatgacgtcttaatttagtgagaatctcaactgggaagacacagaaaatttggccctcaaaagatgagatgatggtgataatagtagcaattatatattacgttttcagtttatacagaatgtttacaagcattatctcatttgcctcaggatggggacatttcagtgggttaaagtaggaagataagtcttggacggtcagggggcatgagggggaacaagatctaggaggaaggggccaggaaaaataaatcaggaactggtttcacaatccctgcttatactggccccaagatgcatacagtgctgcgtctttctacagtcatttctacagcgtgattattaatgtctgttttgaatggattttaccctacacaaagagaaaaacctcttacagttgtttgtatggaactgttagcttggctaacagtcctttctttattccaaaccaacaagtgttttgccccaatctggtaccatctttattacctccactatgctgcttatacttctgtcattaatattgtatttcagtttcatgtgtatgtgttgcctaagatacttacacctgtatacctacgcagagacacaagcatatacattgtatctttctgtccaaacaaataggtatgtgcagggctatgttggtttgccattttaacaaagctcaggtagcactttgataggagtaaacataaagcctgataatgtttctgtgttatggtcctattgttctgccttggccagtgcctgttttttattttacttgaaataattatttagatgttagtttttccccaacttgtgaacatatctctaatgcaggtataaaaaatgtaaatgtactctgtatttctttgtatgggagggcccagtatttagcaggggtgtcaaatcttttggcttcctgggccacattggaagaagaattgttttgggccacacataaaatatactaacactaacaatagctgatgagcttaaaaaaaaactctcataatgttttaagaaagtttacaaatttgtgttgggccgcattcagagccttcatgggccacatgcagcccgtgggctgtgggttggacaagcttgatttaaagaaacaaaattgcaagagaaatgaaatttgagaggaaaattcagtaaaaccaggaactaaaatttataaatctcttattttagggtgaaatactgcttatagagagcattttcatttattgtaatacttaaattataattaatttttattattttaatatagattttgacagtctcaaatttaatataatatttctccattcagtctaaaattgacattttgagaaaacgatagatgatttttacattagaggagttctaggtttagtttctgtcttgttttattggtagaattgatgtaatatagattttatttaaatgatggtttttgtcattcagcatttataatctacttgttctttgttaaaacagttctcggtttggaaaaaaaagcaaatggtcccagaacaccaaaactgttaccacttttgtagtgagaaaatgctttgttttgtaaagaaaaaagagagagactgtaaaagtaaacccattcttctaaagtaatgttacttgataattggccaatattttaaagattgtatgtggtaatgataaggtgtgcacaaattactttgaatataattgtatatggcgtttttgtaaaagtaggctataaaatgtgtgtccgaaggctgtggaaccccataatgctctattagtgtacaagtcattttatctggctaaaactcaattgtcttgtagccctcaaggcatcaattttagcattattgctctcaacaacagtatattgaatattatgtcagttaaaggagaataattatcaaggcaggttagggtggctgttagtcttaccacatattgacttggttagcagttggctacagattgtgttcctgggcaaatgaagatgtacggtaagttgaactagtcaagccaggatattaatttaactctctgtgggacaaagcctgcatcctttatgtgtacacagctactcctgccttctgagatacctttaaatgtggaagaatgacagttgtctgatctgattttgaatttttggatgtagggggaagaggggagcagaactttcaaaagtatgtggtttaagaggttattattagaaaaagggagatgatagtgatgctacagatacatttaaaaggctggcacatcggtcaaggatcctgtactttttttataaagttaattttcacctatgtgagtgtctatataattcacaagctagccagttgggtataaaatgcataacataacttggactacaactacttaagaagtcaggtaatatattaagaacccaatattctcctgtgtacttattaaagtatttattcagaaagtacagaaagttagcttttaagcattttccagaaaaccacaaaaatgggaatatgcaattagatgataaaatctaaatacaagggagaatatgatgtttttctactactaaagaataattctggccaggcgtggtggctcacgcctgtaatcccagcactttcggaggccaaggcgggcagatcacttgaggtcaggagtttgagaccagcctggccaatatggtgaaaccctgtctctactaaaatacaaaaattagccgggtatggtggcatgtgcctgttaacccagctacttgggaagctgaggtgggagaattccttgaacccgggaagcagaggttgcagtgagccaagattgtaccattgcactccagcctgggcattgcagcgagactccatctcgaaagaaaaaaaaaaaaacgaagaagaagaagaagaagaattcttagttcaggtctgtatcttgtgatacatttattgaccatgaatggaagcagtggccccctcttttgtcctttccccattttcccctctgtccttgacctaggaaataagaatacgggtgattatcattgttgaatttagtcatttaaaaatcaagtttttatagtctctttcagtttgaacgtataactgacttgcctgggctcatccaccagcctgtctgtggaaatcttctcatttgcaggtgggtcctgccagaattcagagaagcagttgagacactctgaatatttagctgagatgtcaacagccttataagaagagtggtattgatgcccctctcaactcttctgtgtcttaccagcacaattggtacattagaagagcatttctcaaagacgaatggggccatccgtcttttagaggtccagctttagatttgggagtaactacatactggatctttctcttaaccttcatgatactcattagtataacacaggctctgaggaggtctagggtacgagcctgtaagagtagggaagtagctttctccaacccttcccacttcataacctcttcccttcaagctcatttgaagtacttagttctgaacacactcagttcttctcccacatgagctatttgcatgtaaggtttcttctgcctggaataccttacttgtgtctctgcgtgggtaatttcttctcttctaggcatcagccaaagtctcactttcttacagaggaccatcttagccaatgtaggtcttttgtagtgtagctatatcttaggactctgtttccttcaaactcctatcacaatttaaaatcagtcaattaagtcaactgttaaaatgtttatttttctggcctcctcactagggaacaacacaaatgcagagcactgaataagtatttgttaagtgaatggctagggaaacctgtttagcttggtatagcttgatgtttcaccatggaactcatggaataaccagtaacttcagtttgtcaaaaggcccttagttttttctccaggcttcctaaggactgactgctatagcagcagctgggctgttgagggcaataagaagaaaagtaaaggctcccatgccttctagctagtgatctgtgtagagtaagtgttttatggtatccatgtggtagaaaacatccatattaagcaaacacttgtatttaaacagctctttgcggagcaagttcatgtaagttacctcttttcctcctcttacaccatcctcttatagatgttgccaatgaattaacatttggtatagttgaggctcaaataagtgactttcccctgatcacagaagtgttaattggcacagttgatacactgtaagcttcctgaagataacacatgtctcttattcatcactgtaactcgcttcccagcaccagcacccaggcttatacataaaagggtgtattaaatattggaaggaggatgttttgaagtttgatttgaattcaggtctttgactctatgggcaatatttggatgtttgttttttgtttttaaggctaccagcctgtctttccagaatgtaatatgtgagagtctgtagatgcagtgtggcatgatttgggggaagagaagaggcctgagtctggaactgacagactaacttaagatctcgtatattcagtggcacaccaaatgtctgaccttaggtaaaattgggtgaaatggattcctctttcgtgttccttttcttgcctatttcctgatactccattttgttatctttacttctattcgctctcatttctgtgactaaaaccagatctggtatttatccttaatgctttattgtaaattccggtctttgacttggcctttccagggatacataccttttgtagttgagcataaaaacaaaggttttgtacctagttagtaagatttcagctataccatgtgcagggattggaagagagatgaagtagtctttcctgggtttataaaagcatttcaagttggatggcaaaagggctctggatattgagacaagattgggttaaatctggaagactttgccattcttagtcatagtttcttaatctttacaattaagataactccccatacctctctaaaattaagataaccttcatgtctctacctttgagtgtctaaaaagatgaaataatatagatgaaatgtatgttgtgaactccttctcaataaattggcattttttcacttatatctatgtgtaaagttaactctgagtaattataacagagaaatatcagttgctaaacatgtttctctaccaatgccaaatgtttaaaaaaatagggaatgcattttaggcgttagtatcaataagataaattgcagttgttttagtaagtacatcctgaaatactactagtggcataacacagcagaagtttctcttttctctgcaagcctagtctagtggtgaatgctttccttccataagtgatttgacaagaggtaatttagggctattgctgttttatggctctgccattttctcggatcgtagattcctcatccaggtggcaaccctgagagaagatgaaggttctctgtgggatattttcatggatgtggctcagaagtgtagtagggtgcttattctcccatcactgaccagaactgatttgtaaatgaggccatgtgactgagaggaggagccaggatgtatgggcttggcaggtactctcagggaaaatgagtacaggtctgtgctccactcatgtgtggtggaatagctataattatgccttctttttatagagttggaccagaaaagcttaatgcagcagagtcatgcagtgaaggcagattcatgggcttgcatcctggcttcaggtcttactagatgtgtgaaaaaattaggcccgtgtctttattcacctcagttcactcacctgtaaaacagggataataatagtactcatggctttgatgtgaagacaaagtagaatgattcacagaaagcacttagtagtaccacttgctaagtatccaggcaatgctaactattaatatgatagtgaaaaagatgatgatacagactgttacagactactgccaacctgatgattttagaactttgtttctataaagtagccttaaatcctggatttcactgtacctcttagagaagaatccctttctaaccagtagagaaaaagagcagctactatttaattatcaataaataatacatacacatacacacgtatatatgtatgtacatatgaatgtacttggatataaataagaggcaggagtatgcagtaacaaagactttgtacttcagagttggacagacttggttgtgaatcttggtttcactttttggtagctctgttagccagcagagagaacatacttgaacatcagtttcttcatctataaaggttaaatcaaagaatattttaaaagtatgtagtgcaataaccagcccatagtactcttattaatattaacattactacattgtgaagatgtgtattttcatgtgtgcattttttaaagtaatggtttattcttttttttttttttttgaggtggagtctcactctgtctcccaggctggagtgcagtgacatgatctcggctcactgcaacccccatctcctggattcgggtgattctcctgcctcagcctcctaaattacaggtgtctgccagcacacctagctaatttttgtatttttagtggagatggggttttaccagtgttggccaggctggtctcaaactcctgacctcaagtgaaccactcacctcggcctcccaaaatgctgggattacaggcatgagccactgcacccggccaagtaatggtttattctatatatgacactgtcatttttatcacctttatatttccctattttatcaactcttccaatactttccaagctctggcacagaatgaatgattacttgatatatttgtttaaatgattagagtatctaggattgcaccttatcgcataaaataaaacatttaaaacagcctttgaaataggtattatctgacctcacaggtttttaggaaatttctggagcagaaagatcaatgaatctagatataaattaatttaggtaatccttcaaatagcaaaaaaaattgatttattggtatatattgagataggagatctctcagaaaaccagcactctaatcggtgagctctaaacaaatgatggaaagttgtattatataaactacaaaaatattcagatcacccagaaaattgacataaaggggggattatttgataccaagtaaagattggattatcaacaccatgacataaggaaggtgtcgctgcattatgtcaccaatatgtgattctttttcaggaaagaaggatcacatgtatgattggtcaggatccccctgtctttggcagggatatacaaaaaatagatgattcagagcagtgtgttgtatttatagtgtctgttttctaaagtgcttggaccactctacaaacactgtcctggcaagcctcctaacctccctattagagagatagtttcagagactattatccttggttttaaagttaccgtgatggggaggcctcaggcagaggcaaagctggaagtggaatacagggattttgaatcccatgccaaagctctaactatttgaacggcaatgaaaataaacaccttagatccaaggacaaagcttgatgttttgtgctcagagttaaaatgaaaatattcctccctttactcttgcaaaataaaaatatatggcttaccagattccaggatggaatgcagtgactgccggaataggatttgcgcctgtgggacatgaagaggcttttgcattcccccaggaggagcagaaatgagtccacagctcactggccagtctccatttgataagaatcagttcagatttacttgaaatggacattgtctgtgatggcactgattaaatcatatgatctcctgagcagcactcatacatccttcttgttgaatttaaagtggaaagctctgagctttgggtttaaaccttaattctagcaccaattaactctctagccatacaaaaagcacaaaatttctatgagccgtattttcttgatggtgccttcttaaaggagctttcaggatgaagagaagtaatatgttaaattcatagtggagcttagtaaatttaattcctgaagtagaatgatctcctagtccccccaccccaacccttaagtttctagagcaacgggagctttatgagtcttccagttgcccatacgttttatttgagctactgtgtccttttctagtatttcccccaatttgacagaatagcccagtggaagatgagggggacttgtacaggaatgaaatcctctgtgactataatgaagagtcatgagaaaactctcaaggctgagtcttagtctactatctgtttcttttgagtgacttacttcaagtgctggtgtatgaaatcttgaagggctgtgaaaagtagaaaatgagataaggatctgtgtgggtttctggaagcttttgctaaattcatacagatgggacaaatgcaaataaagatacatttatttgatttcttcatgatacctgtatgtaatgctgacggaagtgtaaaacaaaatgtgggccaatactttgctaggagaatgagtgaccatgcatggttaggccacatctaggcctgatgatctgaagctcttcttgatttgtctgatgtttgcatacacttctttcttagggaagtcactagtgattctgattgtttacaaacttggcatttgttgccgatagccttagattttaaagatgtggctaactagctagtgatgcatgaacaattgttttagaaacctaccattgtggtcctgttggtatctaggaagttttttcatttgttggtggcaactgagtgatctgttatgtctacttttcctctctccctgtcccctcccccatcttcttctctctcttttctttctctctttttttcagtcaaggtagacttgagataggggacttgcatggctatagtagatcataatacatgaggccccccaaataagagagtgaaacattgtctgggatgtattttctgctcgaactcatcgtcatttttctgtgtatttcttacattagcccccagaaaagcatttttcaaagactttgagaaccaaaggttctctctgtaaggaaatgtgttaacctgatttccttgttctcatgtaattttctctcttaaagccataataatagtgtcagaggcagctttctagttagtgtgagtaatgtggttactgtattttctatttttattttaatgtgcttttcctgctgtggatttttttttctttcttgattttaaaaacagcagttgagtaaatgtggttatttgaagactggcgtatattgcatcttctctgagatgcaattttgaaggaaggctctgtgcacaataggcattttttttcagattccttagtaggataaataggagaatgtttggaacacagatcagtgacaatattggtttatggtcatggtaggtcaggcttcctcagagaaactgacaatagagtatcccataggttttgtctctagagagtctgttaatatgaagtctgtttattttatgatgtgttgataagaaaattaggtaaccagggaagcaccttaaattgctgcattcatttgcctctttttaagcatgcacacacattgagaaattttgaattaacaacaacaaaatacacttaaattcccctggaaagagtaattaagagctacttgtctctgtgctgtcatctctgccagaattagagttcctgctgagtatattccattgagtcagccatcattccatcaccagcagggattgcttttctgcttttccacgtattgacatgtgagggaatgtctgtcttgcagtagccatgggcttgtgccagattttgagatccatagaggcagttctgggagcttttcaattctgaatcagggttccaattcataatagctgagccagggaaaccgggttgaatctgtggccaaaaccgtggtaaaaaactttttccccctttcctttcttgcagtgctttattgctttaaaatatgagtgcctctgtccattgattctctggtgactttccgttggattcaaattgtggtctcttaggtgaaaaggtcagtgtgttattcattcagccacacatcgatggagattaactgagagcagtacaagacatttggatcctgccagacctagggcacctgaaggaagtttatttcttttctctctagcctttactatgcctgctgcagaagaggatggccctgtcttctgggagtaggggagggttttgattggctgtgtgttaactgcctcaaatccatggccatagggcgagtaagaaccctggagaatcaaacatgtcatctttgtagcatcacctgatttagtgcttttcctcaggtctgagatgtctcagggggcctttttcccttgcagcactgatctttcaatgaggtgctagtgtctgtcctgagcaataacaaggaaaaaccatgaagtgtgaacagctcttattaggggggtaaatgtcattagcgcctttgtagccttctctgcaatctgaatgctcctgtcaaaagagcgacttactgaagcctcctttaaaatcacataaatggaatttaagatgctgaagttttacattttaattaagcaaggccattaactccctttacatatacacttttttgtagccagttatgcttgtatgccttataaggctattgaaaaattatccacaaaaattattttaaggatttgagaaatagttggttaactttaagtcaaagttttagatatagagaccctatactcatgtgcccaaccattgtaatatgcgtattgacgtatatgataggagaaaacactagcattttgagttaataagtaggtcagtttggattaatggaaagtttgaagcttagagtgtttaaataatgattttattcttttcaatacacaagtggaaatgtttctccagtctaaattccccctagtattctcctgaaacaaaatttttatatgcagatatttgcttcttttgcaagtttgagaatttcacagtaacttctggttaccctgggttgtgtcttgcagttaccaaaaaaaaaaaaaaaaaaaaaaatcacgttaaatagttgcatggttgcgggggtcagatacagaaagaaaattgtcttttttttactatgcatgttaatttttaataaaaatgaattgagacatctggttaaaactttgggaggtgcatctagaaaagttacaggtggtgaatagaagtttgctactcattactgctaatttaagatatataatttgatatattctgtttatttagtgtgtagtctttaaaatatgatcctctattccttttcaaaattccaattaggtcacagattttcctttccttttcctttcctttgctttcctttcccttcccttcccttcccttcctttcctttcctttcctttcctttcctttcctttcctttcctttcctttcctttcctttcttttcctttcctttccttcccttcccttccctttccctcttttccttccccttccttccttcctcccttcctttctcccttccttccttcctccctccctccctccctcccttctctctctctctccctccctcgctccctccctcccttctctctctctctccctccctcgctccctccctcccttctctgtctctctctctctccccctccccctctctccctctcttcctctctctctccatccctctctccctctgttgcccaggctggagtgcagtggaatgatcttggctcagtacagcctccacctccctggctcaagtcatcctcccacctcagcctcccgagcagctgtgactataggtgtgtgccaccacacctggctatttttttcactttttaattttttgtagaaatgggattttatcgtattgcccaggctggtctcaaactcctgacctcaagccatctgcccaccttggcctgccaaagtgttggggttaggggttacagacgtgagccaacacgcccagtcgtatttatttttccccacaaatattctatttgtttttttccccctgttttgaggattcaggaaaatgtatttattcaagagataactggtatattacaagtagtaaacagacagacaacatgcccctctgttacagctttcaatttagtggaagtggtatattataagtggtaaacacacacacaccatggtatattacaagtggtaaacagacagacaccatgcccctctgttacagctttcagtttagtggaagttggtgactcaggctaaattaagggaaaggggagatcactgggtatgttttctaatgaaaacgtaagtatgatctataattattgcagtcattaattatatgtaaatagactctttggacatactaccaatttacttgaaaagtcaatgctttaaggaattttaaacatttttcaactgtcttggttgtattttaataatattaattcaaactctgcaattaaatgactgactaacgtaaatttcaacctggcccccactttttgaattaaaaacatttatattagtttcagttactgagattttgctgtccattatggaaaacccacttatttattagattatagaaggtaagcagcaaaagatatatttccttcccattccttaaaatgtttcgacaagttaatgaaaacttattttaaaatttccttttagtgagaaatcaaagatgatcatttttagccccatcaggatcattttagaaaaactgcctgtgaagtcactcatttagaacgagacgatctctgtggaattgctgttgccagtgccacgtggggagtaattgggccaattaaaatgtagatgttttatattaagttgtggtgcctgttaaagtagagtaccagatttagaattagtctgtattccctttgttagtttccttcactcagtacatagaattttagttcatctgatagcttgactgataagtaatatatgtatataattaagaaggtgatagtctagtgccagtaggttcttctgaaaagcagtgtccaattggtaggacagtgagaagaaccttcaggcagtaccatctgctttgtcttctctttcctctgttctaccttacacctggatccaggctgttaatataaattatgattgctaaggttcatattttaggataactttgacaaagagacgtctggagtatcaaaattatcaaagatgtaaacttcttcataaatgtttttcaaggcaccagatggaaggaagctttactgtattacatttcccatatggaaaagtatctgggacctgaaaggggcacacccttagaaggagaacacttcttaaaaaggaactttataaaagaatgctatagtatagggttttcacgtatgatttattcacttgagcatattgctttgaaggcccaaacagcatcctgagcataagttgtggtttcctagacctaaggagtgtctgatagtttaaatttcacaaactttttagatttgcctatgccacaggtcaaatatgccttgctatgagtctggttgccatttattttagtcaaggtttggcttttgttaaaattgttgcattgggtttatgaaagatacatctaccttctcctacatgtgttattttatattaatagaaagtcaagatggtagaatttaaataccattgtggtggaaaaggtaagcattatttttctacagtgttctttctttcatttttgatatatatattttgtgatcattttcacttggtaaatattacataactattgaggagggcttgggaggatatgtggttctttttttgttgtccacttttttttacagcaataatatttctaaaagagtaatatgtggtttttaagaatacttttaaaagatttttcaaataatactatagtgtttcgagtgcgattcaaggaaaccgtatgtactcatgcatttcataacaccagacttttacagtgtacatcaaaagatagtcctaaagaggtgtattcactttgaaatgacattcagaaaattaaagcatattttcctgcagaataaatgtataaatggtatagacatcttctatccagggtagttgaaaaacctaaataattatgttaaatctggagcttctagacatgtttcaggaatatttttctgcttaggatgagctctacaatatgccatataattttcactttatagggtttatgagcaggatagtagtgagatttatagatgctaatatgttagtaacatttcaaatatttagttttgataaaagtaatatactaaatggaaggaattgcctctatatagccgaactaaccttgaggagcatacagttcatgagtaaaacaaacaggtaataaaaactgcttttgtttatagaaatttggtttaggacagaaactaaaatttggcttagataatgttcccataattttctcttatttccttccaaaatatatctttggaagaaagagcaaaaatacgaagattcatctgaaagattattatattttctcttttcatttaaagtacattattagcttgagttagaattctatgaaatatttatgggatatatatacaaagctttatttaatgttacagttattgtagacagggcttaaatacaagactgaaggagaaggggaattttttttctccatgtcaaacaggctgtccaatttatgaaaagaaagggaaaaaaataaaaacaaaaggctgtgtttttgtgagtcttaaattgtgaggctagaaatacatttagatagaataaaaactcacatacctcagcttattagtgattgacttttgagaccttctacagaaaagaattttgctgaacttcacaacaagaaagaccacatagggtattttagaccacttttattaaatttagttagcatttttaatttttccacaatgttgcatgcctttaacaaagtccattctgaaatatagaattgtctataaaagatttggatgaggtatagaaaggtatacaagaaccagagcaccaagggcgtttattattagtttaaagagtttcatttcactgaaagctgatttttttttaaagtgagtaaagcatatattagtatattaatagtggtttaaattcccagcattttattatttttcacaagtctgtgggtcagctgggcatatctgcagtgagctggcatgttgacctggggttggttggtctaggatggcccatttacatatctggctattaggttgttactggctgttggttggggcagtggagataactgggcaatttatcatgcgtccttcagcaggttaatttgggcttgttcacctgcagatagttgtagggttcttaagggcagcaggagagggcaagtccaagtgtgcaggcacttctaaagtgtctacttgcttcatatttgctagcatgccatcagccaaagccagtcacattacaaagcccagagctgcagtggcagatgactactccaggacatggataccaaagacatgagcaatttggggaccagtactgtaatctttactcacctgatttagtgtcttaggaagcttcatttggtagtggtatctatgtggaactaaggagtcctgagccaggatgtctggcttgaaagctgtcactgtagttcaagcagacataaggctggcatttaagagtaatggcagggaggataaacagcagggttagatacaactacttgctgactagatgcactagatgagggagaaaaaaaggtgctcataggttgattccaggcttcaagattgggtatatgggaatctaggaaactggtaaggttgtagacctaactatgtttatagtgaacataggacattcatgcaacttcctaaacaatttctattcctctgtccagaagtattaatatgaaagagatggaatctatgaaattccttttttgaaactgttgcttaaaaattacgccagtgctttctttaccatcagccttgcaaagatgtgtaaatgacaccaagtgttttctcccatcttttaaaaacatatgggcaacgttgccataaacaataaacccaaaagtttggatttcctagtttcatttctctgaactgagcagctacctaggatttttggaaacttagttttataggtgatgaagattatttttatatgtagaaatgtcaattgtgacaaaagttaaaaatttggaaatcattttattatctacagatctacagaaaaaaataggcagatttttctttccacctagatttaattttaagaatatgaatatttgattcatccacattttcatcttaacagatactgctacatgtttaaccaaaagattaggatttttgaatggtttgctatttagttacgtttcagagccaaagtataaaagttttgattttttctgccatttactttgtcatctaggttaaactcctccaaactgtgaatgttttttaaagaaatcatatctaggttatttatgaaaatatacaaaagccatcttcctgctgagtaaatagaaaactagtttgttcatggtttctctgtacttcttatagatgggtggagaatcatttttttgttaaagagtatacctacctacaaaagacgataaagagagatacttggggagaaagcaacttagtgcattatttgtttccagaagacaaacatgcaatttataatttaaattaagatcagggtacataaactattaagtatgataaatgacaatgtatttcaattttatattatgtcagtttagagagacggattaagggaaagggtaatgaaggaggaagagagacacagatttttagaaatgattttctcatgattttttatgatgtggttttgcaaccatggtacaaatcagaattaggttgcacagttagatgtccattcctgcattactattgtgtgattctctccttcacgggcagtcttatttactgtaaaactaaaacagggagacttccacaatgttagatcgaggaagaaaaccataattgataatggtaagaaagcttaacagtgccaaaactagtaatcctcaaaattgcatcttctaatatcacatctagagctctttgcattgagtaatatttctctttaaatcataacagtagtaattcattcaggataggactattttaaaaagcacttacaccattattggtttagctgatggtcacaaagtctaccagtgttaggtagacgtggatgtttttaaaaacgaattttagaagtcagacgttttttgtagttacattgaaatctgctgtattactactaagaatgattgtcttaaaagttgatttttagattatgtttctctctaataaaattcacttctataaaattttgcctgctgctataggaagacctataaaaacatacattttaactcagaaatatttttcctgcctaattatctccttgttggcatttgctatttagttacattgtgcttcctttttatatgtgatttacaaatagcagtaatgttgaaaaatgtaatgtttgttttaagtttataaacgacagattgaagtaatgagtttgtggatgtaccatgaaatacaaataggcagatttttcttcctacctaggtttagttttaaaaatatgaatatttgattcatcctcattttcatcttaacagatactgccacatgtttaaccaaaagtaacttatccctaaatttttcttacattttaatatctataagctgtcttatttttattggctttgattcagaattatttctcttttatgctttattccttatttgtatttttatcatagatcaaatgacagttttcaacaacacacagatttgtaatggctagaatctcatttactaatttattataaaaacagaataatctaggcattaaaaacctgtgtgcctgatacttaatctttgtgtttgtttccagaggcatgcagggtgtttcctgtccaagacacaaaccatatatttcatttgtcatatctaatgtttttcatatccagaaatcatgctccatgttatgttttacaagacttcataaaaataagtgatccaaataaaatttatagttaatttttctgtcatagcaaaattatctctttctcttctttttcccacaagggtacagatgggattataaagtttaaatgagtgtatatttacaaataaagtcttaagttttgaaactagacagtaatttattatttagacattgctagcgttgtgttggtagcattacaatagctttctaaatgaaaacaaaccaagcaaccagccaaccctgatttgcaagtgtttgctgatttctctggtgaaaatatcccatgatggctgatttcagcctgtcaacatgagtcactgaacatggagttgggaagagatgcttagtcacacattattatatggtatttccaccataccagacgtaagtagaagcaagtaatcttcagagcacagataatagtaaaatgtagtcaaataattataagaacatagataatagtaaaatgtcaaataattagaagtgatgaattttgagtacctattatcattgtttttaatttttttcattgcatgtttctaaaatttaatttttaatgtcgtctgtttgaaccaccaactcccaaaatttccgaatgtttagcaatcagctctcataggctggcatgagccagccctagcacactactgcacaaaaccatttctggtgaataggaagataggttgtggtcagtgtctattgtaggagaggatgtcttgtgtctgcgtgcccagggaggaaaagcagccattttctgtttcagctcacattactaaacaccacctggtcccataaattttggtatttatattaatataaggccttgaatgagagcaaaataccagagtcttttaataaaaggacagggaaaataaatattttcattacaaagattacaaaaataaagattttcattgcaaaattattcttatttttttttttctgtatgtctcttggctgttgtatatctcccacttgaataataagcagatcctatagtcagtgcttcctaatgccactccagtatcaaggataagctacttaaatagttttactcaacaggatatattgataatttatgtgttaacagaaagtagtagctgtgttgttaccaaaaaaaaaagaacttaaatctttaaaaatttaatatgcgttagcaactgagataacgaaatgaacagtgtggagttaaagaatctcatgcaacaaatggcagaattttaagtgcattttgtcaaacttccccatttaagaagagggtgagctccttcctatattactattggcagcttatcggtggtgttagtcaagcattttgaataaaataatatgttaaaaaatataattgatttctttgggggaatacaggagatctctagataaattcatttagatgggttgacaaaactaatggtgtgcatgattaagaagaaaaatttgacatattctgtgtataaccctttgagtattaattctgaccagatcacactgtaaataatgttaactgtcataaaataaacacagccggagtttgcaccatatgttttataattattttgcagcttctttttttttgtttgtttgtttttactgaaaatggaacctactgataactctgtgaagttatgtttacataaaagtaaattatacttgcacgttaacaaacttggcttcacagaccagtgtctctaggtttttgtttaaaaaaaaaattaaatgaaagaaaaacttctccctctctcgcttggttttttgtttttttttttcttattccctcagaaacatcgtctcaaacagaaatctgctgtagcatcttgtcgccgctttcttgtttttgcacatgtgaaggagaagcctttggaatgccacccagaggagggaaaagcctaaccactgaactcacagagagtgtttggtttaagtagccctggagtggcctttcagactgaggctactgtggtcttctagtttgtttttgttttctaccttcttccttgcaagtgtttaacactgccagaaataaaggctcccttagaacatttaagtaatttttaaaactgttattattttcataatcaccatctcctcttgatctcaggggaggctaggcatccttgtttatctttaatagagccttggaaactgatagtgccaatgggaggtgggtggcaagtttcgtaatatgcctacctcctcctgccccctcccggctcattgctaaatatgtctcttggcagatctgacaatatccataattatcaggcaccgtgagccctgctgcagagctgcttgtgcatgacacctgtccagctcatgctcttcccctgcatctcctcatgcctcggcttgctggctggccgtgcgtcagagcaacagtctgccgttagtgaactcatttctcttcttgtcagattctcagacaccagaagttctgcccacacagcttacaacatataccatggtttgtggtgcaatctttcacacagtaggcatttcataaacttttgtgaacaaatgcaaaaagttaatgcagatatttctctcagcattatggtttacattctccctctatgaagtgcttttcccgctcttgacagatttctcagcataatatcatgttttccataaaagtggatcttgatcatcgccctctctcctagacagagaaaagccttgtcagtttttttatgagagagaaaatccagggaaccccaattggctttcatagtgcttagcaattctcatgaagggggtgaaatgtggagtagagaaatgtacagtgatttctggaacttttgttccagaagatgttaataaggtgaagttgttgttaactaaattttgcaggtataataaaacttgaagatgaagctatattcagggagaaaatctgcaaagagaggaatttcgtaaagggcagggtgaacagtaatgccgcttcagtagttcatgcctgtgcatagtcaaccttagaaaggcttttttaaaaaaaaaaacaaaaaacaaaaaacacttcacttttttggccaggtgcggtggctcatgcactttgggaggccgaagtaggcagaccacttgaagtcagcagttcaagaccagactggccaacatgatgaaagtgaaaccccatctctactaaaaatacaaaaattagctgggcatggtggtccgtacctgtaatcccagctactcagaagctgaggcagaagaatcggttgagcctgggaggcagaggttgtggtgagccgcgatcatgccactgctctccagcctggacaacagagtgagactccatctcataaataaataaaaaataaaactaaaacctcagttttgaaggagaggtcatagatttcggtttggggatttatttagtggaacagttgtcaggtattcatagaaggttggattaaggatgaaacttttcatccttagaaactacagcagtctatttaatgaatagcatactcaaaaattatgacttaatatttttattatttataaaattttattccactagaacaactagtaatcatcatctattatgcagttttgactaaaccctttttccacaacagggaccagaattaggtaagaaaatttgggaagatgtcaaaatatatcaaagcttccttttaaatatgtgttattggtttttgattatgaaagtaatacaaaattaatataaaattgaaacattgcagtaatgtataatgcaaaaatgaaaactgtccatagcccctttttgtagagataacacttctccatatgttatcattatcatgtatctgtggcactaattatgattattagtaaatggattcattctatgtatatttttcttatatcctactgtttaaaaaatatatcttgtggttgaccaaaaaatatctacccacttccactcaaaatatccatgtcaaatccctggagcctgtgaatggtaccttatttggaaaaaagggtttttgcagatgtgattaagtcaaggattttaagataaggagataatctcggactctgtgggtaggccctaactaccatcctgtgtatccgtgtaagatattaggagattacatacagagcagaagacatatgcaaaggaggaggtgaggtaaagatggcggcagagcctccggaagctaggagagaggcatgcaacagattatttcccagagcctctgagtggaacacagccctactcacacctcaattgcaaacttctggcctctggaacagagagagaatatgtttccattgttataagccactacggtggtagtaatttggtgtggcagccctaggaaactaatacaggcctctttccacgttagtatagagagatctcatccattttttgaacctccatataatttcccattatgtggatataccataatttatttagtcacttatttaaagacagttgggttgttttcagtgtttgggcttttcaaacactgttgtaggaaatatccttatatgtgtttattactgtgtatgtttgtttttgtagaataaatatttagaagtagaattgccaggtcattatgtaggtacttctaaaactattgtattttgggtaaatatgacatctgccactttgataggaatatttatgctactctatcatgactctggaccataaacaaagtagataactatagaaaccatctcatatattaacatttagaaaatcaacagtggaagttgttcctctcaactcagtgttctgaaaagcctgaaagctcaatatatactgagttgaaaatctatgagaataaatatcctcaacaagtttttgtattttcgtttctctaggaactgaaaatttctgtgacatacctattgttttcccaccatgaaacaagagctgttaaagagatgacaagaaaaaataagagaaaaagttatattcaagaactattgtcattttagaaaataagtcatatattattaatggagtttgttagtaacaattatcttaagtaataattattcaaaattgtaaagaccaaacctctatcgtttctttgtcatgatttttcttctcattttgtcattctaaccccacagctcttcaatctttcctcacttccaagtccattttactgttgataatacaagatgcatttggcatctgttctgttgttaaagccctcaggaaaaattataaagctgttcttgcaaattcatcattattgttaagaaccgtaatttacctcatggttatctcatcctttttccacctcttacctgagctccaggatgacattgccttcctgggtgaggcagcgttgcagcatctcatctctcccaccttaatttgtagcgatgcgttgcatttgggtgacaggcagttgttcgtgcttgaataactcaggatttgaattctacagtttgtggcatccgtgtaatgcttagcagtaggtacagctgttaactattcgcttataaataatcttttttgcctctcaacctgtctcccaggtagtgtacctgtcaccattaataactctttagccgctccctagtgatttgacctatcagttgtcgttcacagaaaagtggtgctctggcctgctattgaagcttatgcaggttctttcagctcctcagtcaccccagcagccatatacttgtaggaagttgtgttggtgggcttcacaagcaggcagctgaacacttcgtacagtttgataaaggtggcattacattttgaacaatagatgataagactcccatttagaccgcaaaacagtgccacaggggtagacaggggtctgggggagataagatgggtggtgaagatgaccaacagcaaataaactttcctgtctctttgatgctaattatctctttgcacctaattatcatggcatcatcatcatcctctgatgtttgcaaactaagagttgatgtgtttgatcaggttagtgaatctgtcaggtatggcattctgcctgtttctgaagcttaagaatgagaagccagtagctatcatgcggaagatgtgaactgccccccagtccttgtcctttagcagtgtgtcattcctctgtttggacatgtgctctcttgcttcctctcttcctctctctgttcctgaagtgtgctgcttccaacacttccccaaattaattcctacctgcatttaggtctcaacctagccatcactttttcaggaaactgctactgctctctctatttggcattgactgtaccaactaaaatgcccatatggcagttttcgtttatttcttattatgctctacaataactgcttgtttacttgtctttttctcctactggattgtaagttttttcatggatggtacatagtgttgtttgctatatccacgttctgggagtgtcatagaatctcaataaatttatgtgaagagaatgagaatttattttttatgaactcactttccattgacatatcatggtcatatcaatggggagttcaggcaataaattatggcatatattgtctactgtatactgtgctggcaccaggggttcagataggaaaacatttcgattgctttttacccttttagtgagtgactaatggacatttctttgtctgaggatatatcttggcagtacaggatttcttcagacgtggctcaggaaatggccgagagtaaggtgaatcacaaggcaaaaaaaaaaaaaaaaaaaaaaaaaagcattaaactatgttgggaagtaatcccagcattggtggacacacattatgtttttaaaaataaatcctccaaggaggtaaatcagttaggtattatgttggtttggttttcatttggaaaggaatttacctcgtaaacgatctttgttatccttatctcactgggtgtaaggagttagcaaatgatcacatttttaatacccagaaaaataccatattctttgccacacagatgtacgcatatgccacatatacatacatatatgtgtatgtatgtgttcctttatatataattaaatacaacagtgatctgaaaagaccaaaaagagtaagaaacttagcattttagggagaacaaaaacaaaaacccaggatgaagcattttagtttacctttataaagatcaggacaggttatgtctgtaggaacttatatacagtatctagtagatagaatgataaaataagaaacaaaaagtatttagtcataagttcaaggatagactcttgattgtgctgtatcaaatacacttttaaagttaaaatgtattctaaaaaggaatacatgcctttagcaaaaaaaaattatataaaggactgtggttgaaagtaagtgatattggggtatagttctagaaatagtctgtgcatgtaaaacacaacatatctttctgtgtgtttgataaaaatggtgaaggggaatatagtgagcacattattctgcacttttcctttttcacttaataatatatcttgtaaacaacttcatatcagcacataaagagctacctcattcttttttaacagctgcattgtatggatgtatcgtaatttgtgtgcctattccttcatacactggtagactaggtgatgaaacatatttttgatctttggtattctggttgttgataggggataaatggtagtacattgcttttatttgcatttctcttaatgagtaaggtttaccatccttttatgattatcagtcatttctgtttccattttttttctaaacgtcttttcaggttctttctatatttctattgcgttgtaaatccgtttcatttttagcacctttttgtatctaaagagtattagcccatagtatatctgtattgtgaatagttgttcatagttggttttcagctctttaccttgtttttgcttttgcttttcatttgtttttgttgcgtagttggttttctttttttaagttttgtgtggttttattaccttttgattgacttttgattcttgagtctggcttagaaagatcttcaagtccttaaaacaatgtgaactagttaatgttatctagttatcaatgttatctactagtattttatgtagtaattgtattcagtgaatttcaatctccttccccccccctcccccactccgggtctctgtctgtcacccagctggagtgcagtggcgctatcacagctcactgcagctttgacctttcaggctcaagtgatcctcccaccttagccttctgagtggctaggactgcaggtggtgccaccacacccagctaatttttgtattttttgtagagacagggtcaaactatgttgcccaggctggtcttgaactcctggcctcaaatgatcttcctgccttggcctcccaaagtgctgggattgctggcatgagccactgcatctggcctgaatttcagtcttactgaataaaatttttcagccaggattgttattttcttaaggtaataaatgttgttgtatagagcttattattaataagatttttcattcatctattttttcttccactgtattgttattttaatgacatttatttacacagagtatgttaaacatgttcagtagattattatacataggaacatcagagtcctatttagcaaatagactaatttaagctcctaatatttttaggtataatcctgaatgtgtatttagaataagaaatcaccccccaaaaaaaaacaggaaatggaaacaggaatcaaggagatttgggccctttccttctaaatttccttagggaacttgtcagaagtgcttacctagaaatcttgcctgtttgcactctggcgtctccttaccacctaggatgttctcttactctgaaactcctaacgacctaggcaaatgagagacctgagctgaagccccattcactctcaggttaaatctggtgtctactagtagctcatactgtacttcattacagtttcatcagtcattaacactggtagcagtttcaaaggggtcacagtcaactctgttgctactggtttccttgtcattttatttaacttttttgtctttattataattcgcttcttttaccatgcatggtgttctcaccccaagtgctcattaggtagtaaagaggaaaaggtggagattgaagaagcagcttatttcacagcataatctcatatggtggtgttttgtttttttgggtgaagctaaaatctgttagagttgtaaaatagaacagttattaaaatattcttttttgagatggaattgttgtccaggctggagtgcagtagcacaatctcagctcactgcaatctctgcctcctggacgatctcagttcactgcaatctctgcctcctgggttcaagcgattctcctgcctcagcctcccaagtagctgggattacaggcgtctgccaccatgcctggctaattttttgtatttttagtagagacagggtttcaccatgttggccaggctggtctcgaactattgacctcaggtgatccgcccgcctcggcctctggtgttgggattataggtgtgagccaccgcgctgggccaaaagattcttttaatctttttttgtattctttttccagaaagtttatacctttcttctctttagtcatactttgaagagggtttaacaagattcaccttcacagttgtttttcaaggcagcgttaggacctgacattaattgtttttttttgttttgttttttttttttgttttgagacggggtcttgctatttcgtccaggctggagtgcagtggcgctatctcggctcactgcaagctccgcctcccgggttcatgccattctcctgccttagcctcccaagtagctgggaccacaggcgcctgccaccctgcccggctaattttttgtgtttttagtagagacagggtttcatcgtgttagccaggatggtctccatctcctgacttcatgatccacccacctcggcctcccaaagtgctgggattacaggtgtgagccaccgcgtccggccagttgttttattttaaaaaccctttccgtgttatgtttgtgaacagagccattttcattgataccgctttgaaaacacacgaatagacactgaaactcgatacctgtgttttctctcaccagttctgcttccatgtttcattttcactgttctcagtcttctgattgagtgaataattaaatgatgacctgagagattggtgggagtgaactcttggagcatccagctttctttatgaggcttagactggcttttctttcccatcatggttttaggcttgatagatgactttatacttttctggacagctgggggttaaaacagagtggtggttttgatttttggcatttttcagctgctcctcaggagaatataaagtgcctgtggagcaggtccaaatcggtggatgtttaagagaagggggaaaaaatagctgaagaacattcttctgtgacttagttgccttctgttgcattaaatggatggaaagggggaataagtgttgtgctttatcgtttttaacattaaaactcttttaaaaagcttcaaaccttaaaaaacacgaaatgaccttcaggcctcttggctcccactgttcaggttatcaagtctcagtcacaccctcccccatccctgtaaaaaatctaaagagaagtgtgaaaagcatcagaaagtctccttttgccagttcagccttttagtcgcttgccagcaccttcatctcttcatatgtctctagctaaggtcttacatggaacaaaaacccgacagcaatggagaccagatgccggtatttcttctctgtcacttggctgctgagcagatggaatttatatcaatcgggcatgctaggaggaagaggccgtggcagccaacatgtggaactggggctgagtgacatttctgctaatgttttgtccttgtagaacattatgcttcctctttgcttatgagctgtggttttcctgactcagactaggttccagctccagctggaatggctgttgctcttcccctctcctcctgccccccttttcagggagtgctgggagctaaggaggagtagtggggcctgcacaatggagctctttattaaaatacctgacatctgcatgcaatgcaccaaaatcatctcagctcaagcagaggaatgtgctgggcattactagtcactttttgtctagtgctgtgtgcttgtttgatttatataatgagtgagtgcctctggcaaaagaggatgttgagcatattattggaggaagggagctttttaattttttccaagaacattgtcacagacaggcctaatactcatacaaaaatatgagtatttaaaaacggttgcagctatcccatggatttcttgctgtggcttaaaaaatgttacacccccctctgctccatttaaggtaaaattagaactcagtaatccaatttaacatgatatggagttttaatgttggtgactactgttagtaggaagtagcacttttaaggaatctcacgttacaaagaatctctggaaggaaaacgtaaaatacatgtcaaaaaaccataaaggcacacacatagaaagaattattggtgagtctttaattcccgtcccctccctcagaagagtacattactcttttcatactgcaggaaataggtatatgtgcgcaaattatattttcttctctaatgatgtaaaccattcacgttttacctatttatggccagtatatgacgaatactgccatgctaacacgttatatcataaagcactgaagtgtcatgacattgctgctcacattgccaaatcagcaacattgtccccattcccacttagaccttttatttccggtggaaatttaacttaagatttcagttgggttgtgggtacattcggagcaccagacaggggaggtagagggagatagagcttccactatttttgttcctttcttttgaaaagcagcctctggcagacctttcctggtctcttccaaatatgtcggccacatctgtcatatcttgagttttctagaaaactcccagggcaggctagccattctttatctttaagaagcctaaattctgtctctttatcacttttttaagtgattctcctgtctgatgtatgttcctcttatatcttgctccatggtgtggggatggccccacagttcccttgggattgaagtaaacccatgtaaattgatgagaagctggagtaaaatactaatattagtatgtctggagaaagacccaagtcagtcattcttggaggaaattcttcaaaattgccttggatttctgtttttctttgcaatttttttaaagctatgcttgtgccatactgaagacaggatttcttatttataaagtcattcaagtggcctgatataagaaacttatagtaacacaacatatatgcccatagcttatgcaggtacagtggaacctggaatcacaaagtacagttactccttactgtgtgaacttgagctctctgtactcaggaatgatatggattcagataaattacttagattgggctgctgggatgaaaggagtctcccttggtctacactctcttatgtgctgttcagagaatgtcctatctcttgctctccaactcttgctatctatgctatcattgtctaaacacaggaagaagacagatttaggtagtgaaaaatgtctgtgcatgcaactacctgcaatattgcagaggaataggaatctcatgctctccattcagattgttcttacaccagttcctttccttctcgattttgtacttaaccattcctgcttttctttttgaatctttggcttctttcttgttcaaggttttctctcttgcttctctccctttccctcaaaatcactcacataatgaagcactgaccttcgatgtttccttttctgtgacccttatgacaagaatgcttcaagctggaagagcccaagtgtcgggttggtgttcagcagtgtgagatgattgttttactcttgcctgagagtcccatcaagaagcacgggaaaggtttcctcgtaggcctcctggaactactgtgcgtgtgcatttagctggaagagaagggagcagacatcatcctgcagaagtcagattatggtagccaaaatgtgtcggtatctgcccattagagtttctcaagaaggattcttaaagataatttgatttggtccttggattctgggccttgccatgtttggtcccaggaactatggcactggtccctgccagtgtctgttgactgtctcgtgggtatggtcatctgtcctccactggaacataactcctttagttctacctggaaggaggccaaacacagtctttggtgttgtttcaaagtctgattctttctcttgccagttgtatgacttgagcaaattacttaacctccatgaacctcacttttctcttctgtgaaatagaaatgataatgtctaccttacagggttgtagaaaaaactggagaaaatggtagttaagtgcttagtacctaatgagaactccacaagtagcagctatttttgttgtcattgtctgctaacagcatggcagccttggacagcctttccgtctaacctcatgtttcacttgatcagcagcagccccaggtctaactagtgtgctgcctttgaagtccacccactgccactagggctcattcgccactacaaaatgagaaactctcccagaagtgagggttgtctctacctgtccaaaggaacacatctctacatccgaagaggttatctcctaaatctgctaaggttgatttgagataaaagctccaattcctatcttttgggactttacgttagaattttcagaatccttgtctctggcccttgatccattcaactagggctactcctctttccagctctagacaaaatttcttctgtaagaatcaccccctcatacctatccctcccctctattgctaatggaatgcactgggatttatcatgcaaatgaaggtcacacctcccagagacacagtccctagacactactgggttatattttaatgacagctgagaaggtagggccagtaaaggaggcattcatccctgtttaaaagaaaacgaagcacagtgcttacctctgtctctttctaaaaattaatctgacaattctggcaagcacaccttctcttctcagcatagagacatgctgataacacacttgctttttgtttgtttgtttgactcaccaaactatatgataaagacatttgttttctggttttattaaaatatgactttagggccgggctcagtggctcacgcctgtaatccctgcacttggggaggccgaggcaggtggattgcctgaggtcaggagatcgggaccagcctgaccaacatgatgaaaccctgtccctaccaaaaatacaaacattagccaggcatggtggtgggcacctgtagtcccagctactcaggaggctgaggcaggagaatcacgtgaacccgggagacagaggttgcagtgagccaagacggtgctactgcactccagcaagactctgtctcaaaaacaaaacaaaaaacaaaaaacaaacaaacaacaacaacaacaacaaaaaatatatatatatatgacttttgcacctgtacatcccaaatctcatgtaacagagactttagtagaatatgattaataatagtaaggtgggggcatttgccctttatacctaaaaggcatgttttctatttttattttattattattatttttaaagatatggtttcgccctattacactggctggagtgcagtggagtactcagtacagccttgacctcctgggtttttgcaatcctcccacctcagcctactgagtagctgggaccacaggtgcacaccgccatgcccagctaattttgtattttttatgtttaatagagacagggtctccctatgttgcccaggctggtcttgaactcctgggctaagtgatcctcccgccttggcctcccaaagtactaggattacatgcatgagcaaccacgttcagccatatttttaaatttaattttcattattatatttttataaataattcaagctacaccgaagtatatataatagaaaatgaatacacacatctattgtcccttctttccagatttcactctcaagatgcaactggtaggcccaataaccagtctgtgttccttcgagaccagtaagttttaagggatttggtagaaaccctggcatgagatatttgtgccaagtaccatttcggattggtttacacatctgaagtatggctgagaattctgcaattatctagtatattaatcatcttagaaaactcaggaccctatgacttgtccaccctgctttagaaataaaaatgtatatggttacatggaacctacaatttactgtgtttatataaacaccccaggcatatttcctttcaaaaatgaaatgaatgatatgatttttttgtctcctttaagctttggaggaaggaagtaaactaatgaactttatgctcttgtaaatgtaatgctttgcatcataggacaccaggtcaggtttgtacatttacttaagtttgtgtgcacttgtgtacgtgtgtgtgtgtttgcaattaatttgtcaggtaaattacagcatataggaattaccctcccactgccccttctttctggcaagcaatactgtttaaaacacatactcatgatcagaattgggctaaaacattttgtagagctttatttatttaatgagataccactaaagccttaatactgtaaggcaaatattgcagtgaatgccagtatttcagtatatagtagcatatccttgcctttcagtctgttaagattgactaacatttaattaccttgcctatgttaaaaaaggaaagaaattaccttatagggatatgcaagctcctgaggtttctcagctgtgagcccagccaagttgccctcctccaactggctacttccctcctcaacacacagaaccttatacacaacagtaaataaccctcaataaatttgaatcttatctcaatctaaagacaccaccatcattatgggggaatgttgttagtcctcaaaacctcagtcagtttagaacaacacagcagtatccaaactttttggcttcgtctggatattgttactgcaagtgttggtgctgcattcctggatgccgtttacagagtgatttcttaaacattggttgtgtcacagtgcaactgaccagtttaaagccttttgctattttgctcacaatcaaagaaaccagaaacatctaattaacgtttacctcatttagagttagaatcacctgattattttactacatttggaataagcataagagatgcttttaatacgacaaattttaaaactatctggattaaaacacctttttattcacttttttattaagataaaactataaattaataattagtctcctattagtcttaagagatttttcaaatgactttggattttaagatgaaaaaagaaaaaaaaagaagcacacatttaactgagtttgttttgtgtgcttgtttgtatatttagactgtgtgtactagaaagaacccgctttgggatagaaataaagactctttgagttctcaccctgtattgggggggtttctgggtacctatgtatgtaatttggacattgatgatacataagtgatatttatctcagttggtatagaaggtctcatgagttatcttgacagctgcataactgttatccactgtaaactcgcttctttaggttagtgtggttagtttttttttttttaagtttccgcataatcattggggaatcttagcatttaacttgcaaacgcttctcagagttctgatacctgaggcggcatcacaagaacgttatctacaccagccccatcttggtaggactgaaaaaaaacaaacaaaccaagaacaacacaaagaaaatgcatgttaatgtggctgaatattcattagaaccctgcggcctggggctggaagcacagttaggctgtgtgtttaccaggccacccgaaaggcaagagggcataaggcacttagaaacagtggctcagctcaagcagtgttgtctttgaaaagttttcattttcccttgaatcagctacagtctcttacttaaggtcactgcagtttgcaatctttggcagaagacttcttccttttatggtagtggcagtctgacttttttttttttcccttttggaagtgttttcctctcaaactgccattatcttccaaacctgtttcatgttacaattgtcagatgcctcttttctgaatttcttagaacataatgcaatgagatgtatatatatatatatcttttttttagcatggaattgaaagtcatatggttatgatttgagaatgtcaagcttgattttttttttcagaggttttttttaaattttttttttttttcaaattgtacctttttctctgggcagtgaactcactgcagagacatcaaagagaatgtgtactggatcaaggtgattttttttcgaccacatcattgccagctgtggtgtttatgattagagacagacgttccagacacctccgagtcctcactaagcgtcagatctttaacgggatccatcccaactgagtgacactaaacagacagccagaggggagttggtgggatagaacagggaagagggcgggtgagggtgagggaggctttggtgccgggtgcattcaccagccaagctccgctaatgccaggctgcaggctgcccagaggccccgtagcattcctttcagcacagctttcattagccaaggggatgactggagcccagcaaacacagtcattgatcctcttctcaccgggcgcagggatgcagtgttcaggtcacagcccagtcggctttgaagcggctccatttcagacactgacagccacagactattggcttcttggagctgacatgattccctctcggatctccatgctctgctccatgcagctaatgatgttgaattccctctggatgttgcttccacttgcaatattaacacttgttcagtggtcctattgatgcaagaattatgtaaatagccaacagtactgatagctgtgcattaaagggagttctctttcctcccgtctgttcccttctgggtcagtgtaactgccagacagttttgctggttccagaaaccagaatatatatctggaatcagtaatcaatgtggtggtttggagttcaataattggaatttttaaaatcaagatgatctgcttatccagtgattgccattagcaatgaagaaagaaatggttttgttgacaactacttatttctctctccatgtgaaagtgtttttttgtttgtttgtttgtttttcaattctgtcatcatcgagacgtggatcccttgctaacaacagttcctggtgactatagaaattaagactccttagaagaaaaatgttattattacaattcaaaaaagaaacaaatgtgctcacctgttggtgggaggacaactgaaatttgcatgtcaactgtaaacatctgaaagataaataagagaggaaagaaagtttatgatacagataacagattgctagtacagagctgctttttcagaacctctcctttattaccagtatttttcccccctttttaaaaaaaaatctaaacaattagatgtcagcattgggtgaaaaacacataacaaaagattctggcttttgctcatcattctgatctccctgctctgcatactgaagccccacttccttttgttgtcctcccagtggaatttcagccactcagaccagtcaggggtgtgttggcagctatcctctttgaatggtagagagtacatttattctttgcacagaaggaacatgaaaatttggtttgaaacctagtaactctcaggctgcatggtctggagacaatagaagtatttcatcccttgaaaccagacgaatcttgagtaatcaggtgaacctgccttgctggctggtggtgcttcactgaagggttggaccagggtgtagaaaggactttggtggttcagatttccactggaaaactgtgacatcctgccatctcagagaagaaagttgcaggagatagccacacgtataggtgattcctgcttatctggctaataatattcttgctaatatttttgaaaagaaattagttttgggccttcacggaagctaacatttaatctcatagggcataaacacgagcgtagggtggaataacagcctaatgttttgaaccccatgaatttgctaatccataggaagttccattaagaaactccctagttcatcattcatagtatttcacctgtagctctaatccccaggcccatgactgcccttctctcttctgagttgtgtgtcagtcttcaacctacggtccttcccgactatggactcatgtacaactctgaatgaaactagcatctttcaaagaagagtctagttttcttcctggtcctgtacccctctgtgtttcgttgtactagagaaatttcttatttattaagaaccttttcggcctggcgcggtggctcatgcctgtgatcccagcacttgggaggccgaggcgggaggatcacgaggtcaggaaatcgagaccatcctggctaatatggtgaaacccgtctccactaaaaatacaaaaaattagcggggcatggtggcaggcacctgtagccccagctactcgggaggctgaggcaggagaatggtgtgaacccaggaggcagagcttgcagtgagccgagatcgtgccactgcactccagcctgggcaacagagcgagactctgtctcaaaaaaaaaaaaaaaaaaaaaaaaagaaccttttctcatgtcttagacccgtgtcttcataaaagctatttactttaataaagttttcacattttgaggggaaaatagtaataaataacattctatacctttcatttgcatgaacactttatttcattattatgtttttcttttcttttcttttttatttcatttgagacagagtctcattctgtcacccaggctggagtgcactggtgtgatctcagctccctgcaacctctgcaggttcaagcgattctcatgtctcagcctcccaagtagctgggattacaaacatgcgccaaaatacccagctaatttttctatttttagtggagacgggtttcaccatgttggccaggctggtctcgaaatcctggcctcaagtgatcttcccccctcagcctcccaaagtgtttggatttcaggcatgagccaccacgcccagccatatctcattattttttaaaagtttattttgtatgaagaaagttatgctttatgccagtgctacccttctccagtaaaacaactaattgatggttgagatgattgttttatttgatgaaaaatgatacttttatatcaaaaagattcttactagttttttatagaaaccccttaaaacatcaaagttttatagtgtacataaaagatgtgtttgtccacatactaacctcgcaaataaatgtataaagtaaaacaacaaagtagttttattagatgtgcctttgtcatcatgcaacaagttagttcagttggttgtttatttaattacattgtgctcaggttctatttgtgtgtgtgtgtgtgtgtgtgcgcgtgtgttacctttattggtctttaggactgctgtgtgtcagcattatcccattttacaggttatgccacggaggcagaaacaagctctcatcagtttgattgtgagttattggcttgaggattattatgactcatgatattttagtgtcctcagtaacaataactttttaaattgctcagaattttatttaccacatgttgaaatagcatgatttttaaaagtactcagtccttctatttgacagaatagaataatttcatcagtaatttgatgatcaaacacccttttaaggatttcatttcctcatcacttcaaggaaagaaaaaatattaatattgaggagggtaatgcgtgtgaagctttcttcaaattatgtttgtgtgtattcacatgtgtatacaatagattaataggtaaaatagatcaatagattaatcgcttgattcaaacaaataaaagtaggtttcacataaatttttgattctgttgtatatatttgcattagtattataagtatcataatgagatttttacggagagcacttttgatggaattttaaatgaatgttttaatgtattattggctggcacagacacacaagtacacaaatcctttagtgtgatggccttgtgcttgttttggtgaaatagtattacttctatgatacatgaaaaaatacctttgcttactttatcggcaaaaggtctttattcttctgcccctggagttaggttaagagtatatttattagccaggtgcagtgtgtctcacgcctgtaatctcagcactttggggggctgaggcccatggattccttgagctcagaagttcaagacctgcctgggcaacacagcgaaaccccgtctctacaaaaaaatacaaaaattagccaggcatggtggcttacacctatagtcccagctacttgggagaatgaggtaggaggatcacttgagcctgggaggttgagactgcagtgagctatgtttgagccactgcagtccagcctgggtgacaaagcaagaccctgcctcaaaaaaaaaaaaaaaaaaaaaaaaagtaaatttattgccaggcatggtggctcatggctgtgatcccagtgctttgggaaaacgaggtgggacaatcccttgagtccagaagttcaagaccagcctgggtaacatagcaagaccctttctttacaaaaaaatttaaaaaccagccagacatggtgtcaggtgcctgtagtctcacctactcaggaggctgaggtggaaggatcctgtgagcccaggagtttgaggctgtagtgaggtatgatcgcaccactgcactccagcctgggtgacagaacaagacctgtttcttaaaaaaaaaaaaaaaaaaaaagtaagtttagtgatctccattagcttttctgagaaagatttcatattaaacaaaagctaagtggctattccaagttttgcctatccttctctctgccttttgtggaacaaatgtgtgtttcctgacagccttcaggtatatgtgtaggtctgaaaaagtatttcaatgagaattgcatattgaggtcatctggaaggaaatgtaatattttgcccatgtaaaatctcgcaatcattactcagattaaagacaaagtgaagccagctagctcagttaaattttcagttccctcactttagcaccaaataccaccctggcagtgaatcacctgagaatttcatccatcactcagtgataaaatttgataacatttgtaggtcaatttattcccctggaatttcctctacaccttccctatcctgtcatgtgccatagtttgaggaagaggaaatgattcaaaaatctgtaaaggcttatctgttgatttctgacctaggaaaaagaaattaaccaagttttaggtcttgtatttgaagagctggtgcaaatatatacagcatgtagctatgtcgggacttggtgaatttccctgactttgtagattatacaccaaatgtaagggtaagcgaaagaagaaagagtacgtgaaaggaggtcagatacctctgtgtttcctgcctttttatatcctaattttattacagaggggcgttaagtggatctccttgctttcttttcatgacgaagtaggagactttccttttggtagctattgtgcacctctaggaaaatcagcaactcagcagaaaggaaaccaggatgcaggcctagcaggaggctgtccacccagtgaggaagttggacattttctcttttgtagagatgactgatgatctgtggaaaaagaacagtgggcactgaggccagcttctctaagacagcttgagtgaatgtgtggctagcgcttccttgattaacagaggtctccctgaccgtggcaatgtgttatgactcatagccttgcagagatgaattgttcctgaacggtttctccaacatctgagatacaaacaggtcttttagccatttgctagacaccagaagaaaaaatggtctaaccagtgtaagacctggaaacagcctagaatcttcaaaaatacttgcactcaaagtcaccttaattttagaacccaaaatctggacagagaaccatgtcagctaaccattacagttgaaagttcatccaggtgacctctgtttcttagaaatgtacaaacaacctctacatatttcttctttagtagttaaatgactttataacttggagctttggagattctttttaaaatagcaagtaatactgctttctttggccagataacaattttcctgctttcctgaatagaaatttgacaggttttggaaccttatactttggtatggaactgaatagatctttgaagccttcagaattacttttacccaggttagtaactttgacttactctcagtttaaactgttccttttgctatcctggttttctgtaactgggatggatatgcacagaggagtcggttgtttcttaatactgttttagaaaaccttgtgacgtggtatggattcccagtatgtctgataccaatgttactagtgaaattggctgagtaacttatgtgtgcaaggtccttactcccaacagttagagacatttatgtgtttcctgtcctcgaggactgtagacaacagctgccttgcatgaaatgattgtagtacatttaccaacatttatatgccaataagtagaaatgtatatgttagaatttgaggatttaagtgttgaggtgatctgtaagagaagataccagagccaggtggctttctttgacagcttcctggagaaggtgagacttgtgcctagatatcaaagttgctgaagatgaagtggacatttggggtgagtttaagatgtgcaaaacattggctgaacatggtggcttacggttgtaatctcaatgctttgggaggctgagggaaggagtttgaggccaggagttcaagaccagcctgggcaacatagtaagactctgtctttactaaaaataataataattaaaaaaacagccaggtgtgatagcatgtacttgtagtcccagctacttgggaggctgaggcaggaggattgcttgggctcagaagttcgaggttacaatgagctaattgtgccactgcaccccagcctcggtgacagagcaagacaatgtcctaaaaagaaaaaaaaaaaaagatgtgcaaaacatacacagaggagggaaagagtagagaagtagactgatttgtgggcagaaggcagaatatcctggatagaagaaaagcagatagttgaaaaattaactttgtgggggctagcatagtgtatgaaaatttggatttgggcctctgggcataaagagccaagaaccaataagaattttgacctgcgtggaacaataggatgaaaatttcatgaccaaagaattctggccataataaattcaggtgtgaagaaattagaagaattttcttcagatattcaagccaacatgtacatgccagaaatacaacagaatggatagtggcttgaacgtcttgtagggagagaatcaacaagaattatgatgtttttttactgagcattaatagtgagagatcgaaggactgtgtctcttttgttgctttgtattattaattgcaagatgttggtgatacagtctacccaagtatgtggcaagaattctacataccaaaacctgtttaagagttgactgatgtgttggaaatgtccgcgatgatcaagtccaagatgtctttgaccagaagtcctgaggacctatggagcagaataagtaagtctccttttagggtttatagcagaatcttaaaatttgttagtgtgttgaattatggacaaagaagcaatgcggacctttgttgcagtacttaaactttatatgctgttgttacctgttttatctctctcactagacttcaaattccttgtggcagagaaagtatttcttgcttatcttcttatactctgtgcctagtaaaatgcttgataggtcatcaatactcaatgactaaaattttctgtaatttgcattctcattggtagtgaagtattataataatgaacgattgttatgtactgttccatttaactctattttggaatgttctcaatagtttggccgctttaagcaagtgggagaatattctcaattatatttgggtttgtactagtgctatgtgtaattaaggttcatttatttattactaagtgtttattatggacctactatatgagcaagttgttgaatggaagcgtagaagaaggaaataggccaggcgcggtggctcgcacctgtaatcccagcactttgggaagccaaggcaggcggatcacaaggtcaggagttcaagaccaacctggccaacataatgaaaccctgtctctactaaaaatacaaaaattagccaggcatggtggtgcgtgcctgtagtcccagctactcaggaggctgaggcaggagaatcgcttgaacccgggaggtggaggttgcagtaagctgaaattgtgtcactgcactccagcttgggcaacagagtgagacttcgtctcaaaaaaccaaaggaaaaaaatgagctaggtgtgggggcatgcgcctgtagcctcagctacttgggaggctgaggcaggagaatcgtttgaacccaggaggcgtaggctgagccaagatcaagccactgcactccacactccggtatgggcgacagaacgagactccgtctcaaaaaaaaaaaaaaaaaaaaaaaaagcaaatggacacactgccctcaaaaggcttgtagacaagggagaaagatgagatttctctattaataactgcactgtttggtagaaaatactatgtacaatatgagatgtctagatataaagtgctgtagaagtttttgaaagtaggaaaggttccttttattccagaaggtcaggcgggccttatagagaagtgtaggctgggcttggtggctcatgcctgtaatcccagccctttgggaggctgaggtgggcagatcactgaggtcaggagttcaagaccagcctggtcaatgtggtgtgaaaccttgtctcttactaaaaatacaaaaattagccgagtgtggtggcatgtgcctgtaatcctagctactcgggaggctgaggcaggagcatcacttgaacccaggaggcagaggaggcagtgagcccagattgcaccactgcactccagcctgggtgacaagagcaaaactccaaacaaacaaacaaacaaaaaaaaccaaacaaacagcctggccaacatggtgaaaccccgtctcaactaaaaatacaaaaattagctgggtgtggtggcgggtgactgtaatcccagctactcgggaggctgaggcaggagaatcgtttgaagcaaggaggtggaggttgcagtgagctgagattgcaccattgcattccaagcctgggcgacaaggtgagattccgtcaaaaaaaaaaaaaaaaaaaaaaaaaaaaaaagaggagagagagagagagaagtgtactttatctgatccagtaagggtagataaaatttcaacttgccagatgacacagggtcagaaaatcatgagacctatttaggaaacagcagataatttcacttaagcgtgggattaagaagagtcacaggaaagaagctagttatatccaggactttccttgacaaataatggttgtcttcctgaaggtcttttgaggtctcatccagagccgagtgggtggccttcgtctactctcacataagtatttttgtgacttttctaaaaacttgttatgcctgtaaaaagtttgtggaactcagtattttttttaacctacacttgaccattaaaaaggtaaaaacttttctacaatttccatccaagttttaatgggaaaagtttgcgatagatttttaaaagctttcatggcccagtgtctgtgccagtttcgtcaactggcttttcagagtccacttcttactaagtctttggactaaaagtgaaaagagcttccagaaagctacaattatgctttttatttgaggaagtgtttctggttgctgtactccagaatttttgaaagagattgtaaatgtggttaatgcgactttgtgtacctgtgactgtcctacaaatgtgctaaaatgagactctggccttacagcttcagaaactgacttgttctgcttggggtgttaatattattacgaatgctaacatgaaattcaaatcacctgattgaagttcttagcactgtgattaatggatgaatttaggagagggaactatatatgatttttttttgtctttaactgttactgataaggactcagaatctttctgattctcttttaaaaagttttctctgtaaacttaaagcactattttcttttagaacagctttagtgtttcaagcttaaaatcttctctctttaaatcctggctgcatatttggctctctccctccaggcagagttttctccagaccttggttggctctgaatcccaagagttaagacagcctagcttctataaatcaggagacagcttcattatcaaagttatgtgttttcaccttcatagatagccagtcttagtgttggtgcctggccctgccttatcgtgtaaccatcagcactgcatactggaatgttctttgtttcgattatttactccttctataaacaaagattagagcaaaaaatgtcagtactgggccccaagcagtggtgactgttactggaaaattgcagtggcatggtgtgggatgtgatttgctactcaggcaggatagcactgacttgacagttataattatttctgagttctgtgctgcatctcttttatacattttatctcatttatacattttatctcatttatcttcccagaagataggttctgttctttccattttacagatgagggaaacaaggctcagaaaagttagcagtattgcctcaacttacgttgtgagtggcagatagttgtgtttcaaacctggacagttgacttcatagtcttctcttttacctactacatgataaagaaattccaaagatgacactgtttaaaataatgttacctagaatttgagcttcttgtaaccattacatggtcccacagttttgtggggttttttgttttttaagagatgaggtcttgctgtgttgcccatgctggagtggagtggctgttcacaggtgcggtcatggcacactgcaacctcgaacagctggcctcaagtgatcctgccgcctcagcttcctcagtagctgggactataggcatgtcctactgtgcctggctggttccacagttctaatttgttagcgcaggatgagaacacatttttagtattgaaatttttatttatttatttctagttttttacagaagatctagagataatggaatttatcaaatcttgactgatctccagtatttggagggtctgtatctttcttgcagctttcagggtctactttatttaagagtttacattttaatctgaattcagggaaaaagcaaagttattaaccagtctattttgggagtcagtatgtcacagaggttcatgaagcatcttgtatcatttggaatagatataattgtgagagaggaagacaattatttcagaatatgtggacttggattctggaatacatgtattaatacatgtattcattctggaatacatgtattaatacatgtattcattctggaatacatgtattattccaaactttaagaagtttgattctcagtaaatggtatgactaactactttttttggaacatgattacttatctttataagcattttcacatacagtgtaggaaaataatccttatttcgcagatgaggaaactatgacttagataaatgggtgctgttgctaagatgacatctagtaggtgcaggtgatgtgtttttgcttaaatttgccatatggattccgacttgcctgtaggtgctgggtatgtttataagatcagagtatattcatttcttgactagaataagtatgttttctgattcactacaaggttatttttcttactgaactataattcctggataaaacctcttgaacttaataactatcaccataaatatgtttaatgggtttattggcatgttgaaaagtgtattgtgttggcacatgaagaggcccacataattgctaaataatggtccttaaggtatttataaaggtgttattgatttgtagtttgtatatccatatatatttataacattctggtgacaaagaaaaacttgagtaaacattgtcatgtctgtggatatcagtgatagtaaaaagttgagatatgccttatttaggtccactcttccagattatcattaatcagatttttttgagagactgcttgaccccattttcctatttcttgaatttgtcctatcaccatatgattagagacctagttctcaacgagtgactgtatttcctgatgttgactgaaacatgaatgtcctctcccctttcctcactgcctttgggcccatgtattttgtatttttgatttagaaaaaaaaattcttagggaaacaaaaatgagtaaaaaaaaagttagatggattgtgagggcatgaattagagtaggcacaggattgttaatttgtctccttctgcacatccgtggtatagtgtttggagcttggcccaggaagaatgatattctgctttgttttttgaccctcaaaatatcctcgttcttggctatacccagagttccttagaaatgatgtttgttgtaacgttttgggacaaaattgtgggagggggctggaggagggtggtaaaccatatatattacactttaaaaatgtttttcctcttatattcttttctgtttttctttcaaatactctctgtagcaaactgtgcgcaatttctcttcttcatgtgaaaatttatctcagggcaagagacaattcatttaactgtcatgaattcatttaacttccatgtgcttttggaaagtcttggtacgctttcattgattgagttacaatcccataaatctagggtagattagaatacgcttgttgtagctcttcctttaggtacttcatgaggccacatgaaaccaccttctgatatttatgcctttgttttgccctctgtgggattaaccccatctcttcatcaagtaaaagcctgtataccaattcacagactttcttttcagcagaataaatcttactgttgatacaatcttttgaaatggaacatctttatatttttatgtaaagtatgattttcctgcaattctggctatgactttgtatagctttcctacatgattctgtggcttcctcagacctgtggaagaccttgactctaaatctgagcagacagaaagctaagtgcagaatgatattcttcaagtaagccattcaccccaagaagaagtaagagggggggaaaaaagacaaaacaaaacagtgtggaaatgtgtctaaactagtgtccccaagggtatcccaaaaccatttattctatggaatgttagtaactgttgtgctttaaaagttacaaagatctgataagtttgggaaagcctgtgttaaaaaaaaaaattaacccaatcctatattcaaaactttttagaaacttctttttgttgttagagacagagtcttgctctgtcgcccaggctagaatgcagtggcgtgaccatagctcgctgtgaccttgaactgaattcaagtgatccttccaagtagctagcactacagatgtgtgccatcacgtctggctaatttttcttattttttgtacaggtgggatctcaccatgttgcccaggctagtctcaaactcctaccctcaagttatcctcccatctcgacttcccaaagatctaggattacaggcataaaccactagacccccactccttccatgccaaccaaaaaaaggatatgttacatttcctaaactcatttatctgaggagacctttttcttgggactagcagtcaaaaaagcccttacaaattagaaatgcattttaaatatgcaagaaaatggcaaagtgtcttggtattccccaggcttagtcacttattctctgttctttagcaattcaaccaatggagtagaggctgtagttttctgtgggtgtcttacctaccttaccagaggtcagggtaacatagaccttagcttcctgaccttcctttgagtgttggttacattcgcttttttaaaacccacttagccattcatccagcccctaatgggatcagcgtttccatcaaaccaattgtggacagagagtttttagggcccttatttatgcttcttagattttctatgtatctcaggataagtgaactgtagagaaatactctatgttatgcagactgtgggagactggagtttagttctaaaagcatgtattaggctctgcaagagctactcaaccctaatgaagtcatctgactctaaggttttatatatctttcatcttccatttggacacccagccatctatccatccatctcactgagtggttgtgatggtaaaatgtatgaaaagtgttgaaaagttgtaaactttgagaaggttatataaaaagcattggtatcattattatcatcagtcaagaggtgtgttgaggaatggttttcattgctgactcatgagataagttacttcccttgttcctcaagatttttggtgaaaatgttaagcattactcattcgtatgaataataaagactcccttcagaagaatgtttgaaaggctaattacatttctgttattgtacaatcataatagcattagagagcacatatataattttaagtgcgttacttatatttgctcattttgttaccacaccaactctgtagtaagtatgattactaactttattttacaaagaggaaaactaagacgcagatcacttaggtaacttgttcaatatcatatagttataagtggcagagctgggatttgaactcacacagtctagctctggagtccatgctgttaaccactgtcttagtatgatttataccaggatactagaagacacaccactgtcttatacagattggttcaaatactgatggttagttactagttgtgagacattagacaacccaataaccacctgtctcattcctgcaaaaggactttatttaggtataaagcaccaacagatagtagtagtgtactcttaaaacagagtgatgggtgtgtcctattttgccactagaaatgcttttttcacatctgtattttaaaatgattaagggatgatcattattttccctccctcatgcctcctgctccatccaccctgaaaaactaaattctttggccaaaatttgcaagcgcatatagaagattggttagcataactcagacttgcatttatgactgtatgggcaaggacaaagtagactctgtaattgtttagtcatatatgagctatatatatacttcaagtgagtgaaatgttttgttcattctagattttttttatttatgtgttttgggtttggaacccttagaaaatcaaagaaaaaaattgtttgttcttgctatcagctttcatatggttcccgagacaagtgctatacatttagaaaattaaaagggtaaacattaaataagaatgcaggagttggcaagaagtcaaatgaattggatgttcattaaatgcccagggtttggggacaggcaaggttactaaaaactggagcaggcttaatgagacacatcagacttgagttgagtttggtggatgggtaggattctgaatggtgaggagaatagtcttgaaaaggggtagaggagagagggaatgtagtggaaaccagggtagagtcagcatgcatgtggctagagacatgtttcagccagtgggctgggctgcaggaattgaggaggagttgggagtagcaggccactaggctaagaatctgggagtttgtgaattcccagctatgaaatggggccccatttcatagtctgggattactgaaggtttaaagtggaagaatgaaatccagaaagctgagttccaagagccttagtatgatagtagtaaattgagtagttagaatgaagattgatcatattttcttagccaggagaaccaattagaaggctatttaagatatttagggagggccaggtgcagtagctcatgcctgtaatcccagcactttgggaggctgaggcaggcttatcacttgaggtcaggagttcaagaccctcctggccaatatggtgaaaccccatctctactaaaaattcaaaaagttagccagacagggtggcaggcgcctgtagtcccagctacttgggaagctgaggcacgagaattgcttgaacccaggaggcagaagttacagtgagctgagattgtgccattgcactccagcttggacaacagagtgagactctgtctcaaaaaaaaaaaaaaaaagaaaaaaaaagatatttagggaggagctatatttgatggcagtgcaaatggaaagataagggatgggcttgagatacaccagaggaagaattggtgtgatttagtgtggtataattaaaatgccaggtcattttctagtaatataattaatatttaattaattaacagtagattaatacaaactaatttctaaacataggctctggaatcagactgcctaagtaagcagtaacctccacattgacctcaaaaaagtaacttaactgactgagcctcagttttctcatttgttaaatgagaatagtaatacccaccttggaagatttactaagaattaagtgagatttaattcttatttatataagaaagtccttggcatgatgcccaacaaatagtaagagtgcagtgtattttaactataatcattagcgtccatattttaaaatgggaatttgattacattgtggtttgttgtaagtgctgaacatacctgtgcttttcttatggcaggtatagtaattgtgttaactaataaaacggttattaaatatgttcaatctgtctagtatttgtagagtttctgttgtttgtattcacattattctactatttgatatccagtagcccagagaagatggtgacaacccctggcagggacacgcacctcctctgcgggccactgagaattggacaataggatttagaatcagtggtagagctggacctggaatccaggcttcttcattgtcggtaaaggtctgtttcccaatatgaggcatcataaattaaggtaggagacagaagaaaacatataattttttgggggtcttttttttttcttgattatagattttatttattttttatttttctataagttattggggtacaggtggtatttggttacatgagtaagttctttagtggtgatttatgagattttggtgcacccatcagccgtatacactgtaccatatttgtagtcttttatccctcacccccctcccactcttccccctaagtccccaaagtccgttgtatcattgttaggtgtttgcgtcctcatagcttagctcccacatatcagtgagtacatacggtgtttggttttccattcctaagttacttcactttggatagtagtctccaatctcatctaggtcactgcaaatgctgttaattcattcctttttatggctgcgtagtgttccatcatatattcatatatatatatgatggaatatatatatatatgatggaatatatatatgatggaatatatatatatatgatggaatatatatatatgatggaatatatatatgatggaatatatatatgatggaatatatatatgatagaatatatatatgatggaatatatatgatagaatatatatatgatagaatatatacatatgatagaatatatatatgatggaatatatatatgatagaatatatatatatgatggaatatatatgatggaatatatatatggtggaatacatacacacacacacacacacacacacacacacacacacacaccacagtttctttatccactcattgatcggtgggcatttgggttggttccacgattttgcagttgtgaattgtgctgctgtaaacatgcatgtacaagtatcttggaaaacagagaatttcttaaagtctctttatctgttcacagatatgactggctaacctgcgtttttctgtataattgttctttccagggtatatagtatgtcctttatgttggtggatgtttttagcccaacctttttacttggttaattccgactttactttcaacttaaatgccacccaatctaaatgacttttacccttttttcttagccactacgtattttctttagagcgatttttataccttgtagtcctatatttgtttacctatttgtttatttatacccatctcccccaccaaacttttaggtccatgagagcagagatcatttctgttttgttatttagggtacttggtttccggtataatgtgtggcatataataagcaataaataggaatttgagaatgaattcatgaattagagaatatgtaatattcagacatatgtcaaagggcatggtctctgcttttgctgataaaaccaacttggattaacattattaaaactttcagtgctatactttcatcatctaatatggacagaataataactacctacatctacttcacagaaatgtttttaggataaatgagatactgaatactgttttctgcaatatctagaaattaggcctacatcataaactgggtatttagggaacttccctgttccacactttgagatgactaggaaacccctttctgatattagagctccaaaaaggctaccagagtggccatgcacaatagtgaccacaagggtgaacagactctctgagcccttccccttcctgccaggcaatgcctgactctgcagaacatatggatcacaacctaatgtgtgtggaattactctgctatcttcagaaaaagagcatcgtgcatatctaatgccatgttgatgatggtagtagtactgcggagaggctgctgatgtgatgatggaaccaaagttgtgaggtaagaagatcctttagaagcaaacaccttccagatcctagccctataaacagcaactgggtgtctggtaaatacagcatcggcttgaatagacatatttgaataaggttttctcaccatagcctgggcttctaaagagcttggtagaatattttgattgttgagatcatcccctccccatctttaaaaaagatatggatcccctgctcctgataaacacaagaaaaaatataaactgtaaatatttatgtgatgaaaattatattaaatatttaaagaaactgcagagcattgcttaatcatcttattaagaatcctagatttaaaccttagatgtctgttcttaggcatgaaggaatcaggttaaactgccttaaaaataaagtgcctcacagttgtatcataaaatatcaactgacattaaggtaattgtgcttaagcacaacttagggctcttctgaatatttgtcattgtcacaataatggtgctatttttaatagtccaatcctagttctaaagaaataaactatattctttgtgtgtgtcctaaacagaatcatgactagggagaaaatgtagactccgaattctttatcttagtaaaagaagcacagaaccacattagatatgggttctggtatcattatggtgtttttgttttgttttgttttgtttttttgtttttaatgaaacattctaaagggctgggtgcagtggctcacgcttgtaatcccagcactttgggaggctgaggcgggcggatcacctgaggtcaggagttagagaccagcctgtccaacatggcgaaaccctgtctctactaaaaatacaaagattagccgggcatggtggtgggcacctgtaatcccagctacttgagaggctgaggcaggagaatcacttgaacccaggaggtggagattgtagtaagccaagatcacaccattgcatttcagcctgggcaacaagagtgaaactccatcttaaaaaaaaaaaaaagaaaaagaaaaagaaaaaagaaaacaaaacattttgtagtaggagcctgcctagtccagggtagtgtaacactcctaagagtctcagccatttcctacgttaggatcagttttacagatttgagtcaaactgatgtctgagtcttcgttaaccttcagagagccatgaaatcaagtgcagatttctaagccccagccactgggccctagcaagctcatgttgagcctttatgaaattagaaaaggtgttctttctgagcggataaagcccaaaccagagcacatggcttggccgtggtgagccaggcctgaactacattcagcaccacttgccactttggtggcactttgggcagtgcatatgttgagcaccctgtccccagaaggaccggacccaaatctctagccagaacgcaagcactgtttacaggcaacccaggaaccatgttatttttcagattgacattcacgtcacaatgctggtgcttttgagtatgtgatctgcttaagtccacagtggtcttttggcctttgagccccaaatcctcagagttcatggcatgatctcactatatggaacagaaaagtgtttcattttatgtcgaatttaaataatatctgggaatatttgctgttgatttttttcctcctgctaccctctctcatgttaggccaagaaagccaatgaggttaaactacgactgtccttttttaggatctgctaataatttagatagaggctgatgatttatcaccaccttattcaggctgtaataatcccctatccacttggatctctgcagaacctcttaactgatcttctctccgccaacctgttctttactccaactcatggaaagtcacacttgctaatgatacgtcattgactttctcctgggttgaaagaacatccaaactcttttattttattttattatactttaagttctagggtacacgtgcacaatgtgcaagtttgttacataggtatacatgtgccacgttagtttgctgcacccatcaactcatcatttacattaggtatttctcctaatgctatccctcccccagccctccaccccacaacaggccctgctgtgtgatgttcccctccctgtgtccatgtgttctcatgaaaatccaaactcttctacacggcctgccaaatcttgatcaaaaccctacaggacgtgccaggcctacatgacgtgtctccttttcccttcatctctgactgcatctcctctctccctccttcacttgttcaactttggtcacactggcttcttcgctgttccttttccctgaaaaattttgccttcacatctcagaccttgactcagaactcatctcaatgactcttgccctgactgctgtatctgaattttcagcctttcctcacccacaccatttcaggtcctctttctccactttgtcttttcttccttaaaaattattttctggctgggctcggtggctcatgcctgtaatctcagcactttgggaggccaaggcaggtggatcatgagttcaagagatcgagaccaccccggccaacatggtgaaaccccatctctactaaaaatataaaaattagctgggcatggtggcacaggcctgtaatcctagctactcaggaggctgagacaggagaatcgcttgaatctgggaggtgtagtttgcagtgagccgagattgtgtcactgcactccagcctggtgacagagcaagactccgtctccaaaaaaaagaaaaagaaaattattttctaatatatttcgtattttatttagtgtgtctgtttctcttccaccaggatttaagctccaccagggtaggggtttgtctgttttattcagtgttgtatctccagtgcctaggacaaaaccaaacatgcagcatatggtcaagacctattagttgagtggaggactgaatgaacttggcccctgcctgcctctctaccctcgtgtgtcatcagacttcttcatgtcctacatgcccacatcttttccatctttctgctctctctaaacacgccatgctttcctccactctctgtgcctttctacttactgctgcatctatttagatggttcatcttcacctgtttggctcttcaggcatggctcagaagtcacctctgctagaaggactgccttagccccctgctgtgcaagtagagtaccctttcccagcatgggagcaacctgaatgccttacttttatccttttgcctagctcttccattaaaccacataagctccttgagggtcttatttggatttgtagtctcagtctgcacatagcacagtataggcatgtcttaaatgtttattaactggagaaaggagggacagaggccagcatagaactggaagattatttcaggatttcatccatccttagtctacctagtctacctaccatgttgccacgtttattacagtaggtgctcaagacagctctgaatgaatgagttgtttgttccctcttacacatacccacccctaattaaaaattcaaatcatttttgtatcaatattgtactttgaaaagatcttctgaattgatggcttctaacttcaggttgttggccagatctggatgtggtcagataaggtagatgtaactgtttcctgagtctaaaacctatcaggatgcactggttgggaaatggatagagcaccttagtgtattttctgagaaacacagatcagtggttttgcttacctgtgtgttgataatgagtgctttttctgcgtgcgtactttatttcttcgaaataggacttacgtgaaaacaaagtggcttaatcattcaattacagtttcctctatgaaatttttcaataaaaatgaaataaagcaggggagctctaagtctgtttcatactctgcagtatggatgatcaccaggaaacattttcttaatggcatcataatattctgaatgttatttatactaatgatcacgaatttcatcttagtgatgcctgtaaaaaacttaacctacatgttaagttgacttaagacacaacgtttcagactacccagactgaagacacaccatttcagattacccataaagattttagcagcagtgttctgtgactgatttgtaatgatgcttactactcatcattaattgagtagacttgatggatagctatacagaaaaaaaaaaaaaaatgggcaggcctttaccaccctcgaaggatggagcttttggtatttattcgatgcataacctgtattcctaaaagacaagaaatacatcatatgatttctcagtggaccatacatcacagcaggaacacctttacaacctgccaggtaaacacatattaaagttaattctcagaggcttttgttgctttaaagaaatcatatgcagtagaaaattcctcctgttttcacaaccaggaccaacagccagttaatcagttgaagtggtgaatctttaccaaaacaaacaaactacatgttttaagcatttttagctgaaaatatagaaatgtgcattttgagattagccaaggcctttacttaagtatggatggttgtgctcattaaagttctgacttcttacatataccacaactgtgatgtatcaccaagattttcacctcttgctgctttaaagtgaacctggaacttagacatgaataggttgagtgtagaatcatccaatcctccaatattttgcatttgtcttgcccacaccatgtgaaagcaggattgtttttgttttttttttaagggtggggaaaaaaaagaaaaaaacattgtcaggactccctaaagcattcaacttaattttgatagaatgaactttttattttacaatcgtatttcactggtttttataatatttcattaaatgataaaatcgtatttgtagatgaaacggttataatcaggtctgagaaaaaataactgatccttgactaaattgatttgtaaaagcggaagtatgtgagcataccagagtgtagtttattagttttgtttatttagcatgctatggacatcaatatattttaaagaagaaaaacgattttgattaatctggtagcgtaagcatacatgtagtagtaactttttctttgttggtgtttctgtataacttaaaaagagatgaaactaaactgcagtgaaataacccttagagactggtaatccacccctaatgagcgagtgcacatgtgaacaaggtatgatgcatatcttcagctgctcacttgactttttcagttggataaatttccatcctctttcattgtaatatggcccaaactaaattcactgttttcttaagccttcctcccatttcccaggctctcttagaattactgccatttccccagctatcaaggtatccaatatagctagaaaaaaattattttgaaggaatactgcgtgtgctgtaggagttttatgtgtgttttttaaaattattttgacccttacctctgatcctcttaagttttgtcattaccagatcttgtcatttctgagaaatgcatgttcctcttcatttgagtggcctccccagcatgagaccctttccacctgttgagtatatcactgcagtggaaggatcttacttgattagcagcattgcctccagccatttgtatccttaaagctgtggcaagatccttttttcacaaatcccattctcagcagttcactctccattcaagattctcagtggcttttcactgactgcaacatgtaatgtaaaaatatttgtctttgctctcggtgccttgcttaacatagatccatcctcatttcaggtatcagtctctattcttttatgccctgtgggaacccaccacaatcacgttgtctgtctgcgtctctgtcctccagacttgtgctccgcctccacacctctgctcatatggagccatgtggtctgtaggatcttaggtcttatatgccactgattcatgtcctaaaagtccttattcaattctgcttgactctcttccaaggaacactcctccgcaaacctttgagcacctagagattagggactgctcattctgacatgaaaccagctgcactgcattttattgttatgtagttgtgtttatctcctcaactccaaatgaacccctttgaaagttgggactcttctcttaaatgtttctctttttgtagcttctcttcttcagggagtgtagaatactttcaacccagcacaactgtatgaaagacctgattgaggaaacataagaatcactaggccagggtcccttccctctaggtgctcacagtctaatggaaaacagatgtgtccttaaacacacacatacacacacccacacagatacatagacgtctgatatgaagtgagaaaactctaaaatttctactaataaaggtgtgtattagatgaaagtttggaggaaggtgagtgatacggtttggctgtgtccccacctaaatctcaacttgaattgtatctcccagaattcccacgtgttgtgggagggacccagggggaggtaattgaatcatgggggctggtcgttcccttgctcttctcttgatggtgaataagtctctccagatctgatgggtttatcaggggtttccgcttttgcttcttcctcattttctcttgcggctgccatgttagaagtgcctctcacctcccaccatgattctgaggcctccccagccatgtggaactgtaagtccaattaaacctttttttcttcacagtctctggtatgtctttatcagcagcatgaaaatggactaatacagtgagctttcactctaacaatggggagaaaggtctttgatttggaggggttcctacttgaattgtattaaattagacatttgcatttgagcattattggaagaatagaaagatccgtgtattgttttcttgcagaaaaattttttgagggaaggagaaacagtattgttaagtaagaagtaaggaacttaataacttgatcaagttcttgtaactaatcagtggcagatacacgagggctcttgttctactgccggtagttttgagtagtaagttctgctgcctcctcaagttttgttaacattcttttgagtcacctgaacatatgtatgaaatttttagagggtaagaaactttttagcccccgttatgtaacactcaaatcactcaggagtgtttccttttcagagtacttcaaacctgccatggagttagcctttgggaaggagaaaggcaggtaacataaaatatcaactgagaggctttgaagatgggtgatgtgttttttctccttaggatgttaaatcacatatcaccacatgtgtgcatggaaatgaaaaatgtcagcaacacatttatgtaaaccatggatcatatttgcatatacatttcaactcagccttcctaccctgagaccagcaatgattgatgctttgtattttgtctttttaaagatttctctagtcctaggattttgctgcatgttaaaactcttatctcaatgaaaggtaaattagataataaactataaacctatgctgtctagcacagtagccactagccacatgtgtctatttaaatgtaaattaaattaaaaattgatttccttagttgcatagccacatttcaagtattccataccaaattgagatgtgcagtaaaggtaaaataccagattttaaagatgtattacaaaaaccaaatttaaaatactgacaaatttttgtattggtaatatgttgaactgacaatattttggattgttttattaagtaagacacattattaaaagttttgcctcttttacttttttataattgttacttagaagcttaaaattactactgtggatcacatatttctgtttgacaacactgacttagaaagttcatattttaatttttaattctattgtcttagtgtataggtttatactgaatgagcttactaggcattttggaaagcagagtgattagcaatgactgaaacataatatagatgatttaatgattcctaccattttttgcctgtaatttttactgggtctactaatcagttttttgggtttttttttgctaaaagaagcctttatccttgttcaggccatcaccttttaagactgttttggttttgatcttgtttagcctttaatctttgctccttgattggctagtgacaggcaaactgaatgatcgggattaagattcaaatatttcatgaatgctttcactacagcattcctttttataggaagttacagtcaatacagtatataaggcagtacttaatctgtcatatttgcaggctaagccctgaattagatattttagtgcatgaaaagatctccagactaaacgcattcatttgctaattagaaaaaaatttgtttcccactaaaacattttactcagtagtgtttatgtagaaatactgtgaatattcctacaaagttgcttaatttatttctgtgagttccaactaggttcagtataatttttccattagtgtaagtataggcctgctagtgttacgtaaaccctatttagctgttagtactgttgtcaccactctgattacttaaagaggtctctagagcagaaaacagacttcctaacttatgagttgttaatattttattttttatgttatttggaatatcaagatatagtacgttggggagaaaaatcctttgtgaatttgatagaaaattggaaacccaagaaaaaggccattgttaaggtttttggctaatctcaccgaaattgtctgtagtaacccacactgccatataaggcgaggggaaacggtgcctttttgcatgctatggggaatatgtagcttagtagtacaaagataaagcaaagagctccaaagatgcggccaaaaatagtcgtattggggtttttgctgaattgaattgtactgatggctgaatattttccgggattgagccctctcttctaaacttaaatcttgtcctgtttcaccatctatggtaaaatatccatggaaacaaagtggcttcctcatgggttgcttactgatcctgcattaggaaagaccacacagacattcgaggaagagaaagaatatttcatatggctgctttccttgttaagggggacccagagaaatgtttatttctgaatagcttaccttcattccaagaaatcggcttttgggcttacatagcagtggacatgttactggaatcttaagagtgacaagaaattattgtttctgaagatagcttgtcacttttttctcataggacttggctggggttcagtgctctctttggtcttatttgaatggtattttataagtcagacaaaataatattcaactattaatattgttctgctaaaacagtttagaataaagatttaatgttctcttttcagtgaagagcttgtgcccactgtgcagtactgtaataaaagagaaacaaatgaggcagctcaaagttatggctctccgtggcttttaggtctctcatacatttttataaaacatatatcagaacttctgaattgttaaattgggttattttttaagtgcagttgtattcaaataaggacccgagagtaacactccatgtcctgttaggtgtcagcgttcagaactgcccgccccctccacccccagccgacagacttactgctgttattacatcctctggtctgtagctaggagaggacgtttgaccccctcaagactgtgcttctagttgttcttcaagtaaactgactcagccccaggcttactgtcttgcctttaggcaaacaggtaacttgagttacacatctcttttctcatctgtaaaaggggaatatagaaagtgtcacttctggattcccagtggatttaaaaggcaaaaatgagattaacgatgtctatggccaagcatggtggctcacaactgtaattttggtactttttgaggccaagatgggaggactgcatgatccgagagaccagcctgggcaacatagcgagacgttatctctataaaaaaaattaggcatggtgtcatgtgcctgtagtcccagctcctcaggaggctgaggcaggaggatcgcttgagcccaggagtttgatgttacagtcagctgtgatcccaccactgcactccatcctgggcaccagagtgagaccctgtctctaccaaaaaaaaaaattgtctgtgaatctcccaaattgctacagtttaataatttgcatccctatagaaacccaggagaactttaaagaacagaaagtaaactttagtgcaaatatttgagagcctaatgtgtcattaaatgtttctgaggaatatatgtttgctgaaaagctgaaaattagggttagtgtaagcatcactcataataatctcatgaagagaatcttgcagatgacattgcccaagcatagtactgggaggataataaaaggtgtgcgcatttatttgggtgtcagaagattaagtacagggtgtgcttcagtattaattcttcctgccccaacctaaacatttaaccaaataaagaaggaacatcaagtcccacagaactaggaatgatactactattctgatttcaagaagtataattactgtcctaacacttagaaatgaccagaatttaatacccaggtcttcattttcctctgacttcattttcctctggctgaaacaggagtgacagaggccaggatcatcagaggcagatggatccctatggcaggttgttttgactcttctaagttctttgcattaaaacaacattcctcaaacacattagcctcccagcacgggggtggaaacaacaaagcaggaagcctgctggagccttggggaaatcttgagtgctttggggtgatttattttcagaggattcgaactaagatcagctcaagagaagatgggaacattcaggatggtgggaaagcaaagtaactgactccctccttttcctctctgtaaatggtctcctggaaagccatcacaagtaaatgttttattccacataaatttgtacccttgggggtacaaatgggggattgagaagggttgtggactgcctggaacatgcttttttctttttctcttttctttttgagacagggtctcactctgttgcccaggctagagtgcagtggtgtggtaacagctcactacagtctcgccctcgtgggctcaagcagtcctcccacgcagctggaactacaggcatgcaccaccacgcttctctgtttttaaaaatctttttgtagagacagggtctcactatgttgctcaggctagaatgtgctttttaattttaattttttggtaagccctagccacatgaaatgagcccagtggggtggaggaccggccctgacagagcctatatgatcccttgactgggttaatgcaaagttgggtctcttattaaattaagcagaaattccagaaggcttgtggctgggtgatggatttggcctctaaaaccagaatgacccacaaaacaggtttttgagtaacagatgcttaatgaacatccctgacccaactttacaaaaatgcaaactgggctacaagagacttaatcagagcaggatgaaagcccaagttagtgggagatgagtggaagtctcatgtacccaactgtgaaagggcttctttttccaattcagaacaattgtattagatggttatgaggaacgatcatttagatggaagctgaactccctttcgttcactcagtgaaaactaaattgttgggcaggttcagagaaaaaaaatagaaatagtgtgtgtgtgtgtgtgtgtctgtgtgtgtctctgtgtgtgtgtgtgtaatttctctggaagcacaggaatgatgtgttcttctttgttaagggcattatgaaaccacggcagtcctcttcttgtacagtggttgtaattataaccacagggatattgtgttctcaaacaaacattcaagctccctgataccaggttgcctgaagccaagcttcacatatggatgtgtaaaacaatgcctattagtaatctcccccatcacttgtcattggtcttcccctctgacagtggaaatgtctttatagtctgtgcctggcatattgcttttgttcatcttaggttcattatgtctgttttaaacaatgagaacatataggtcgtggcacagtgaaatgtagcacctgaaacttaagagcttgatcgggtatatacataaaggctgtccttcagaaatttcttcatgatgctgttgcatgccattggaacagttggaaaaaggaaaattagaaccacttgcatgccagccagctctgtttttaacgcatgattattttattggggtgtacattaattaatcccgaaataagatcctgtgtgacattcagagttgttttgagtagctcagagtttaaatattttagttttacaactctgttatgctggcagccaacaatggtgtctcagtgaagtcagcatatgagccctgcttgtgatgacatctggaaagcttgttttatctataagcacagttgtagacaaatgaaagcagacagatgtaaggctggggtggcatcttcgcctcgagcactctctggctgtacattttccagtgtgtcaaaaacaaggagctttatttcgggggtggaataaaaacattctgtcacatccctacaccagctactgtgctgccttttttgagctataaggtgtaaaacggcctagactgttcaaaatttaacaagagacagagttaataagtaaacaggagaaagtcagtagtcagatagaggtgcctgagtttggaggggacatgacaccacgtcaaaagccttggggtcattttaagaagttaatcacaaccactttctcctgggagagccagaaagaataaaagagttggcaggggatttggagttctgggtagatttttcttttgccattacctttatcagccaggatttattaagtacccatggcgtatagaaaagtctacaaagtagtttgggtgagtggagcaaagaaaagctttaggacagggtcatgcttgaagatgagtacttagaagcctgaaagtccgtgacatcttccatgggtggctctcaagtccttttgctcagggaccattccttaggaaatcttatacaagggcagcttgccttttatcccactccctttttgctgctgtagaaataagtatccctgaaaataatctccacatatgcgtgtgaatttgcttggatttgagttaaagcagatgcttttcaaagttcttgatcctgcaatagcaatagaattagctatgtggggtatgaaattaatattttcatctctggagatttatggcttcctcctatttcatggcatatactgtgtataccactctgtataccatgtaatcattgctaattattgctaaataagttttaccaaaattttgggaaacctggacatggtcttgtttagcatctgcttaaggactggattgcccacctgcagccaaaaccacatagctttatagtatttgaatcttgtgtcttgaagaaaccatgcagatacatgtaatttgagagcaatgaaataatggaaatgaaaggaagggaatagtatgtaaggaaatgaaatatggtcagttgcttgtatcaggacagaagcctcttggtttcagcagtgtctttttcagtggccaaggtggtagagaatatacttttcattttagcaatcaagttacattatggtataaacaggggaaaaccgagtttttcatttcccgtctcattcccatcacaccatcattaatcctttcagagtgcatggtgttaagatccactgagccctggtaagtgcctttgtgtatacaaaatggcactttttgttttacatgctgttggatgtggtggagaaaatacatgtgtaatcgaaaatggacagcaaattgccatttgtacctgcaaagactaaatggtccagaaagatggatagttggggtgttagtcacacatgagtagactgatgggctggccacggaaagccccggacctttgcatgacttttcacttagagccatctgaggggttcagtgactccgtggctgttctctgagaccccagtctggtccagagagtcctggagtctgaagtttgtgatgatacagaggttgattcctctgagtttattcatttaaattagaaacacagagggaagggaatcttttcttgtgatcccagttattcctgatagagaagaagtagcagattttctaaattatctgccggctgtggggttggaaagtaagtaagattatatgtctcatcatccttctatgagtatgtagaaacgagagtcttagaatcagtgtctgcaatcaccttcatcggtgctagcttacaatttaaactgtcaaaatagactttatttccttcttttgttgttcaatataagaagagggttttttttttctgcctattagtttgagtttctatagatgactatttatagcatttttttaaaggtttcccaacactattgggttgacacaatgggatataatagccaacagggaccttgcactgataccaatttgatttatttataaattaaattattctgctaaatctgctgtagtactatttagtcattttgatttaatcagaagtatcctttatgatgcaatctgctggaagactgtgtttggccaagattaaacttattcttttgaaaacattaaaacacaattatggatctataatttcccctgtggtatcagtgaacattagttattattgacatatattggtcttctattattactaatatttttattactgacaacagtttttagtatttagcatgtgccacatatagtgctaaggtttttatatgtgtttgtagctaacatttattgagtacttattttattacacatactttggagctcagattatccagtataattcacataatgatcccgtgaagttggtactaagattatagtattaccctcattttgtcaacaaggatgtaggttcagagaaattaattatcttgtctaagatcacacatattctttgcatattggactgtatgtgtttgtgtataggcattaatttcattctcagtgtagatctgtactttcttttccaaatatattataaccacactgtaccttgtacatgtaatttttactcagaaactaacaacttgttggctttaaaaaatactcattgaaattgaacattgcttcagtttctgaaatgaaaataaccagttcctaagttagcagtgatatcagcgatggtgtgtccggaattggtgggtccttggtctcactgacttcaagaatgaagtcgcggaccctcgcggtgaatgttacagctcttaaggtggcgtgtctggagttctttctgatgttcggatgtgtttggagtttcttccttctagtgggctcgtggtctcgctggcttcaggagtgaagttgcagaccttcgtggtgagtgttacagctcataaaagcagtgtggacccaaagagtgagcagtagcaagatttattgcaaggagcgaaagaacaaagcttccacgatgtggaaggggacccgagcgggttgccactgctggctcgggcagcctgcttttattctcttatgtggccccacccacatcctgctgattggtagagccgagtagtctgttttgacagggcgctgattggtgcgtttacaatccctgagctagacacaaaggttctccacctccccatcagattagttagatacagagtatggacacaaaggttctccaaggccccaccagagcccaaaccctgagctagacacagggtgctgattggtgcgtttacaaaccttgagctagatacagagtgccaactggtgtatttacaatccctgagctagacataaaggttcttcacttccctaccagactcaggagcccagctggcttcacccagtggatcccgcaccaggctgcaggtggagctgcctgccagtcccgtgccatgtgctcgcactcctcagcccttgggtggtcgatgggactgggcgccgtggagcagggggtggcacttgtcggggaggctcaggccgcacaggagcccatggagggggtgggaggctcaggcatggcggactgcaggtcccgagccctgccccgccggaaggcagctagggcccggtgagaaatcaagtacagcgccagtgggctggcactgctgggggacccagtacaccctccgcagccgctggcccgggtgctaaacccctcattgcccggtccagcagggccggcctgctgctccaagtgtggggcccgccaagcccacgcccacccggaactccagctggcccgcaagcgccgcctgcagccccggttcctgctcccgcctctccctccacacctccctgcaagccgagggagccggctctggccttggccagcccagaaaggggctcccacagtgcagcggtgggctgaagggctcctcaagtgccgccaaagtgggagcccaggcagaggaggcgccgagagtgagcgagggctgtgaggactgccagcacgctgtcacctctcaatgggatggtaatgatttaacagattgggttttcatcaggcagagggttgtttttgtttgctagagaggctgtgcagtgtactgagaagccgaaaagtgtgcagtgctaggttgccagagtttgaatcccatttctgccacttgtgaggtctttgactctttatgccccatgtttcttatttttaaaatggagatgataatattaaaagtacctatttaatggagatgttacatgtatcgaatgatgttacctgtgttgaatgttgttacatgtgttgaatgaacttagaatggtacttgccacatagtaaatactgaatattataatagctgctatacttattttatgataataactttagctgattcatgggggaccacaagtagcttgcaaataattttaaagattttagaaacatttggaaactgtcaaaggtaagtattcttccaaaggttaagctgttacagataacattttagtatctttgtgccgagctattaaaataaacataaataatctaacaaatattttacccaacgtgcataaagaaagaagtcagatcttaaatgcaagcaaaattatattagcctaacttaagcacttgaaatgtttatttctgtactttaaaaatgagtgctgacccagtgatatcaggaactttccccccaaaattgtaaattataggactgttatgctgatcaatgatacataaaaaagactcttacaagcaaatgtaataaaatgttaattgtagaatttagatggtagatacataagtgctcactgtacaattcattcgacttttctgtgtatttgaaaattttaataataaaatattgaagaggaaggctcttatacctccctatcactgaagggaaaatgaacctttttgaaacttgaaaacttttgctaggtgctgtattctttggcatgagagatagcagttgaagtggtctgaaacacacacatgaacacaccctctgaaatcccattttagtcaaagttggggataaatttccaaccaccaattttttcttttctttttctttttcttttcttttcttttttttttttttgagacagagtctcgttctgtcgcccaggctggagtacagtggcgcagtgggctcactgcagcctccgcctcccagattcaagcagttctcctgcctcagactcccgagtagctgggattacaggtgtgcgccaacgcgcctggctaatttttatttttttggtagagacagggtttcaccatgttgaccaggctggtctcgaactcctgatctcaggttatctgcccacttcggccttccaaagtgctgggattacaggcgtgagccaccgtgcccagccccaaccaccaagtttttcttttttggagtcctcttggtttttgtgaattgaagtcccatttgcttattggtcatctgtttaatatcagggtcatgcttcttttctttagtccgagcgggaagagctttgagagatgagaatgcagggagccacaaaatagttacttcaatttagaggtactcttacacactgacattcctttttgacctagaagagtttgccagcagctgtatggttaatatggagttcacattttctgaagctaataagcatctgtacattctgtgatctacacttacaacatctaatggtcctttcctcttataatttgtggtaaaagatgtttttaagctgaatattctgttacactaacactgttcattgaagaataagatcagaaattaggttatagattacatctaaaaaaaggcagtattttataaccatgtggaagaaatattaagctgaaaatgtttgtattttgtgtcatttatgtcatatgcctttttaagaaaaagtgtctttgctcattaacaacagaattacggtggtattatctccttcttcacagatcacttctgggatcttgcttttaattctgggtaccactgtgtatgaggagcattgagcaattgaaatgtgatcaccactcatgaccagggtggtgaagggtctgcagactgaccacggggaagccattgacagtgtttggcctggagaaaagcctgccagaatggagtcctcctccccatctgtaagggcttccacgtggaccaggaagcatattgcttttgttaatatctcagaggaccgaaatttatacgaaggcagatttcagcccagtggaaggaaagacatagaacagttcgagccatgaaacaatgaaatgaactacctcagactgtgatgagccagatacagctgggttttttttcctgcctgactactcctgtcatctgtttgcaggatatggaaagatgcaggggcccgctcaagtctttttctaaggagaaattttagttcctaagcacctaaaaaaagacatgctgagaagttcaaattgggggccaggtacccccaccggaggagactatcccctttgttctatgagttgcttctaaagtaggagccaaaggaagtttccctccaggcctactctgaggatgcctgtccttttgaaagcattcaagaaaaaacacctcttgattcaggatcatgatacaaagaaatagagatatcaaatttttgataaaaaagaaaattctataatgttaaaactgaaatgaaatataattatatatgtttccccatgaatatttttaaactttttttagggttataaggaaatagtctagatatattaaatgtctaaatgaagttcttagcttttcagcaagaagaaatagctaaaaatttaaagtcaggaagcttacaaaacagatccaagagagtaagagacaaataactaattctttttgaaaaaatgtttaagtttgccattaataaatgattgtctaagtgagacagctttggctgttgcttagacattttaaaatcttgatttgttaagaaaatcaaggactttttttttttaatctccttgtcacattgttatcaaggaaagattttctttaaaagccaatactagaccctaaaggtaatcaaagagtattccgaagctgcatgatagttttaaaattttctctttttaaaggcagtgtgttgctctgtcacccacgctggagggcagtggagtgaccattgctcacttgggaacctccagctcctggcctcaagtgatcctcctgcctcggtttcccaaagtgctgggattacagacccaaatgatactttggctgttcttcagggagaggtctttttctctcttgctccttttcttcctgtcctctccttttctaccctgatggagcaacatggtggtttgggacacttgtatttaagttctcattgaatatcggggttcctcttgaaggctcttctggatcctacattacttctgacaccctccctgctaatgttctttccctaccacagacacatgtaaaacccacaaattggacaatttttgtacatttcaaaccccttgcatcattatgcttttttcaaaaatacgatttcaggaatgatcaccttgtaatattaaatagctgtagaaaatgacagaaatttggcatgtataggaagaccattggatcacagtagattaactcagcattcagtcatttgacatgtattttttgggtgcctactatgtgccaaagctgagaggttctagaagttaaaatggtgagctagataaacccgtggtccctgctttcttggagcttacagactagggggaggggacagtgtcaaactgccagagtttttttttttttttaaaaaaaacaacacacacacacgggttaaaaagcaagttatctagagtacttctggaatcacttccttgacaaagtgagctttgagcagaggtctgaaggatgagttgcaattaatgaggaaaatggtgatgatgaggggtgagatacttggagaagcatggcctgctgaaagaactggccacggcgacctaaagggagcacctcaggtgtgtacaggagaaactccagggcggtgtgggagcctaggtttagatacgcattccccctctttgctctgctgctgtttttaatacttcttccagaacttccctaggattatcttccacaggggagtagatactgtttttattgtaatgaatcatcatcctctattattgcaagtgatgaaggcttctagtagcagtggaactaggaatggcgtcagtggctcagctcttgatggcagatctttagggggaaaccctttcagttttaatggtggataaagcaaaactcctcgttctcatcagtttcccctctaggctgtcctgggtagggagttgataggagatcttttggacacgggaattgcttcactgttgacagaaagacatggtgcatttgattaaattaaattaggagcatgtgtatgcttgacaaagtgagctaatgaaggaaaatgcatcaaaaggatttatggtgaattgattaaaatttttctttccagaaaacccttccagcttaaagcttggaattgtaaggctatcggtgctgctaggccctctaggttctcacttgcctttacagtaggcagtttggagacttttctttgagcagctgctccttctgtagcatactctgttgcaggcaaaagtattcccaacctgcaatctgaattgtatggaggaaaggggataaaagacactgtttgatttattaatttctagtggattagaactacaaatgtttgctatgtttttaatttgagaagtagagagaatcacagcagcttttaattatgcattttgtgtaatgcagctctgaatagagcagaacaaaattaaaattgtggatcaaataccgaatctgagtggatgcttaagtgagctgtagcgtaatgctaatggttttgcgtcttcctggcattatgtcaataatggctgtaatcacattaagtagagagcccattagctttttctttgcagcagcatgcaccatagcaacatagtgtgagtttctaaaataacttttgacattgttttaaaaaacatagccatgtttagggtaagaggcaagtatatataatgtgtacaggtgaacacagatgtgttcacaaggctatgttatatgtacagtaagatcatctattatataggcacattaacccctgctaacattatggcttggaaaaatctaacccagtgtccttatcttcatgaatttaatagattctctgctattttcacgagagtaaagccttcctggagttcaccatggtgtaaagtcagacctactttctgaatagtgttgtacctagagtgtggaaaagccttttaatatttccctcctttgctgcaatctcatatggcatggcatttccagctgtccaggtctatgtagttctttctgtgttgaagctggaacacagaagtctgattgaagttcttttgctttaatgccattttcagtaccttttgatagagagctcccaagatgagcccaccatgtggtgttcatcatgggtttttttaatgactgggagattagaattactatggtatgtgaatattccttctacaaataactcagttttgggatattctctgagtagttaaacattctaccaatttgattttttttcaacgaaagcttcaagtgcaattaaaacactttgcgtttttctattacactatatgaagataaactaggagtcagtaaggcaattttcaaaacaaagtgttgcagagatactttattctcagtatgtgtattaataacttgactcatctttctcatcaaaccttctccccaccagcacatacctggaggacatccagggtgcaatattgagggttcatctcccatgctctcctctttgtcacctcctctattcaattacaaaacaaaagaaagaaaaatggtgctgcctcagccatctaagtaaataccattgcctcagccttctaaatagcccttgaacacttttctcccttcattcaggtcctcattgtctcttgcctattttcacatctaatgttcccaagtgttcttctttctgctgtttcatgaaataatttttaaaaaacaacatatagtgatttgtatgtggagttaatttattttttcctgggagatattcttttcaattaggatgtataatcctaacttttattcagtatgcaaggataagtgacttaatttttacagctgatcactgtgcattctgttagtgcagttaaaaattacagttctctcagaactttaaagcaaatgctacatcagtcaagattgggtgtctttgtttatctttggtatcaaagacccagagaatttggagaaacatcacacagcttgaaaagttatttagacaagctataatatcacatgactgccccctgagtggtaagacattgcccagtggatctgaaaacacttttaagtacttaatcatcatcgtatcttttttaaattttttatttcttatttatttatttttgagacagagtctcgctgtgttgcccaggctggagtgcagtggcacaatctcggctcactgcaacctccgcctcctgggttcgagtgattctcctgcctcagcctcccaagtagctgggactacaggagtacaccaccacacccggctaatttttgtaattttagtagagacagagtttcaccatattggtcaggctggtctcgaactcctaacctcaggtgatccacctgcctcagcctcccaaagtgctgggattacgcatgagccaccacgcccggtcccatcatcgtatcttcatgagatagtcaggaatggaatttgaatactttaaattggaacatggagaggtgaggtgactgtctaaggttgctttgacagtggtggagctgggatcaacacttttatttttatattttaaaatatacttcctcttagccttttaattcagaaaagttaactttagtttcttaaaggaattcataagtgctacctcatatccctgtatagcagtcttacctttacagagcactttccggtttgtttcttgttagaaccccacaagggaaaaaagtaggatccccttctgaagatgagaaatttgaaggatggtcggttgttaaagaatctgaattcttctgactcttcgtccatggcattccactgtataatgctaattaaaatagtttcttctcttctgcagagatgtaaggttccactgtgacaagtgccattttgtctgcccacacactaggaacacctcaatagggaaagaagtaagagccacctgatttgctcttcttgtatcatgcttagctccaaagtagtctcccagatgtgtgtccttttccactgttgtctcctgtctgtctagatgtgccttgggactctgccatagtatccacatacagctgctgcctctctgtggatgacccatgtccatttcccatgcttccaccttccttctgtaccagttacacattttcaaatgtccactgacttctgatgcctgttggcacgatccacaaatccatatcaacataactaaaacttaattttttatatttcacccctttcattaagtagctgtttctcataacttccaacattaacctttcatttactattcattgagcctccaatggctgaattttctggtgcatctcttggcatttctaaagttccataaagcagcacttgcctctaagagatgtaaaaagaagaaggattataagaagtggaccattcttggattttagaagtttcactatgtttgaaggctaagaggctggtttaggactgagtgaataggcgagccagtctggaaggagttggaaggtaactaagccatgtgacctcttctgaatttttatcctaaaagagtgcacagcctgtagaggagagtaggtatatataagaacctaggtgaaggtaaagctaccagaacatgttttgaaggcttagatctcagtttttcctaatttccatcattctcactgacaaatgcagggcagcacctcatgtaagcttactaccagcttttctatttacccctgcaactctgtctcacactgaccctttctcccctctttctcctaggaagtgagaggggaaggagaagtaagatgagaaagcagtgaggttatatacctgtactgtccagactcctttccctttgtgttactacaggacaatatagtgcttgtgaggcctttggaatatatccttacagatcttaagaaaatcatgtattagttcgttttcatgctgttgataaagacataactgaaactgggaacaaaaagaggtttaattggacttacagttccacatgactgggaaggcctcagaatcatggtggaaggtgaaaggcacttcttacatggcagaggcaagagaaaaaatgaggaagaagcaaaagcagaaagccctgataaacccatcagatcttgtgagacttattcactattgcaagaatagcacggcaaagacccgcccccatgattcagttacctccccctcggtgcctcctacaacatgtgggaattctgggagatacagctcaagttgagattttggtggggacacagccaaaccatatcattctgcacctggcccctccaaatcttatgtcctcacatttcaaaaccagtcatgccttcccagcagtcccccaaagtcttaactcatttcagcattaacccaaaagtccacagtccaaagtctcatctgagacaaggctaaagtcccttccgcctacaggcctgtaaaatcaaaagcaagcagctgggtgcagtggctcacgcctgtaatcctggcactttgggtggccaaggcgggcggatcacgaggtcaggagtttgagaccagcctggccaacatagtgaaaccctgtctctactaaaactacaaaaatcagctgggcatggtggtgcatgcctgtagtcccagctacttgggaggctgagtcaggagaatcgcttgaatccgggaggcgggggttgcagtgagccaagatcgtgccactgcactccagcctgggcaacagagtgagactctatcttaaaaaaaaaaaaaaaaaaatcaaaagcaagctagttacttcccagatacaatggaggtataggtattgggtaaatacagccattccaaatgggagaaattggccaaaacagaggggttacagggttcatgcaagtctgaaatccagcagggcagtcaaattttaaagctgcaaaatgatctcctttgactccaggtctcacatccacatcacgctgatgtaagaggtgggttcccatggtcttgggcagctccgcccttgtggctttgcaggggacaacctccctcccagctgctttcatgggctggcattgagtgtctgtgtcttttccaggtgcatagtacaagttgtcggtggatttaccattctcgggtctaaaggtcggtggccctcttctcacagctccacgaagcagtgccctagcagggactctgtgtggggtctccttccctatgtttcccttttgcactgctgcagcagaggttctccatgagggccccgcccctgcagcaaacttttgccagggcatccaggtgtttccatacatcttctgaaatctaggcggaggttccgaaacttcgattcttgacttctgtgcatctgcgcacagaacgccatgtagaagctgctaaggcttggggcttccaccctctgaagccacagcccaagctgtatgttggcccctttcagccacagctagagcggctgggatacagggcaccaagttcctaggctgcacacagcatggggaccctgggctcagcccatgaaaccacctttgccttctgggcctctgggcctgtgatgggaggggctgacaggaagttctctgacatggcatggagacattttccccatgttcttggggattaacattaggctccttgctgcttatgcaaatttctgcatctggcttgaagttctccccagaaaatggggttttcttttctatcacatagtcagcctgcaaattttttaaacttttgtgctctgcttcccttataaaactgaatgccggctgggcatggtggctcatgcctgtaatccaagcactttcggaggccgaggtgggcggatcatgaggtcaggagattgagaccatcctggctaacatgatgaaaccccatctatactaaaaatataaaaaattagctgggcgtggtggtgggcgcctgtagtcccagctactcaggaggctgaggcaggagaatggcatgaacccgggaggcagagcttgcagtgagccaagatcatgccactgcactccagcctgggcaacagagcgggactccatctcaaaaaaaaaaaaaaaaaaaaaaagaatgccattagcagcatgcaagtgttgagtgctttgctgcttagaaatttcttctgccagataaccctaaatcatctctctcaagttcaaagttccacagatctctagagcaggggcaaaatgctgccagtctctttgctaaaacataacaaaagtcacctttgctccagttcccttcaagttcctcatcttcatctgagaccacgtcatctgaattttattgtccatattgctatcagcattttgggcaaagccattcaacacatctctaggaagttccaaacttccacattttcctgtctgttgagccctccaaactgttccagcctctgcctgttacccagttcctaagtcgctttcacattttcgggtgtcttttcagcaacgccccactctactggtaccaatttactgtattagtttgttttcatgttgctgataaagacataccagagactaggaacaaaaagaggtttaattggacttacagttccccatggctaaggaggcctcagaatcatggtgagaggcgaaagccactgcttacatagtgacagcaagagaaaaaatgaggaagaagcaaaagcagaaacccctgaaaaacccatcaaatctcgtgaggcttcatcactatctcgagaacagcatgggaaagaccagcccccatgattcagttacctcccccgggtccttcctacaacatgtgggaattctgggagatactactcaagttgagattttggtggggacagagccaaaccatatcaaatcattagtactgtttgagagcatgttcactttttctgagctgcttattgctgtaggtgaaagcaagttttactccttataaactaaaatttagtcatatacagtacctagtttgttagcagtgtttaaaatataaaaagcacacacaggtataaagtataatgttccatagcacataagctgaaaagctcataattaatttttaaaatccaagattttaactagatatattcattcagcaaacattttcattagttttctgtgaatataagagtgaaaagttactatccctgttgtcatgcaaactgacaattgcaatgctatgtgatatttgtattattggggatatggacaactagaggtatatgagtatgcacctcagtgtcacatttgggcctagatacctcctctgccttctgttagctgtgtcaccttgaataacacttttaagcctcttaaacctcagcttggagatgataatagtacctaccttctggtggttgttggggaaattattcaagatactgcatatagtccgggtgtggtggctcacacctgtaatcccagcactttgggaggccgaggtgggatcatgaggtcaagagatcaagaccattctggccaacgtggtgaaacctcgtctctactaaaaatacaaaaagtagccaggcgtggtggtgcacgcctgtagtcccagctattcgggaggctgaggcgggagagttgcttgaacctgggaggcagaggttgcagtgagccgagatcatgcctctgtactccagcctggtgacagagcgagactccatctcaaaaaaataaaaaataaaaaaaaataaagatactgcatataaaatacctagcagaatacttggtggaaaacaaatgttcaaaacatattagctattgttattgtaactctagtagcgaaaggagtctctaagtgtgtcttgggcagtcaaggaagactttgcaaaagaggtaggtagcattcaaagtgatgctcaagaaatgagtgtagggccaggcatggtggctcatgcctataatcctagcactttggagggtcgaggcaggaaaatcacttgagcccaggaggtcaaggctgcagtgagccatgttggtgccactgcactccagcctgggtgacaggtgagaacctgtctcaaaaaaaaaaaaaaaaaaagagaaagaaagaaatgagattaggagtttttcaggaacacagtaacagaacagcatccactcaaggatagaattggaagaagtgatagcatgttccaggattttgtgcatcagtatttctgaagcataagaacctggtcaggcaccagatcatgagagaccttgttatccagaagatggcatttttttttttttaattttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccacgaccccaccacagtccccagagtgtgatattccccttcctgtgtccatgtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcctgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacagtcatgtcgtctgcaaacagggacaatttgacttcctcttttcctaattgaataccctttatttccttctcctgcctgaatgccctggccagaaccagaagaaggcattttaattgcatactctgtaccagtcatctcctaagtggaactttttttagatagctaatttaggcagtttattgagatatgttaagaaagtgttgaatttctgttgatttttttccttatcttgttataatttgtcttataatattcatgttatatgtgtaatatatttataaggcattaaatattagtattgtaagtacgtgtatgtaatttgaacgtgatagtcaaccagtatacaattgtgacccaataattgtttttatggctggtgtttgttctaatcagtaatggcatgttggcatctgttcagattgattgttgccttgttgcctggccctaccggttattaacccttttttttttttttttttggagttggagtctcactgtcgcccaggctacagtgtagttgcacaatctcagctcattgcaacctctgccttttgggttcaagcgattctcatgcctaagcctccatagtagctgggactacaggcgcctgccaccacacctggctaatttttgtatttttagtagagatggggttttgccatgttggccaggctggtcttgaactgccgacctcagatcatccacctgccttagcctctcaaagtgttgggattacaggcgtgagccgccaggcctggccttattaacacatttcaatcttactcctgtaaatataccagagtggcactgtgtgctaatattttgtaactgatcatgggcctgttgactactcttctggaagacagggagccattacagaactttgggcaagagagtgaaatgattaaaagtcgtgtgttagaattcactgaatcatcctgagggctaagttagcattggaaaggccataggaggagctatcacttcctaatttatttaggtgtaagcatatagatcatagttcagtcacagacatcacccatcttgatggaagacttatgaaagaagaacatgattagttttaactttttcaggattaataagtagaaaggataggagatgaattttgaaaaaaccattgcatcacatcatataatgatatagttaccatctctgctaaaatacaaaaattagccaggcgtggtggcaggcacctgtagtcacagctactatggaggctgaggcatgagaattgcttgaacccgagacaaaaattaaagactgttctttcaaaatattctgagaagaaaggaaagtagatatgtttaggaaatatttaatcttatattaattatttaatcttatcagtctgcaaagagatgcccctccctgtctttgttctttgtcttcatgtatgatgtgctagttatttaatattgtgtctcttttgtgcttcggatcctgaatgacctcagctgaagtttcttcccttcttccaggtttgtttgatacttaaatattaagtatttaaatattaaaaaataatatgggtaatatttaatcttaatcctaatgacctgaatggcaaagacactgtactcttggagcagatgtccagacattggcctgtgtgccatgccagtcctgtgcagattgtctgaacatcagcctggagagaaaatgaataaatacatttttaacaattatttatttatttgaggatcttaaagagttgttagctattattagggtctactactagctcctcccattttaaatcatttatatttgtcttctttctttttttttttttttttttggagacagggtcttgccctgtctcctaggctggagttcggtagcacaatcttggctcactgtaacctctgccttccaggttcaagcaattctcttgtttcagcctcaagtagctgggattacaggtgtgcaccaccaagcctggccaatttttgtattttaagtagagacaaggtttcgccatgttggcccaggtggtctcaaacacctaacctcaagtgatctgcctgccttggcctcccgaagtgctgggattacagacatgagccaccgggcctcccaaagtgctgggattacagacgtgaaccaccatgcctgaccctatttttgtctttttcagttgtgaattttgtagttggaggaggaattagaaaataatctcctatcattgttaatatgtaaccgtcatttgcaacaaatggaaatttaattctgtttttgtcagtgcggtgagatagcatcaagtatacccttcatttggatagattagtcaagaatttggccgggcgcggtggctcacgcctgtagtcccagcactttgggaggccgaggcgggcggatcacgaggtcaggagattgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagaatttaatacttgtatgctcacagtggcaaattttcagcatagtcatttttgttaactttccaaaatgttgtcagaacgtgctgtcattcactctcattcaatctcctgaaagttaactcctgtctcattttctgtgagatgatccatgtttcctgttacacacacagtcagtacactcttagtgtactagtctccctgcacacctttcagaacaacattgctttcagtagtaaaaatggaaagagagaggccagtggagtaatgtgaggaaagaaggaaatgggtgggctgcgggggaaatgatcagttccccagaaatggtcggttctggagaaggaagaggatagttctaaaatttgggcataaaactaggacatcaaacaagcctggatgaagggaagaaacttcagctggggtcattcaggatctggagcacaaaagagacataatattaaataactagaacatcatacacaaaaacaaagaacagaaagagggaggggcatctctttgtcaaaggaggacaatgtgaagaccaggaacaagcaggaatggagaaaatgatctggtctttggatctgtgttgcagactgatgataggttctgtctcccccgccatttccattgtggaagaggtatgatgtagctggaagaaacttgataaagtatcctacaagtaaagcccttcgtgtgtgcctttgccactttccattatgtggagttttttcctggtgttagatagggctttttttctcttacttttctccaaactttgtcttttggctcttcgtgttaatcattttgccagcaggagttacaagatttggttttggtttccactttacaccagtttacacttaaaggcaaacatttaattcaagctttggagaaggtagagaaggtataggcataggtgctttatctcaatataaaagttgggggcagaatctcaggagatggctcctgagctgttcttagatgtatcactttattaattcttacaataaagccaaattgaattgatgtcggcatgtcatgttctaactggctttaataatttttttctttggctggtggatggagatggttttgagttataaaaaagtaaagaacgtgagtgaggaaatcctgggttagctcagagacagcaggaggatttctgagagagtggctgaggaaaaagcaatccatagacttgccaatggacactcattaaatgttaataggaactgcatgtgatgaaaggcaggcggctctggattcatcttgtaactgtatgtctacaactggaggtgtgtgaatgaaatcaaggaaaggcattaaagaaattatttgttaggaagcagaagcaagagtttgtttactttcatactaaagagaacactaccagcatttgtgaactgcatgcacatgagaagtgagcaggcttccagctcagtggcaggtgcaagatgatgttagaaacaaaataactcttatacttgaataaattcacaagaaggttgtgagtccctgacacagtaggtatgtaaaaccacgtagctgacatcaaggcctgttgcacttttgtaacctccttgaatcactggagcgagcagtccctggtgatgcagcgtgttgcagggctctgtgccttgatagggagttgcacctgtgatacccgaaacctccttacaaactccccccgccaccccccaccacgttgtcctggatcattggaatgcaggcgctggattgaaacgtttattcatagtagattaagagtctaagtatctgtgaggcctcacttaggaggctcttagaggattaataaaatatttacaaaataacctatgcaattgcttcattttaaagatatttgcctcttatcacagcataaatcctcattcaagtggcttctctgttctgtgaaggaagttctgtacttgttcttctggagaagcagaaacagattcctgccatactttaattaaaaacatggaagcgcctggtttctccacacgtgcacattcttgttcttacacacacagccccaacaaagagatcaacagagggatataaaatgatcatttttgaaaaagacttactgattcaagtgagcggcattcacatgtaaaatgttccgaaaatttattctgttatttatgataaagaatcttatccctgcatgttttacctataaccaagagagcctcaattgatcaaagtatagtttttctagtaattaaaaatgaatattgatgtaattaaaaatgttatccttaaaagtctattatggtacttactgtatactatcttgtctgccgtcttggtagatcaagttgtacagtcatatttctagatgtaggatcaagatttcagttaatccttgggtttatgctaaggccacaagtatgtattatctgtatgaacaaccatttatggagtgcctgccatatgcctagaattccgtgaggcctttcacgagtactgctgtgtcatttaattcaatcctgataataacgctaaaaatcagggatttctcatcttgttttacacctgggtaactgaggctcagggtagtcaacgcagatcatagtaagtaaaagactcggtgttgaagcaccgctctgtgactccatgcctcatataatagaggattgcattgtattttgttttggtttgggttttttgatagaatctcaccctgtcacacaggctagagtgcagcggcatgatctcggttcactgccacctttgcctcccgagtacaagtgattcttgtgtctccaccccctgagtaactgggattacaggcttgcaccatcacacctggctaatttttgtatttttagtagagacggggtttcaccatgttggccaggctggtctcgaactgctggcctcaagcaatccacccgccttggcctcccaaagtgttaggattacaggcatgagccactgtgcccggccttattttgttttgactttttttttttttctgttccgttttacctccacttatttccaagaagggagaatttcagggttgttagaaccagagcttaatccttttttcctgatggccagtgctttgtaataacagtgatcttttactgaatttcccttcaatgatgtactattgctcttgttgtcttgctgccttttaaattatgacttctctatattataacttaaagttggtactttgataattgttatcaactttaataaaatatgtattagatgacttaaaatttaccagaaatctgtattaaaatagtctttagggcaaacaaaaaattacctgacaacagtctactcacttgcacgtgcgctttccctctctaggtaataagatggaaatatttttacctctttcattttctttctcaaagccgtttcagaaagggataatgtagctggcagctgtggccataggaagtctgtgcaatctgtggtttatatacatgaaaaatatatgccaaaatatatgcatttactatggttttttttctttttatttgttgataaggtgcataagccccaactttccactagactaacttgtgattaattgggacatctttgttctctccaatgtgggatctaaaaaccagcctccgtcttcactgtatggcagtgcagctgctgtttgcatgctgttttctttgttgctatgtgtgtgggtgcctcaggcccaagtcctgagtccccattctcctgccgtgtattgcttgtgtttctgtggagaattgtaatgttcttggatcagggacttttacaaataggtgtgttcttcctagttggcttggagtgatcaaagaccaccatgtttcattttgcccagagccttcgaatcccacccaccaccctcagtaaaatcctttgcagagagctttaccctaaagacacagaaaacaaatgcaacacctgtgaccctaagagcattacttacaaaggcctggaaactccctgaatgctgtttataaagtacaccctcagttgtgtttcttgtttcctttctagctacatgtgagcatgaaactcttttgtagaggtgcaggaaggtcatgctataggagaacgtgattgcacgtgttagaatgcatgctaggacacaggccgattcatgacactgaattctgactcatcctaagggagaggaaatgcatgtatatggatgtgttttggcttctatttaactctataattgtttcttttttcccttaaataaggatttcttcttgattaatggtgttattcacaagagactgtagggtttctgtacttgcttcacccttgtgaaggggaaggaatgtgttttcttttgccatgtccctcctcaacaggggtgctcttattaaaaccaggaaactaaacagaaggacggtgcatgtatttgctcattgttctctcctcgtgctggacttgagctgaaatgtggtttcagggcttcatgtgtgcactgagtgatggagtaattaagtgaggtaaatgcatatgaagtgcttgttcccttggtgcccggcacatagtgagtgcttagtaaacagtagttgttacttttcattggagccaaatgtatatcacacctccctttctgtaatacatatttatgatagcccattagttaagtctgaaggtcagtgtgttcttgccatagggctgtaggaaatgttttttgtacacttctacatgtagttggcggattgttttttaaaaatgctacctacattgttttcctctccctaaattatctcatgactctagcagattgctataaataagtagggtatatcatatttgtaggccaagaattgacaacccagtttcagacaacaatgaagattttctaccctatttgaatacaaaatcaaaaccaagatatttgttaatatcccaatattgatttttgttattagaagtaaattttagaagtaaatgttgaaaaggaccacaaaagctgcttttccagcctctaatggaccagcagcctcttttgggaaatgattagttgcatcttccaataaataacttttgatatattaaatactcatttgatggctgctctctaaaggaaatgaagctagcatggtcccttggcttccatgagccttaatctcatgtatctgttattgcacagtttataatggtaggggttttcccccttaggactgactatgttttcagtaatgttatttttttttaactcaacctaactggacaccgtagagggcactaataaatcacacctctctgtgctcaaataaagacagacattctacctctttctcccacctacccacccattcctggatcgagcaacagaactgagcttaaggccacctagagccaccatcacagaatctctctttatgttggatggcagtggggatgcagatctgaaacactagtgcatctgaaacaacaatgggaaggtgtggaaaaaagggttagcaggcctgagactgccctctttagggaggcctgcttgccaggttggcccttggctggcatccaggaacttggattttgggagtattcccaccatttcctcacctgatgaaagagtggctcattgcttctacactgtaaataatatgctttatgccgaacacgcgctttccttctgggaatctggaattttggtccatgctaggcaaagcatgcctacgtgaccactcccacaaaaactgtgggcactgagttgcaaatgagcttcccttgtagacagcacctcacacctgttgtcacaatttaatgctggagaaattacatgcatcctatgtgactcctctgggagcaccactggaagcgtgcacttggtttcccctggagtttgctccatgcatgttgccctgtgctgatgctgctttgtatcccatcactgtagtgagtcttaggtgtgcgtatgaccacgtgctgagtcctgtgagtctcgcaatcctgggactgatcttagggacctggacccccaacacaggtccctaagtaagttagtccccccaaaactaacttacataagattccatatgaggagaaaagtcagaaattcagaaggtgtgcctgaaaattttttctattgacaccccttgttccatatgatcttcttcctaaggactacttcattttgtcattgagtttagtcagtgaatatttttggaatataatgtaatcaggtaggcacttcttgcatatttacatattactgcaaattcatttattgttctccactaccattagaactgagggataaaggagagagacataacacaatgttcgttctctttgtctctctctctccccaccacatatactcacacattttccctgctttctactattgaataattagaaaccagtactaactagaattcttcttactgataaagtgacagttgaccctcatatggaaattctttatgagttaacaaattaaaataaaaattacctgaaattagagttaaattttttgatgttttttacaatattccaccactgtcccacttcttggatatttatctagaatatgtctttccctaccctaccgacagataatttgctagagtttttcatgtctatctccattttcaaggactctttagttgcttccttatcaggacaagaaagaagcagaagtgctgctaggaaatatctgccagagcatttggggagaaagtacaggacagagactggatgcaggagtggctgctggccaccagtgactttacctgctgctcttggcctggtaggactctgattttttttttttttttttttgagacggagtcttgctctgtctcccaggctggaatgcagtggtgtgatctcggctcactgcaagctccatcccctgggttcatgccattctcctgcctcagcctcccaggactctgattttgtctgcaagtgttcacctcacataaactttgcctttttgatctagtggggtaaccttcatgccttactccaaagaaaattgaacatagagcaaatagaacatgtgaatttataggcaatgtctatttgagactccataaaaacagatgctgaaagaaagattaggtgacaaaaatgttgcctcctgacttggtaggtaattacaagtaaaaaatgaaatgttttccaccttcttttcattagtgaaattttgaccttaatttcatgttaaactggcattaagtccttgataggtagttgtcatgtaatagtaccttttcttcctctaatagatatgatgagtaagaacaaagtcctcctggtgatttagaaaatcagctacctgttgatcctaagcagtggcttgagctctttcattgcactgtagttcacagagagaagcaattcactaattataaaagttggaataaggcaagcttttttattccatggaaccattatagctacagatttggaaataacaaatgctactaggtatgaaaagtaaaataagtgaaagccttttatattttataccttagactgcctgaagttccttgtatgatttttttttttttggagatggagttttgctcttgtctcccaggctggagtgcaatggtgcaatctcggctcactacaacctccatctcctgggttcaagcgattctcctgcctcagcctcctgagtagctgggattacaggcatgtgccaccatgccccactaattttttgtattattagtagagacagggtttcaccatgttggccaggctggtcttaaactcctgacctcaggtgatccacctgccttggcctcccaaagtgctgagattacaggtgtgaaccatcacgcccggccaatatttcttttaaaatacatttcatatccattcattaacattgttttatttctgtgctttcccctactccccccactctgtgtattttctttttggtataggagcagagctccatattaagaattaaatggatatattcaaaattaattagtctctcctttcatgtatctatgtgtttattttctcttggccattttagtcttaccaagtcttctgtaaaagatgctctctaccacttctccctctgccccacctgcagatgctgatatatctcaaactctggccaggactcaactacatattgttttggttaaagtattttaaatgtgctaatattcagtttcaccattgggcagttcagtttttgcccacaattggaaattgcctctagtctatcagcttttaaatgtatattcatttctcacatttgcacctggggctccgtttctcatacttagtctctagtccctgcatttctttttctttccaacttgtttttctgagatagccactctttttctctcttgccatttatttttacatttgaggaaatttaagtttttgcccttaaaactataaacaattctgtaacaaatgaactaagaatcataggctcaaccaaggtcttaaaatattttcagaaagatgaatatttacttgtattagaaaatattaatattcttatttctgagtatattatgtaaaacttctggatatctacatttgcaaatgtgactgcctaatcagacattgaaaaacaggttttaggctcacactggctgtttttgtttgttttattttttagtaaggatgtcgctaaagaaggtagttgagtttacagaagtaacaagtggttagttttcaacagaaacaaattaggtataagaacagcataattcataaaaattgtgttgtgtggctcacgcctgtaatcccagcactttgggagactgaggcaggaggattacttgaactcaggagttcaagaccagcctaggcaacataatgagatcccatctctgtacaactaaaataaaaaattagctgggtgtggtggcacatgcctgtagtcctagctacttgagaggctgagccaagagtatcgcttgagccaaggagtcaggctgaagtgagctatgatcacaccactgcactccagcctgggcaacagagtgagaccctctctctaaaattaaaaaataataattgtattataaatgtgatggttttagtaccatccaagctctgctctaggggtagaaagatgtgtattttacagactctgtactcagctggttatactgtaagggattatctgagattacatgtggcacatagatataaaatagaatgtgattaaaaaaacacaaaaaaaagcagaatgggacttctgaacagatcacagaattcaagagagagagataacatttgataggtgggccacaaatgattccccagcagactgatgacagaattctaagtagaagaggtagcataagcaaaacgttggtggtgggagtatatagtgtgttcactgaaagctaagttctctagttctggtgcagtgtcagagtgtgtatgtgagaactaagacataaaaggtagattggggcagttcttgaatggcagcattaaagaatttatgcttaaatcatttagcaaatgggaccgttgaggttttgtttgttttgttttgtttaagatggagtctactctgtcactcgggaaagtggcatgatctcagctcactgcaacctctgcctctggggttcaagcagttctcctgcctcagctgaatatggaagtagctggaacttacaggcatgagacactgggcccggctgaggtttattttaaagggaggagttgtaatgtggtcagaggtgcactttagaaaaagcaccttgacaccagaatgtcgtcagaatgtgagtggggtgaaaggagtgaatggaaacaatgagcacctatcaaaataatccagttaggatgtaatgtgagccattactaagcttgggagaataggtataaagagataggtatatgaaactctcttaactcttcaggcctggatttcagaagaatagtgggaaataaagtaggagaggacattgatggggtttggatgggtgtgagcaggcaggagtgccttctgtgaagagcatctcagtggagggctcaactcaaactgcttctttgaatcatggcttcgaaaattactcacttcatgatattagacaactttgacgcacctcagttttcccatctcttaagtgggtttgataatagtatctcaagcctgatttgggtatagatgaacagaatacatatctattacctagcatcctacttggctcattttcaggcctcagcaaagtgtaggtactagtatttttctttcattttctttgctctaccagatagttacttttaatcccatttcatatgtgaggagaccaaggcacagactgcattgtttaaatccgtccagtagcctctgtgcctttatgtgttctaggtttgggtttagttttgttttgttttcagaattcagatagaagttctttttgagcaactgattacattgatctgtaggccagatccctaaagacatccttagagttgaagttttccttataaaatagattgaacagatgcagaacagaaattagaaattgcaggaaggaggggaagaccagaagagaattcaggaattaatcaatgtaaaaagttatttgcagaagataagatgaaggaagaaagtatgcgcccacgaacatttataattgtaatggttctgccaggcgtggtggctcacacctgtgatcccagcattttgggaggccgaggcgggtggatcacctgaggtcagaagttcaagaccagcctggtcaacatggtgaaaccccgtctctactgaatatacaaaaattagccgggcatggcagcaggcgtctataatcccagctacttgggagaattgcattaacctgggaggcggaggttgcagtgagccaatatcgtgccactgcattccagcctgggcgacagagaaagactgtctaaaaaataataataataataattgtaatggttcattatttatgtgtctaatattaaactggctcatttaattcatttattcactccataagcctttacagaactgccaactatatgagagacagtgttgcagtttgctgattttttgtacactgggatttacctttgatcaagaaaatgtaccacataaaggtaatctcattcccaaaagcattttctaagaataggtaacttactggtacttgcaggggaaaaaacaatgaagattaaattttaaaatgtatgcattttgcaaaaactgtcattcttaacttgttcttcacccctagcgtactagtaatgatgctgcctccctgcaccattggtcctggggaactagtttacatttttaggaaaagcactcgaccaggtcaggtcagctagattcttgtcccaagtcagctacttacactttagcctcctgatcttgagcaagatacttacttgttaatttccttctatgtaaagacaaaacatggcactagatgatttctaagctgcctcccaagtcctacattcatagcatttataaactctgtgagcattgagtcttcttggcagtggggatatcaaggacgataaacctgaaataaagagacctacttgacagagaaatataagcagatccctgaaatataagcagatcactgaaggggcaggtcatttttaatgggagtgggaaggtggaaggaaaaagataggagaggaaacatttcatggagaggttaatttcagttgggctttgaagtatgaaaatgggcataccagaaaggcagaggggtgcagaggtaggtgagattttgtagtgttcaggatcatttatggcaagtaggtctttgtagctggagcttcagaggtcttggcaggagatgatgttagaaatgtaggttgagtctatattgaggggacttcagatgccaggtaagaggatttattatttattctgtgtacaatagggagccatgaaaggtttgctaagaaggggagtgaaatattcccaacctcatgtttttgaaatttgatgaaagtgtgtagaaagtggattaaagtgagtagggaaatcctgctatttttttaatggctatcttcatctgttaacttatacccaggtaccttttggcatttatattgatccttccaggattgcccccatttctgtaaccagcaccgatttcaccaactcagtaaaatcctgttggtgcttaccttctttgaggtggcaccatgagtttatctctcttaattgtctcccctaaacacacattattttccccaggctgcaaagtagatatatcattagcaaaaggtaaaaaggcaacgaaatccagccttaaaagataaagttaatgatttagaaattcactttactcagctgtacatccatagatagcctagatagttaaataaatcaggaaagattttaaccccttagtggttgtcacagtgatgtctgtcttaactggcatctcagtccccttaactgcaaagactaaaagaaaagagtatggcacttccatttttccctgcagcacctgctcagttgaagttgcattgctttcatgcaggacagacactgagattactctctggggatcagaacccgaggggttgtgcttagactccctgggcaaggcctgtcaactctggctttcatgtttccctttccttttgctgcagctgtttcttccagcctgttcagcaagtgcaccaagagttactgtatggtgtacatgcatgtttctaccaaacagctttatcatcggtgttagaagcctctctgtacaaacctgtggctgtcataaggcgatttgatttaagctttctgcatgcccaattaattgagagttgaaagctatccttcagattggtgtggccctgttacttatgcttgccagttatcagccaccttggtgtcatatagtggaagcattttgaatattttacatctgaaaatgttttaagataataaatggcagtcatctcagaatgccagatgtttcttcctgttctcacacaaacatttatttacctgataatctgcagaatcatagatttcagattaaaaacaaattcttctaaattatctgcagttgatgcagtctgtcttttttaaattattatttaaagatgctcattttgtcctaattttccctgtaaattttatcagagcagatgtggtcactgtgatgcagcagtggcctaaactaatttcactgatgtaaacattgttaaacaatttcaaatgcaactttggaaacattgtttctgaacctgtttaataatgtttaaaaatgcatcaatgaaattggcttagcctgtggcctttattacattatctgttctcaattacaaagattctgtgttttatgtctggactagttataagtcactgaaaaaaaatgatgccagctgaagagtgtggcttatacctaacccgtttaatttgatttaaaattgatgaaccttggaaaatacttccagaatgccatatcagctatcaaaataataggaaatgtattcaggtcatcatattggcattacaattttagttaccctccccccccgccccacctttaacttttattcccattgcttttcacctcccattcacccccatttccattgttgtgattccactactaaattccaagctatcagctctgaaatgcaacatagaacattaaatatgtttttactaattgtgatccgctaaaatttaagctctgtgccaaagcctttttatttttatttcagaagtagtatttaagtgatgacatgcagtaatttgttcattcttctgtcagtataatttacaaggcaatggcagataaacatagcaatacaagattcatttacggtgacacaatggcagatacacagagcagaaccctgcctatgagataaagtggactgagtgacttatgcagtaattaggggataattgtcattaacctcacaaacagtagtttacccatattgtttaaaaggctccaggatgcataatgacaaggtaatctgtcaaagcgctagggggaaatattaataagatttgtgcaagcctggatagaaaatatgcagaaagcggccacattaagctaattggtggatgaatatacacttgtaaaagtgcttctaatggcacgtttgcagctctccaaatgactaccgttaatgtggagaagtgggctgcttagaaagtcaggactgctgggacaagagggtattaaggcacgcagacgccgttattaccttgtgctctataatgtacgctttctccttttatcctttttcattttgaatttctgaggttttgttatagtaacatatattgattgtttactctgattattctgtatttgatctatatttcttcagtcagccaccaaaccccaaacacctctcttttgtggcccaataaaatatataatctctacgttgatagtggcttattaatatacagaaacacaaactattaatgcatatgtggatttataattatacacacatgtgtatgtgtgggtgccttttataggaacacatttaatctgagcaatcaaaggaaagtagatccattaacagccttgtgtatgtgttacaagtaataatgtgttgttccctgatgaatgctaaagcaggaaattaatctttgtgttctacggctattcttatacccagaaaagaacaaagttaaatctcctaatacatctttctgttcagtcacacactcagtcctcagtgtgttttatggaatactcaatcctcactgttttatggaatactgcttactaagtattccatccctttctcgccctgctccctcacatcctaatgaatatgttaaagttccttggggttgttcaatcagcttcatttgtaaagtaattcaaagtataatatgtgaaggagaatcatccattcaagctttggaagttctataccaatatcagtaatcttgattgtgcagatggaaccttatggaacctcaaagataagaggttgtagccttgaattgttcaagttttggcccttacttgatgtgtaaaatcaccatcatcatgtaaaaaaattttttgcgcctatttttgctgtttttcagacattgtggaaaagcatatctggaaatcccagggactctggcatttatgtttagaaatgtaaagcctcaactatctacaaatttagtagtggaactttggtttatgcaaggagaggtaagctagaaaatgtagacctcaaagcaaaaatgtcagagagggctctggtgagttctgtttattgtaaagcaagcagatttatagctgtcctaagaccagggatttatctttatgtctgagtggacaagaaaacaaggccgctgcagggactgtccctttctttcctcctgtttctagtgttttccttaaggatcataaacggttcctttgctgttctaaactataaaataagtaccctctagaatctccactagttatcatctccatatgaagaactattaaagggtttaattgaggtgagggtcttctgtacaaatactgctagtttttggagctgcaaagatttccgaaagactaccgatatttgtttacatagtttttttgatatataacatttattttgtaccttcaagttgcagaatgttcacaaaccctactggtatgatttgggggtttccaaggcctcttagggagtctttgggcagtttccttagtttacaagcagaatttttacttgaactgattgatgattgaattgaccaggagtcaaaattaatccaaaagaattagtgactgtaatcacatcactgacaagcagcaccagacagaaacatcaggggaaacatccagaatatacgataatacaggaactttcagataaaggcatactttcagtcataaatacacatattctaaaaatacgttggttacacaagttggttaaaagtaaaagggttttaacattttaattaaagtgattcatatgttcagattctaggcataaatagtagaataatagaattgtaaagctgagtttttagtaaggcttacaaattttagtatgactcctctttacatgtgaacattaattttattttcctctgaggttgaatttgtgtatgttatatttagcctaatcaagatacaaaatctgctttagcctaaaggtatagggctagatattctgtgcttaagttaaggactcataggtaatttgattttaaagattggtatactaggaatatcaactggatttagtattttctattttgaaacttaaatgattcctaagatattcttattaaatattaaaatgtgtctttaaaagtttctcaggtttgatttacaatgcagcgaggtaacttgaaaaatactttggaatctttgaagtccaattccagacattgcagaaagtaatttactcctttgaatttttttaatatggcaaagcaaggcacctgctttatttatttgcaaacaaatgcccatagaggaaatgcatatggctggttttaagctagacaagctaaaattcctcagtacaaggaagaaatcctgacaggcctgtaatagagcttagctggagcttctatgattaaatatgttgtaccccagagtgatctatcataatcactgtttttaaaataaaaacgctgtatagactgttactgaagaaaaaaggcatagtactctatgaattatacattcttatctggtccgtaatcaagaacattctgtaacagtaaattttttaaatcaaatgtcaagcaatattttaaaaatcagaagaaccacatgaaactagtgccctggcattttgataatgttattttggttagagaggtgatcatttttggagagtatattgttcaacttgtgaatacattacttcttttaaaaatatatcctttccattgtgaaatttttttcaaatatggatcagaaaaaaattataaatatttgtatactgggaaatatatcaaagccactacttcaaagtcacataaaattatcatgttgcttcttccttctaaaaactagagtcaagggccatgctcctcaaacttccactttaatccaaggagaggcattcttttgactatgtactttttttttgctagtagtttgatatacctcacctcattatatcaccattcgctaagttgaagcactttgaatgctataataagagtgatttataatgagagtagtatataataagagtgagccaaggtcagtagtttctgtattcctgtgtgtgtttgtgtacatgcacatgtgtgtaatgagtaactcctttaaagtatcaatctttatatgcagtcagtgtttacagaaagaagatttaatgttaatgttagcatgtcagctaacaaagactaataagttatttatcttgatgggaacttctttaatacaaagttttctgagagccccaacattctaactaatggtggatattcctgtagcattcatttccccttgggcagaggaagaataggaaagatatttcaaattaagtcctttattatctggatgaactgaatgtagcattagctgtgtaatcacagcaagctggtatacacctatctctaatgtttgcatacttacttcatgacaaaggcagtttggggtggatgaggaaagcatatttgttcacataggtcaatgttaacaagtaaagtccagtctgaatttttatttcgaaatcattctttctgcccatgccacaccctgaagactctcactcatggggcatccctgtcctagagaggagagtagggatgtgattggtcagcattgtattttgaaggtaaagggatgctgttgagaaattctgcaaaatacaaatttccaaatcatgaaaattgagtagggctttcgttacccaaaacaaatgttgatttaaaaaaaaaaaagttctaatttgaaccatttggtacatacaaccgtgatatgaatgagtatgtttcattctgcctacaaatattacagttgttccagctggcctcctagaaacattagcccgaagttctggaaaagcacagtcacataaaagagctttgtgtgaatagagaatggtgtaattttgtttacttacacaagcaaagtgctctgatgtatattgtgtatgctagcggtgcatcttcctccgtcagtgcccagcaagaaatatgtgtttaatgtaaatctgctaaaacaaataaacatgccaagttctttttccacgattttaagtgtttctcagaaattatcaaaacattgcttgaaaaatttccctaaatgcttcccagaatctattgttttcaatgagaattttttttgtgtggccatttttattcttctccccatcttgcctgctcatacttacacacttgcaggcacatagacacacaacattgatccatgcacactttggaaagccaagtcttataaattagagagataaacataatctaacaaaaaagggaaaaaatgactctgaaatagtagggagcagtcagatcagttaaactttttgactgagggtttaaatactggctttagaatgacaatttaaggttgaaatatctgcttattacatatggacccatctcagttacaaaacaggtaaatagcgggagaatgagagagaagaggactgcacatattatgtataagtgttttcttcagaactgtttgtaatgctcaaaggtttctcttccacagaatatctccctgaaactcctgctttcagcactcagagccacctctttccaacccacatgtgggatctaggagttttccatttgctgacccctagctagaagtttgttgaatgcccctgttcatattacctgagataatggtctgagcctatcactcactcctgaggtgatccagaagttagatggtatatctcctaatttctgggtcacattctgatacatgtccacctaaccaagaggtcagcacaccggcaggtgtaggcaagcaaaggcggattatcagtgtcttgcagagtgtctgcgaaggtgtgtgtgcatagcacatacctgctatatattggtgttagctctgtagggaggtagtctccatagttttatgattacacaccccattagtaaaaatttgtgagcatgtacccccatttatatatatgtaaagctgtttctaaactctgtgtgtgtgtgtgtatgaatgatactagcaaaaaatcacctttaggtaaaaataaataggagttttcatgttgactcaccatgtcacagtggattgtcttgcatattccactaataggagcaaatgggagcatgtgtgcctgtgatttggccgtgctgtaatacaggaggaaaggagtaaggtggcttataaacagtggaaagctgtacatgttgagttatgtgtgtgagagttcaagcaatttgcgtgatttaattttttgaattaacttcattgaagtatactttccatacaataaaatccgccaattttaagtgtacaatctatgtggccataaaaacctcagcacaatcatggtgtacaacattctcaccaccccaaaagttccctagtgttgctttacactcagtccctttcccctggcaactactaatccactttatgttcccataatcttaccttttccagaatttcatatgcttggaacagtagcgtatgtatgtctttgggtctaacgtctttcattcttagcataatgcttttgaagagtcgtccatgttgtagtcggtagcttagttctttttattgtgcagtactattccattgtatagatatctcacaatttctttacccctaagacttgaacatctagaaaacctggtaaaatttatgatttaagttttgcatagcattgtttcatcaatttttaattcagcaattactgtttcattttacctaatggaatacttaagctaggtaggcttgaaatttggtaatttctctactttctatccaatctgtttctcttgctttgatatttgaattaacccagaaggaaaaagaatagaaaagtacaataggaaactgattatgaaaataaattgccaatgtggttatgatgaaataatttcttaagatagcacactgtgccaatctagacatgaaaaaataaacatatctcacaaacctctgattttgttttaggtagtcagcagtccctacaggtcagtgtcatttaattaaaagctctacagttatatcaagggggaaatacttttagtttttagctaatcattttagtattttccattaaattataccttaaacttgactgaaaataagttcatatgattgagtcttttaaactgtttgcttcttgttttgcttttttttttttttttttttgacagagtctcactctgcaaccttcacttcctgggttcaagtgattctcatgcctcagcctcccgagtagctggggttagaggtgccctctgccacacctggctaatttttttgtatttttagtagagacgggttttcatggtgttggccaggctggtcttgaattcctgaccccaggtgatccgcctgcctctgcctcccaaactgctgggattacaggcatgagtcaccgtgcccggctgcttatttcttaacaatttgactactggagcacataggccttagatccgtgctgcgtccagtgtttcttcctcacttccattcttggacagaaagaaagcagttgttttcctgtatgctgtgatgtgagttgtagcctgccatgaacacaggtgggctccttgttggactgagcttgaggtccctcgacagtctgattatcccaaagccccttatttggtttctcttccatctcttcacatctgttccttccctactatccctctttcccaataagggaaaccaatcaaccttattttactttgattttaaaactataaatcattgaagtgctttgatgtgggaaaggactcagataaaaccatttaaaccatgcatttgatcctacaacaaaaagttttaaaaagtcacttggcagagccatacaggaacagggtgccagatttctacaagtgataatcaccagttccaatgaagtaacaaaaggaagtctttttatttcaaatgtgtaggtgtaaatattttaagtcttttatactttttctgaacccagtaaaactggtttataagtctatattatttggtgttactcatcttttaattaacagtatagccagttattttcacaggaaatcaacacttatgataataactcgcatttaacttaacagggtaaatcttattatcctcattttgtcaataacatttttcaacctgaagggttaaaagtcactgtactctggttacaaatgggaaaacctaaaagaattgacttaccagctacaaaattgcagggagggccaagagttcagttatgtactctgatgttaacatattattcatgcataagaccagtggcccagcatgagttggtcggtagttgggatcttcgtcctagcctaacagactgaatttttgttttattagtgtttattccacgataatacctaattctttttatagctccaatttacttttgtaaagtttatttgacaatttatactgtttgcaaggaggactagtttttccaatacttaagttaaatacaataaaaataaattgactaaaaaaatgtatcatgcctttagttgttgcagcagtgtccacttgtcccaaattttccaaatggttacttttgttccagatgagttaaaaaaagaaaagagccatccaactgacattggtccatttttgaatagcaatatagaccatgcatagaggtcgttaccttcacagaagactcttaaactagtgattcagaatcaaagcaccaaaccatacttatttctatcacaaagatcttcagaaaaaaacttggcatttcttttttccctttgatgctttctaactcccttcaacgaggttagtcaaagatacagtaaaactgctagccattcttagcatccagcttgcacacttgttaggttgtgtaagatcaatttgtttcttgttgcagtctctccatttataaatgtggtgaattagataatcttgatcaaattgataatgattttttggtttttgagacagtcttgctctgttgctcaggctggagtgcagtggcactatcatggctcactgcagcttcaacctcctggattcaagcagtccttccacctcaaactcccaagtagctaggactataggcacggaccaccacacttggctagttttttaatttttgtagacagggtcttgccatgttgcctagggcttaagccatcttccaccttggccttcctaaatgtcgggattataggcatgagccacaacgcgcagccaatgatgacttctttggaaaggacacctatggcactatcaaggggactctagtttggtgttatagagctatgtgtcccgttcttaagtctatttgtttgcaaatatgctttgttgtttatctgtgtaaatataaattgctgcttctattaccactataaataaagcttctcttttatgattcaggaactagcaaagttctaaatcatacttacctggatctctttcaccagaagcaagtggtttaatgtaacagactccattttagcagagacagcaactaagcgctagaagacaatctgaaaagcagtggttttagaaatagtagtgggcattgtggtgggccaggagaaaccatatgggactgctctgtactgtagggagaaagaagataaagggtgatggaaatgagatgcctcaggtgggactgatcagttcctatggtttctgaggtgcattttaatgccagaggctgccagttgtataagtatatcactgacatgtagatttaggtacaggctaccttggaagaacctggggaagatatgactgtacattgctcagattgaggctcagcctgagaaattaatccgtagtgaaaggctctgtaaaagaacactcaagagagtagatttgatggtacaagaaagatggtatagaagaggacattatagcactctagagaaagacttcctcagaagtcctgctctttactaccacagactcaatgggcttacctggggaatggcatcatggaatgacagccactgagtactgtggacacactctaaacttagagtcagaatttttgtgttcaactcctgggccttcaattagtatcttgacagccttaacaacctatcttagctttcttctcccctgatttctcatctgttctctgagctctggaagttacgataggggtgaaatgagataatgtatttaaagtcacaacttatttctctatttacctatagcaccaacattcttccatgttacccctgttccaaaagcagaatgtgaatgataccaactgctgtgagtgaggttttgaaaatggcgatggccggacttcaggatcatctggggttgccatgtgcctgcacccttatgtgactcttctgagcagatagttgtataagagtatttgatctgaaggccaattctatctacatgatgaaggagggacatctgtgtttgacagttttcataggaatggacacccacatgcacgtactcacacatattctttatgtaaaatggtaggatgctaggagtgagccttacaaaggggggcacataactatcagagcttttttaaaaaagtaattcaagtaaatgccaaatacccacttaatcaaactagctgtgatgattcagaccatagggcagtgtttcagagagaattttacatccacaggttgaggagagacttttcccttgcaaaagcagtacagatcccttatgcctctcatcatgcttcccctagtgtaacatcctacataaagcacagtggctgaaaccggaaaattcagatgggtatactactactagctaatctagagactttattcaaatgttgctaattttcccactaatgtcttttttctggtctaggatcacacaattattttttattagtcccctctaatctggaaccattcttcattttttataaatctttcctgaactttacactttgaagagtactatctactgttttgtagaatgcccctcaattttggtttgcctgatgatttctgatgattgagttgaggttgtaaaatttttacaatgtgtttgtccattcccatgtactaataaagacatacccaagactgggtaatttataaaggaaagagttttaatggactcataattccacatggccggggaggccccacaatcatggcagaaggcaaaggaggagcaaagtcacatcttacatggaagcaggcaagagcatgcgcaggggaattcccctttataaaccatcagatctcatgagacttactcactgtcataggaacagtacgggaaagactcacccccatgattcaactaacttccaccggctccctcccatgacatttggggattatgggagctacaattcaagatgagatttgggtggggacacagccaaaccatatcattagaagaatgccacaaaagtgatgtcgtgcccttcttagtgtgtcctaacaagcggaacatgatggcgtgatttctactcacggtggtaacgtcgatcacccttttaaggtagggtctgttaggttttttgcgataatgttatgattttccctttgtaattaataagtatcttgtcattttgtttttaagaagattctttgctttcttaaattcatggtcagggttagggcaagtgtcactcacagagggatacaaagtgtgctgtcccaatgggaagaaatggtgccctagaaagtgatggagtcattatttaagtgtttgaatagatctctctcaatccatgctgaaatggatcgcctgacattacattgcaggattttaaagtcctacctccaggcaaatctcatagttactggcaaaaatgaaagtgtgaaatgctttttaatgtatatttaacaacacatagtctggtgattactgatgtgtattctctgtggactccctttgctatcagaggaggatgctgagagacaactttttacacatttattctgtctaaatccatcacatgtttactttttaaatatctatgactgtcatttataacaagatcataaaaagtcaaatacattaagtctaactcaaactttgaatcataggattacaaccaattttcaggaaaagtacaattaccttttatgagtgatgtttttcttactcttccttatgaaattgcctgctattaaatgatactaaaatatagccactcaaaaaaaaaagatacagtttagtaacaaggtatgaggggtagtgctactttattcatctttttgattcagaaattcacataactcctatttaaaggaattttcatcattgaatccagtgtcatgtctgcttatgttgaagaagtaaatttcacaagaagtacttaattccttcctatagtatcactatttaataaggactaaggtaccatttttttcatttatattggatttcacagcaagagttcacatcttatactaatatatgctaaatagttgcatagtatatagatcattgttgttaaaaaagcagtactgaaggcattttagatcacagagccccagtggtctacattttgtttgctttgacattattaaactcaatctgtttctctaactgtgactctaattactacatttgcatggcagaaaagtttgctttgtgggttgacttttattaacagtgcttgcatgttgttttctgctcttgctcagtgttttatgagcacacagagcaccttcagttgcattgaataattatgcacaatcaataagtttttgtgtttgtctttgttgtttctttgatgtggcctctaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacaggtcagtaaatctccattggctgctcctgctgggggtggagggtgccagttttcagtcatgttggacttcacactaaaagaaatccaacttagatgtttttggtgcactgtaaagattgtccacagtgatcatgtgataactaggctgccatgctcatgaaggattgttgcagttggtgcttgtgatgattaagcatgcagaatcatgtgccatcttacccgtaatgcacgccatttttctctgtgctctgtgtatacgtgtgtgtatgtgttttcatgcatctaggtgtgaataagttaactatgtacacggttccctgcttccccgtgaaccttcacttagaagccacagcttctgttatatatatatttatatatttatatttctgctttgccatgtggctttttaattaaatcagtatattatcttcatacacacatatttatccaatatagaaacagaaatttacggatggaaagaaccataggtccaggacatcgagacagcctgcatctccgtaggtataaccagtaatgttatcattccttacatgagtatttagtgtgtccttgaattctttaagagttgtgaaaatatcagaaggaaatgggatagatgtaattgttgatgtgggaaaatggtatggtcgtgtgggtttctttatcttaacttcataatgtctttgagcacatctctaaactatagtctaccatgcggattatgcacagaaggggaggcatgcatatactttgaggatcagcacgaatatattatgtccagccttcagatgacatcacactcttgctatgtagttgcagctctgaaacagttgggcttaagcagaagcagatggtcctaaacctacaaggttctttattaatcctcaagaaaatgcagtataaatggaatgtgtcaaggtggtcagtggcaggatagtgcggttatcctgcatttgttcagataagcttgtgagcagatcacgtacataatacaccaccagcccaactcgggtcacacagcagttagttattcccattatatcagatgcggtttttggttctacattgtcttctaaaaatattttagagaaaattttataacatggtggaaatcaatggaagaaacacattaaaattaactagaaagtttctacagagccaccaatagtaagcagtaattctagtgcttgtcaattgtgtagagttctttggcaaagtaacattaaaagtaccactgaaaagtagtgtcctgtccctggaatattcagttttgtcttcatatttggagatcaatcctttttaaaataaaagtttgaagaatatttttttcctttctactgaaataaaagggggccaatctttgaaaagcaaaatatttaagaaaaataagtaactttcttatacaacccaaaacatggtttgaggagaaaccatttttttaatgattttcccacccccatttactttgttctgtaaacatggtttatagtcacaacgttatttcagttccaagttatcattgacagtcccagaatgcatcagataagatagctatattttgaataataaaatactgtacccaacctcctccaagttgtcagtaatattcattcttttaaatttgagatagtacactactaataacgaggttaatgcattgtatttttttaaacaaaaataaaagactcatgaaaacctgcataaaatatttatggaaatggagtgtttgaagacaagccaaaatttaagcttaattgcatgaattcctgtcacagttttagttggtttgctgaaaatattgcaagtcacagcactggaataaatagctgtgagaccaaaaggctacacacccagtgtttgaagccttcatttatgtaaaattcctagaaaacgcaagcgcttgtatatttatgtcttaacacatagggaggcactgttgaggtactgcttgttggtttatctgaggaaaaacatttattgatagcaggaaaatatttcagtcttcatttttattgtaggtatcaggattttagtgagtgactagccatatatacgtttagacccgcgtctaggatgacgaggatattctaggtgggaagaagagtacagatgtgctcccagggtgttcagtcacatagaagatagcaagcttcagaagacagttgatacatttcatttggctgaaatcacagtatgcccagtctttttcattttggagctttgtcacataagataaatgaaaaagcaaattgcaaacattgtagaataaaaactttttttattctcacttgaaattttgctttttaacaatatgcaactcttttgatcttaggttagaaacacacaagttctgatactttaattttgacattatattttcttaagaaaagtgttcatcttggttgagtctatgacttgaattaatataatgttatgagtttagctacaccaaataaccagtgatgccattggggtgcctgcctcttcctgcagctcagcagagtgaactgtgaaacataattgtattcctgttttagccttttattgttattttgtcaatgaatgtcaacctgtgatttaatctcattattcacaaagcctcttggattacatctctgatctgtctcttagacttaccttctcctgtctcttcacttttactttgttagtcacgagaaccccaggaattttatctccttggtttttcccttttaatttgctgtgaagctaagacaagttttcttacctttttcttgagccaacagaccttctcaaacagaaaccctcctttgtctttaatcctgctgtcctcaggcccatttctttcctctccccagagtctcagtttcatccatccttgactccacaatgtcttccttgtgcaaataaagcattagaggggattttgagtgggggctgaagtgtgcagggctatagggtttctaggattcctgtcataaagctaacagaattgccctcttccttctgtttacgaaagcagacttcttcatgattcgaacaccttggaggagttttacacaggtctgcctgggcttctcccaaagtggttatacatgaggtagttgcatttttggtctccagataggcatgttagtaagatggaaagcagaaagatgttaaatagtgtcttttaggtttggcagttaattagcaaagatttccaggtctttgtttatggtccttctagattttataagatcaagttgaagatttttcaaaagcaagaatgctctttgtgtaaagtgacacagaggaaggggagagacacatgcaagatttgttagggctgaagattccaagcaacagtgtcaaagctattcttttctatatagttgtaaatgagtgtgtgtttaacaaattcagaagccaagaggaccattccacactgacaaagagcaagctaatacacacaaaatctgattcatctttgttactaggtagctgttagaataatttttattctgagtgatagaagtgaaatgtaaagaattttctctgtaaagaactctgatgctctaaagcaggggtccccaaccccggggctgcagactagtactggtccatggcctgttaggaaccaggctgcacagcaggaggtgagtggtgggtgggtgagcattactgcctgagctccacctcctgtcagtggtggcattagattctcacaggagtgcaaaccctattgtgaaatgtgcatgtgagggatctaggctgcgtactccttatgagaatctaatgataaatgtaacgtgcctgaatcattgaatcatcccaaaactataccccctactcacatctgtggaaaaattgtcttccatgaaagtggtccctggtgccaaaaaggttggggactgctgctctaaggtgactgctgaagtcttcaagtatatcctgatagcaaggtgtagtgttagattttgaaagtctctaaagaccctttcctccttcttgtttatcccttgatctgtctgctgctgaggtgctgttctgttaaggaacaggaggctgcccctccattatgaagtatacatatgaaatctttcctaggaagaggaaattctaaccggcctggaacctgctgtcttcatacgggagattctcttgaagagagcgtgatagtcagaattagctggtgggtgtaatttacctttcatcatttctcatactctgacttgatttttgatccccaggagctgagtggcataggtcacccattttgaagggaagcctatttataagttgcatttggtttttattcaggaagaaaaataacaaataccctctgttctgtttcctaatatttcttatcattggctcatatgttaaaatctatttatatttgtcttaatgattggcagttctaaaattccatctaaaatgaagactttgtactcagaaactagatgatctgtatagtaagaagtcattgtctctttttcatcctacatgagttttactatctttgttcctttcttcttctcagagtagtggccagtagttgtcaaggtttgtcttaaatttcatctgaaaggtaagcatatatgcttgatcttcaagttgtagaaagatgatttagccatatgaataaatttaaagaccaaattatatttgctgagggtgatttataaataaatatgaggtaaccattggtgtcaagtgtgaaccttccattcgattgctagtttgatcagtccacatctaaatgtggaaagttctgtattcctatggcggaagacatgtgtatttgatgtattaaaacctgctgatgtctccagaactaaatttgttcctttgtaggcctctgggttagcggtagctaaaaagcagaaatgtatagtattagcttgtctgattacctgacttccagccctgtacaggtgtgcaggaataaattaacatgagctacctctgatgagccactgcatacattaacgacagaggtgaagatgcgaaaacatgttacctgcctcctgttaccaccttctcagcatagcaacaaccattttttccatcattctctatgtttggaaacttatacagaactttttctagggagggcttttcagtaaatacacatgatttcaccaggcaatacctctaagaaatgagccacttagcaccaattcaagataactattagtatatttgccctaatataattagctgtcaaatacgatgtggtaatcccctccaagtaaaagaggagaacattttaaagcattagctgtttcatttcattgccaatcaaactacaagtctccatttctaaaattctcttacaacatgaagttgtgcaggtcctctgacttctaaatgttaaggaagagttttttttttttccctgctactctatttggtttcacaatagagcaagatcaatagaccttttgtacttatcttccattactttccatcagaagcaaacacacaaaatacatccccctcctgagtaattgctagttgtgccctcctcaagcaaaactttggtagtaagataaacttcagtgtcattcctgtccctggggttctttttagatactgggagaagagcaatgagcaaaacggtctccttgtatcatggggagagactctgtcaagcctaaagtgagcctcggatcttcctaatgacctcctgctggcccagctggatgcaagacaagctcgtttaagcctctgctgacctttcactcctccactacaagaactgcaccactcatttccaccgtcttcagaactgtgcaccaaatagaccacaaagcttcatggctgacgaatgatttccttttcatgatgcaaagagatttttacaaatttctattgatgagagttaacattaagtctcttgtggcattataacctctgttgcacaaatacaatgcttctatataactcttatttttaccttccttataaaggaacaatctactgttcttgccagcattatcttgaaaattcaggccaaaatatctgagcagaatgcacatactgagtgcaccggtggtatttttcatgaagagaccactttgaaagggtcttcctgatttccacctccctcagaatctatctgaccttctcacagactttattggtgtgaatctttcttatatttaaccatttatttgagatgctcatttttgtagcccatcttttctttttaaaaaacatgggctggtttctacccagaagagggtggtaagactgtacatgtacgttaacattcacttgtataactcaggtaagttccgttttgtcttagatgaaaggctgctatcaactcttttgctgtaagtgatcattcgtggttgtactaagaggaagggataccttctttgcctaaatgccatagtgaaggtttagccatgaagcattttttttctttttttaaagccttctcagaaataatgtgcttgccataagactcccacaagcttcaaataaatgaatgtggcagaattggaaagaagcttgtccttgccaaaaaattgcaatgtcataaaagagggatttggtaactttgattcttgagtgccaagatatgtgtatgagggagaggcaggcaagctaagaccgaggaagaaagaatactttttaggaaaggacaatttttcttcagttatttcacataaaactacacttttaaaatatacctagattttatgtcctaatgcaagctgcttgaattaaaacaggagttgtaaattcctggtaaaaagctgttacacctaaagtgttagtgatcctaactctagtactttatagagtttattacttcttttattaactagggggaaaaatgttacccacttctagtttaattctttttgttgcttgctctaattttgactttaccttaggaaagaaaaaaaaagacaagtgtttctaacagaatatatgtaagcgatgcctcggtattgctattgcatatatcaatctgaattattaccagccactcaaaaattgtgctaatgttctaatctaaattcatccacgtaatgtatatgtgtgtttacacataaacatccacataaataagaatatcaaaagacagatcattcttaattgccagaatagacatctacatctcggaaagtgatgtatgaagtaactttatcacattgatgggaaataagatttcgtaagtaaaacaagacccatttgggcaccaagaaccacagacctgcagctggaagccctgtaggtctgatgggcagtggaggggagccgctctaactctgctgcctttttagtctgctctgtcactgagggggcactggtgggtcagttcgctcactcgtaattgtgttttacagacttctaaagcaattggctcagtcagtcccaattcaataaaagtggagagcaagagagagagcacttttgttctattttttacttgaaattatttcattcagcagtctgtcttttttattaccaggacttgacattagcactccaagctatattagcatccatttcagcagttcagtaatggtattaaaaaaacacttaacttcaatggtgaatggttgtatgacagtaccataaaaaatccacattaaaaaaaacttatgtatttgtcccagcaaattatttttcacttgtttaaccacttcaaaactatattctcatgacgggtgttcacgaggactttcttgttctcagcaacagctgacagtggtgctcggttgattagggaactgaggaaagaggaaagggaaatccagtgaagagagggtaggtaaagatgctgtttaccctgtagttagattaccttccattcatcagcagagatggaattggcaacctcagagcacccaaggtgaaattcttggatcctcatgcgtgactgggatttgattttgaacccaacactctccaaacttgggagcaaagcctaactactttggcactgcaatgtgctcataaatgactacattagtttctaaattttgattaaacattcagtaattaatcaatggtagacacgaagcagttggcaaggtccagagctgcaaaatgtttaagacataaaacattacgaagtaattagaatatgctccttcaagagaaggattgccttcaataaagaggtaaatgatagtatcctgtttattgtggacgtaggcagccaaagcaatatgataaactgctggaaacacacatatcagtaatcatccacattattagtgccattaatcataattccaaaaatatgacagcagcagccaactttttgaccaattttgcttctgcctgttggccattataacttcactaatagactgcagagctcctatgcgtggcagtttgcattgagaatggaaggttaattatatttgagctgctgatttcttctctccttggaaaaggcttagcactttgacaatcccaagggctcactgttgttaaatcagtaaaagtactttattgaaattttctttgttggtcaggaatgagatgtttcaaatgagatataagcaccaggctggaacagttgctaatgcttcttgcttcaaagtgatccttgggcagcaagatgaactcagtggtttctttagatcactttgctctctcatttctcgggtaaaaagttcagtgctatatggtgatacaccaggaaatcccacaagattagtggtagtctcaacatgtatctgtatgactgggatgttgggagtggttaataacatcagagggaataagtacttctttaatacaaaatcctgcatttcagactctgcctgtgcaaataaaaagtaaaaagaacttcacaaaaatcatccgtttctaaatattaaaacatttagtagcatgcatgcattgctggttggttaaatgaagttttcatgttttggctggtagttttgacatttaatcaaagttgtaaattagattatgctcactctttttgttcaggtgtctttattagtttcattttcaacacagaattctagataaagccatagctaaatactaatattgattgtcctacaaaatagtgtcacctcccttggggaactcatgcatcctgactgttaccttttaagaagatcataaattaaccattttaggctgggtgtggtggctcacacctgtaattccagcactttgggaggctgaggcaggcagattgctggaggccaggagttcaagaccagcctggccaacatagcaaaaacccatctatactgacaaaaaaaaaaaaaaaagctgggcatggtggcacatgcctgtaaaaattagctcctattattttggaaatatatcttctaaaatctttataaagtaaggctatataaaacaaggaatggaaagcttgagggttaatttgtccagtgtaaatataaaactcaaagctcagatttattctcagtaagtccttaaaagatgccagggctcatggctttgctttttcttacccaacaatagtagtaaactgagcaccatatgagctgcttgattgagaacacttccaaatgctgtgaaaacataatcctgttcacagtgtaacactcatctcacattacagcgcaacaggtacctattgaataatcagcacccttgagaagcctcgatgtctcagatacaactcaaaagtaaaatggttagggaatggggctgctggatatcaattctacacttaacctgtgcatccagctacacattttccatctaccaatctgccttcccaaatgccatcactacattaacattttttatgcattccacagcaatgacaaattgttttctaactgtagggccagatttagtatgcgaaagacatgtttgcctctgccaacaaaccaataattctcactaacgtcttcagagttacaacatttataaagttgcaaagtggagtaaacaaaccatctgtttggcttttccatatatgtcatgctttcttattagcatattacgattcatttagtaaacaaatttggtgatttcgttcacgtcaaagttagatcggaagcttgaagatgattaacattcctgggacaagcacattaatacattgcttcccctgcaaagttaaatggcttctcaggagaatcgccccttgttgacaagatgagactgtcaattttgtctgcctgccacattaggggccatacggggatggcaggctctgagagaggggagtcgtgtaggcagcataattcactgtgaattgagaaaagaagtctaattctgataaatggtcgaccccaatacatcctacctgttattacaacagacgtgccgtatctgtgcagtaaattagctaaacccctaaagagtttggtaggagcttatcttcaagtgaataatttgaatgtagaggaaactgtctgcgtgactagtatggatgatttgttttatattgaaaggggttgaaatgactgagtttcatacttttaatttgcaagaatttgcttagattttgtttcttgcatttaatatgtacttccttacatttggggctttttgagtgttacccactagaatttcacattgaattttcttcctgagctaggggatggttttcagatcttttggacagaatctttaaataataacctgtagaacaactactaattttacagaaaggtatagtgtcaaaagtatcattttgtgcacagagccataagcatcctatcgttaataaatgataatacaaaaatgttgaggtaagtgtaatagatagtgttgtagcaatccagataagaaaaggactaatgaaggcagaagttttaatttttcatttctgtggattttgatagcaggtttacatttctactcaaaagtattgttgactcagtagtcttacaatgtacttaaccctagcatctagacttacccagattggatataaatttatctctctctctcccattctccccatatacatatatgtacacacatacatacagacaaataggcatgcatatggtatgtatatgttattgttacgctatgtatatgttgttatgatcattctgtacaatatcatttgagaatttgtgaatgtgtgtgttgaacggcagagttgagctggaaaataaaggcaaaaactaatccaaagtggggcctcagttatttttcccttgaggcattctaattaattattaagtattttgtttcaattcaccaagttcagaatgtctcaaatctgattaagaattaagacacttcatgcaacctatagcttggttcattattcagtctctgactgccacagtcttactttctaatttggtcatgcaacttgttttttttttttttctttttcgtgtctccccgatatcttaaagccaagtttaaaacctcaaaacactttctttagatagtgtttttgtttttagttttatgggccagacatcacattaaatctaacttaatgtgatgagaaaagagaagtccaaggcaagacttgctttctctctaaagggcatttgcacttacttgactacgtttgatggatttcatgtcttctgtggttgcatggtaaagttttcatcaaaggaacagaaaaagactggtagtccactttagtccagttagagtacttccactcagcatttcaaagaagaaggaagtttggttctgcagcaccctcccctcagtccaaggttttgtaactttttgcttttaagggtgatattggtctttaacaagcttttggtagattcacagtatagaaagagtacagaggtttaaaggaagcatttgtagttccaagcatagcccaagttacagggctttttcaagccctaattttgtggcattcccttataacatactatggtattaatagcgtcaggatcaccgtttgttttgtcgccaccacctttccttggatattctgttacatgagtcctaccttgggatcattgctttcttcccttctacagtgtattttgggaaatactttttgaagactcatgcatattattgatggaagggaaaccaatgtacttttaagtacctcctctgtgcaaagtattctactttacgtgcaggacacataagattgagtaagatttagttatgttcttgaaagtgaacgtctggggctaaggtttggaccactgccttaatgattaccactgcacttcttaagaccaagtccttaccccttatacctatgaactcattttctctctgcattccagtcactttttttctgtaagaggaacttccttccatatatctttcttgccttccaaatcaaagcaagtagaaacaacctttctactgttcatgttcttatagaatgtaagaagttctaatacagtcttagatatttgttattgagtattcttccctctttcctagagataaatattcagaacactaaatctgtttctagaaaaaccatctctgtcgctggagagctcaaaattggttccttgttggattctttgttccaattgttacatacaactgagtagggcttcctctgccagggagtccccctcctgtttccagcactctctggccttcctgccattttagggtcttctctcgacatctgattatcagtaggtgagagttctttctgtgtctctcccaacttctcttttcacctcttcagttttgctgatccggataaacttgtaatagtcctcaaattgctattaaccctaggtctttgtgtctcatgaggacagtattttatgacagctaatggtctggattgactgattcaagagtccaacaataggtctttgttaaaatcaagtgctgtcttttgtcccttctttggagactgaaccgtaacctcttgggtaggatcggtaccctctaaagaattttagtctgctttccttctcgtgctttccttccttccaccttaggaatactgtgtgagtttgtgagaaaatcttcaagcccactatcatgagagtgaacagcagactttcctcagtccatccttcccatctccacttcaagtgttttgcatatggcatttaggaggattattaaacaaaaatgaaatagattaggaattgaacgtaaaagaatcaattctcttgaactgtggttgcataatggaaatcgactaccatgaatgaacccgtgtactgaagttatgaagagcagagctaatgcactgccatgagttcatctttattattgcattacacctgaatcaattgataaagtagctgttttttttaaagtgagggatggcacttaattgaataaaagtcaatgtaattatattagcagaggccaacagtactgctgacagcggaaaagggacactgttgaacagagtgccagagctggtctacacatttctgcacatcgtttggttgacagatattgagggctggtacatcgtctaattagattacagatttctactgctgtaagtgagaaatgaagagaaaatctctttctggtaacatattggtggagatgtgtaatttcacaagtcatcttagggaagatgtgtccatctgggtgatcagtgtgtccttttctcaatgttaatttattcttccttattcagtgtgtcttgatgcaactgctgtgtgtctggctgctgttttctcagcagtgaacctaggaagtggtaactgcagatgtgtgagaagcaacagagttctagattacagtcatcgcaaaatgtgtgctcgtgaaattaagaaagggggagggtgttaaaaataataaacgggtaggatttcatgagctgctcatagttggcagatagttttatcaatagaataatagcgcatagcgtaactctacttccacattcttgtaataactggtggtgttgtacccacatgtcagagtaaagacctcacagtaggcatttcctgcactttgcttagcaacctgcacttggagtcatctgccatctgacaccaaggaaacggggaattactgtgtcagagcagggaccgtggggacaacttctgtttatcattcacatacccacacactgcatgcatctgtttagaactcatttgtggatgatgatgctgtgaatttggtttgtgttaattcgatttatgatttttggattatacagctgatctgaaaatcatcaagacagcgtatgggatgatcgcttatgacagaaaataattttgtgatcagaacgttttaaatccctattttattgtttaagtttttcaaaaccagatgtctagaatgtgaatttgttttctctctctctctttctctttctttctctctctctgtctcttattcttgctttcttttgtgatcgatttagcaaaagattagaaagctgatcttattgtcacaaggtaagctcagccttcctaagtgcagttggagagggctgctgccctctgccccttaaaacccagagtgctgtatattgtcttgtgtggaaaggtggagaagtcttccccacctttcttgtctctgaggcacatacctctcaaccatctctaggaaatatcacccacgtttgtcaccaaatggaatgacacattttggtcttccatacttttaagtataatcgggaggtctgttgaactttatatcagccatttaggtcatttcttttatcacaattacttctccaagctgtagagcttccaccagtattgagaagcttttatgtatctgtagatatgtcagtttattttttggaagggtaaccttcaatttaggtactgttgaacatgtgagcctttgcaggtggagagaggtatgtgcccaagggcactttaaaaataatgggggatataaatacaaagacaatgtttccagatagatgataacatatcaggctttgtaaatcatgatgtccctatggattctctgggacaaatcctgtctttatatatatatatgtaaaaaaatatgtatatgtgtatgtatatacatacatacatacaagcaaagcactgagtgagtagaataaaagttttgcttgtcgaagaagtatgggttccagttgttaaagtaaaggaaccctatgttattgttgtgcttgatttttttgtacttactgtgttttaatttttgtacctctgagttttctttctgttgttcagtgtgattttttttaaaaaggtgggtgggttttatttttttaaaaagtttctgtttttccgtttttgtcttaaagaattaaattttaaagtagaactactcgatgaaaatattttggacactaaaatgcacatacttctaaaaagtaaatgtattttattattagatttaactgggattcccaaatcattctgagaaaaggcattcgtgttgttaaaagacagtctgtaaccctatttcaaattgcttaatctgttaagctattgtttttccttaaaacttgaaatgtggagggtagagacggaagatttcattattttttgaagttatatctaaattatctaggctacttttttaaaaaatgaattttttctatacctcaaaataaagtgtgtgctgtatagaaaagatgtttactttttcttgtttttaggtaaatttagactattccatttagacaagcagaaagtttctattcttttatcctatttaatatatattctaaaatctctgccatgaaattctctgcagctgatgctgctacatagtaaaactaacagagtaatcattgagaaaaaggtgcacgggtttgcattcatcctaccattgacagagtcaactctcttataaaaataatgttaatggaaagttcccctgattgcacctctcaccaccaccactaactcccagatcctgaggatataggggaatgcttgcttttataatggtgtaattagaagtgaatgtgcttatttgatacctagtgaaagctgaatcaattttaaaatgctttcctttttctcacctttccccaccccccatccacgtacccccccttccctcttgttttcctagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaagaaaaaaacatggtcttgtttttactacctgttagatatagtgctaaagaggtgctggcatgctttacagcacagatctgattttttaaaatgtcctgtactagtacataaatcccgtcatgcactttttttcatacactacaaggggatgtgtaataaccatgcttcttttttatccttaaactattgccatacttcagtaagtgtcttttttaaaaaaaattcacttgtataaaaatggtctggtcagtatagggcacaaatgccaaacaaagtattagtgttaacacaaaactgccaactttgcacaagtttccagaaaagaaaatacaattagtcactcaacataaccacaggccaatttgttggccaccagaaaaccgctttttaaaaaaacacttggtgattctttcaagtgccgaatgttattagaatcaacattgcatccttcttgcttatacgttaagttacataaaaggaaaacaaaattatgtggtgtgaaacagccaaggcatttattcttcagaggcaggataatatttcaggatacaaaagcccaaattacccgctacggaacaaagatgaatacagtaaaagagtcgaacactcatttccaaggccctaacccttatcctttaaaaagaaatcctctgaactgggtcggtctgttgtatggctgtctaatttgttgcaaattctgcagtcgtactataattcaggcctgtttggtagacaaaatcaaaaggcatttaacagcagcagtacttggaagctttgaaaacatgtgctaaacttgaatggagcaacactcctttctgaaaagccagaagaagggggttttaaagcaggatctctcaatgttcagtgttttgtgtttccccacacgatttgtcagagagaaatgaaagcaagcctgaaaccaagcaattgagagtgagaaagaggagagagactattctccaaaccttttttgttttgttttgtttccgatgtttacacatgttgcctgagctggttaaccacatcggcagcctcagctaccacaacatactgactaaatgatgatatttactcaagttcagtctgcagccaaaaccattagggtgtgcattgcagactgttttgttgtcttttttttttcttttttcctttttttttaagtggaggggaaaagaagagataaacaaggaatattttgtcaaacagtacacaataatttaaagagaatgtatttcttttttgcatttaatggcctcagacatttctttcatcagtctaaaagttagaaatatccctttattttaacttttatgtcgtttccatttttcatgtttttgtaattattttttctatgttcacatcagcattcacttccgttaaatttgccaaaggaaactgttaatatgtttctgttgttattattcctgtaggatttattgtacctcacagtatttattgtttcccaaaataagcatcattagttggggattcagtatttttgttgtgaaaatttcagaaacaatagattcttaaagataagctagctatgtctaggagctttatcttttcacctccttcagaggatgctatggggtccattttaattcttcatttgttctacggggaggaaagaccaaaagtatttgcagtacaaaagaaactatatcaaacactatgttaaatgacaagtgtttatggtaaaaagctgaggaattagtaataatcgtttttgttttcttgtactttgaattccccaaagtcttaattgctttattttggtgttgtgttaaattgaacagacagatgttttcctttgttttataccatataagactctgtacagtatgtttgtgaaagattgaactagaataatgaaagtttgtttgcaaaca

SEQ ID NO: 38598 - DNA, 19563 bp, Homo sapiens
gacacgagcggcgggagggaggcggtggcgcgcccggccccgcccgcccgaccaagcgtcggacgcggcccggcgccgagccatggtgagtccagcgtcgcagccccctgggtcccctcggccttcgcgcagcccgctccgggcccccaagtcctcagcctggtgcctcccgagcctgcctcggactgttcggcccctctgggactctcctccctcccatccccccttcttcgatttgtctgtctgcccgactgtttagctctgtccccaccgggtattgccctcaccctttcttcctcctctcctccgcctcctcccccatcctcccttgggtctctcccctaatccacacacctccccgctccccgccctcctctgtcctgacctgtgccttcctttcctggagcttccctccccctcctggtccgagctccttacccgcgggagacccctgcgggttggtcctgcagcgaccctggaagaggcccggcccctcgggtcatgagaactgacctgcatggaaccaccattttccatccctgtccccaacccggtgaggcaggcccacccatccggccctaggggactggccacagctgtggctgggccgggtcccggggcatggccaaagagggaaattcccgcagagaaaaagagctgcctcaggatagttgggggtgcttgggggggagctcacagtaccagggggcgtgacactgccagagccgaccagagtttgcggaggaggaaagtgccccagagctcttgctgcagggaactgaagggctgcctcagggcactcctgctacagaggggagggaacacgagccggagctccctgcagggactaggggaccctggcagcagcaacttggggcgctggacgctggagggtacgctaaggagaagcccacaccaacaggagtgaacactgccctgggaactttcactgcagagtactctgaagcaccgctgcgagagtgggcactgccagagagagcgcccactgcaaagagggcgggggcatggccaaggggccgctcgctgcagagtggaggagggggagaggccttgccagggggagctcaccgcagggagtggaggaggggcaggggcactactggggccgcccctctacggagggaagggcaccctctggcagggaggctggaggaaaaagaaagaggaactgggccagggagagctgactcagtctctctggtctcctctctggtccccgccggcaggaggctgggtctccgtgctcccgcccgccgcctccctccccagacccctcctcccctcctgccgcggccgtttcctgtggctgagactctcgctcagccatgagctcaccgcccctaatgggttgcagctgcctcgctgctcaagccctagctccgcactccctgccttggagcagacggccccactctgcctcacccccgcccatctccaccttccccccacccacgcgcactgcgtccgcctggtcccgggaacactgggggtctgtctgctcgcccacacaccttggggccgggtctgcgcgctgacgcactgaatgtcccgtctctggagtggttgccctaacttcccagacggtcaagacaaacgggcaactctggatggagctcagagaaaaataagctattttgttttatggcaaaggcaaggtatgggggtagggaaggtagagaccaaggtaaaggctgcattgagtatccccttccccatttacagcaaaaaagaaaaaaaaattccagtaaaagggacttcaaagactgtcttgaaaaagaagtttgcaaaggaatagcccaaggggtggttgtttaggttaggagttggagaaagacgtctcattgactcacttagggaggggagtctggatgaagcagggctgagtctttttgagactcctagtggaggttggcagagagaggtcccactggaatcagaaaagatcagctcgaatgcgcaccatcaaggcctcctcctcccttcccacaagttcctcttgtgacttttttctctttcaactgcccccacccgattctttgtaatccaatcccacatgctctaagattgggtgattgcttcagagccactgtgggagaaggaagagggatgctagaaagacccaagacagtcacagacagtctttccatcctcctctttccaccaaatgaccatctctagcatataaatgagcatctctctttcaccaaatgatcatctctgggacataattgtgggtgatggcacctccacctaagatggggagccctggatggtgggtcttatgggaagggatttgcaggatggctgtgtggaaatctccctcatcccctcgagttctcagccataagctcagtcccctgatagcccagaagcctgtcttttctctcctgggaaagatctatgcaatcaccccaactcacgagcacccggaacagccctgatcaggggcattcacaacaaattctccctggatctccaaagccaaggtctcagagcgggagtgttgagcgccctgccaggtttgtgcactctggcccagccccactcctgttctgggctcatcagccagcatttcctgagtgctcactttttgcccacattgtacaatcggggctttggagaacacagccaaccccagaccagtgcagctcccaaggagccatgattgggtgatctctagggatctgtagcctggtcctatctctacaggagcctgagccagtggaggactgtgtgcagagcactctcgccgccctgtatccaccctttgaggcaacagcccccaccctgttgggccaggtgttccaggtggtggagaggacttatcgggaggacgcactgaggtacacgctggacttcctggtaccagccaagcacctgcttgccaaggtccagcaggaagcctgtgtgagtggccgtgcatcactattctgccttccccaagatccactgccacactctacagactagccaggctgactaatgcccccactaacctagagatacagcctcccttgaaaccgatctctccagaatcacttaagcttcattctctgacctctcacaaactttgaccttcacaggcactgaccattcagatgctaacacacacacacacacacacattcatcttccccaaattcatcttgaccccaatactgacccccaaagaccctaactctccagacccaattccagacatcttctccccctcatatgaatttctcaagacactaactcccccgtacattagtcaacagagatcattcatttctacagatataaagactcctaagagtctttagcttctccaagacaatggcatctgctgaccatgtcttggtaacgattcagttcttaccctcccacacatggaactagcttcctgaagaatcttcctactactgggagaccgatcagtcccaatcccttcctctctgccacctgaataccccaaatctcccctcctgctctcctgagagtataaccttccaggcataaggctggtcctgcctagggtgggcccattctaactgccctctcctgctggtttcttcagcagaggcctgagtgcagcctcccacctctctccccaggcccaatacagtggattcctcttcttccatgaggggtggccgctctgcctgcatgaacaggtggtggtgcagctagcagccctaccctggcaactgctgcgcccaggagacttctatctgcaggtggtgccctcagctgcccaagcaccccgactagcactcaagtgtctggcccctgggggtgggcgggtgcaggaggttcctgtgcccaatgaggcttgtgcctacctattcacacctgagtggctacaaggcatcaacaaggaccggccaacaggtcgcctcagtacctgcctactgtctgcgccctctgggattcagcggctgccctgggctgagctcatctgtccacgatttgtgcacaaagagggcctcatggttggacatcagccaagtacactgcccccagaactgccctctggacctccagggcttcccagccctccacttcctgaggaggcgctgggtacccggagtcctggggatgggcacaatgcccctgtggaaggacctgagggcgagtatgtggagctgttagaggtgacgctgcccgtgagggggagcccaacagatgctgaaggctccccaggcctctccagagtccggacggtacccacccgcaagggcgctggagggaagggccgccaccggagacaccgggcgtggatgcaccagaagggcctggggcctcggggccaggatggagcacgcccacccggcgaggggagcagcaccggagcctcccctgagtctcccccaggagctgaggctgtcccagaggcagcagtcttggaggtgtctgagcccccagcagaggctgtgggagaagcctccggatcttgccccctgaggccaggggagcttagaggaggaggaggaggaggccagggggctgaaggaccacctggtacccctcggagaacaggcaaaggaaacagaagaaagaagcgagctgcaggtcgaggggctcttagccgaggaggggacagtgccccactgagccctggggacaaggaagatgccagccaccaagaagcccttggcaatctgccctcaccaagtgagcacaagcttccagaatgccacctggttaaggaggaatatgaaggctcagggaagccagaatctgagccaaaagagctcaaaacagcaggcgagaaagagcctcagctctctgaagcctgtgggcctacagaagagggggccggagagagagagctggaggggccaggcctgctgtgtatggcaggtgagatgacacggagtgaggctcatggggcaagggccaaagcaggtcgggcctatgggagggggcaggaggaggagcagggttaggctgggagcagaacaaccagaaccatcttaacttcagtcccatgtttctgtctgtgtctgtgcaggacacacaggcccagaaggccccctgtctgacactccaacacctccgctggagactgtgcaggaaggaaaaggggacaacattccagaagaggcccttgcagtctccgtctctgatcaccctgatgtagcttgggacttgatggcatctggattcctcatcctgacgggtcagtgggcatcagtgggtgaagggaaacaggactgggaaagagaagcaattgggtgggcttggggactgggggaggcagggtggaaaggaggtaggcatggactgctcccagccaggacagcctggccattttgtgtcttcaggaggggtggaccagagtgggcgagctctgctgaccattaccccaccgtgccctcctgaggagcccccaccctcccgagacacgctgaacacaactcttcattacctccactcactgctcaggtaaccgaggcccagtcctggcaccctggacactaacctcctgattcatgaggaccctcacctccttcttctcaggacactgaccttctgacctctaaggacacctacttcttcaaccttcagacttcaagccattgacctttggccttacttaccctgacctccagcttcatatcttcactgatcttcaaaagcaacactgttgactttcactctcttccaaccctaccaagatcatcaggacattggttcactgattcaacaaacatttattgagcactgagtacctattaggcaccatactacaggctgatattgaatgcacgccatttcagaacagaattcttaattttccagaccttaatcccttgacctagtagccatatgaatatagacccctgactgctaggtgacttcctcttgtacacacaccccagaatttggccctttgcccatttcttcccaaatgtaccggcaactaatttctcctcaggactattaactaaaaacagaccccgtatgtctgccttgccttatctgctatcccccaaaacacacacacagcagcctccttggctcttcctgctcccgcaggcctgatctacagacactggggctgtccgtcctgctggaccttcgtcaggcacctccactgcctccagcactcattcctgccttgagccaacttcaggtaaccacccctcaaacaggcagttcccctggatcctaactcttcaccagtggccagtccaggacacccgattgcccagtttagggttattcttttctgcccttaggactcaggagatcctccccttgttcagcggctgctgattctcattcatgatgaccttccaactgaactctgtggatttcaggtttgagcccttcattcccatctagtttcccatcagtagtggggagaggagaagaggctggctggagccccaggctggtttctgagtccttgggtgcccaggaagaaaccccctgccttaccctctacagggtgctgaggtgctgtcagagaatgatctgaaaagagtggccaagccagaggagctgcagtgggagttaggaggtcacagggacccctctcccagtcactgggtagagatacaccaggtaagcttcccctctaccacctagcatgctgggagccaggaataacccagctgaagacattctaggagagaggccatgtccaggacataccatgaggttgcaaaaaagtggtttccattccattcaattcaacaagtatttatggctcccaaatcatgaggaaaacatgtgcactgtgccatgttctactggggagataggaggagtatgataaattattataattattatttttagacagtctcactctgtcacccaggctggagtgcaatgcttcgatcacagcttactgcagcctcgaccctctggactcaggcgatcctcccatgtcaacctcttgagtagctgtggctacaggcatgtgccaccacacccacctagtttttgtattttttttttttttttttttgtagagacggggttttgccatgttgcccaggctggtctcaaactcctggactccagtgatccacccgtctcagcctcccgaagtgctaagattacaggcatgagtgactatgcccagccaaataaattcttaatatgacattaagtagtgtatgatttttggtgggagataaatcatgaaacaagtagagaagagtgcaagatagtgtcattgggtttctggaaagcactgagagtcaaaaggctggttcttgttccaaattactttacctcacttgcagaaatagtgccctttctgtatccgctccttgcaccaacatccaggcctcaggatcctcatcagcgcagtataacaatcacaatataattgctaaaggtccttccagcacttatctcatgtaattctatgaatataagtgttgtgagtattcaagaagagagaaataaacatgatctgagctgagtatgaaagaggggtctgtagatggtctctaagcttcgcctttagtgtcaaaggggaaattgacatgaataggcagagagagggggtgtgacagggggaagccccactgaagacagacaggaaggtcacagttaccaagctgtacaatgtgccaggcccacgttagttgctaaactggcatcatctccttaaaaatcacagaagcctttcttatcctgactttacagttgaggaactgaagttcaggaaggtttctgaacctgcccaacctcatacaattagttagcaacaaagtcaggaactgaattcagcattgcctccataaaagtctctggggctaccgcaccccaaccctagggcttaagttccttcttaaactctgatcctcaactccatccctgcatgtgggtttcaggaagtggtaaggctatgtcgcctgtgccaaggtgtgctgggctcggtacggcaggccattgaggagctggagggagcagcagagccagaggaagaggtatgaaatgagatgggacagtggggggatgggattgggatggggctggggtggagactctctggtggaaccccaactggcaactcctccctatccccaggaggcagtgggaatgcccaagccactgcagaaggtgctggcagatccccggctgacggcactgcagagggatgggggggccatcctgatgaggctgcgctccactcccagcagcaagtacgaagtatgggtgtgcggaggcaggtggaagtgggaggtggagacacagctgaaggctgccaacaaaccttagctgccagaccattcttactgtgcatgtatctgggcaagatactatgcttttacacttactgtctcataaccctcacaacatccttatgtgccatttactattacaaatgaggatttggaggatcagaaatgttaactgtcttggccaacatcggtcagtaaagagtcaggattcaaaccaaagcagtcagggttcagcccatgcttttgatccatgctgctatgcaacctctcatgtttgcatccctcagaggcacggaaggacagaattgaggggctcaacaagggaaatgattcattcttctctgctccttcccaaggctggagggccaaggcccagctacactgtatcaggaagtggacgaggccattcaccagcttgtgcgcctctccaacctgcacgtgcagcagcaagagcagcggcagtgcctgcggcgactccagcaggtgagccaggatccccacgtccctcttactcagcctgggagtgtggcctccagcacctttcccgttggtacttatagttgatggtgttcttctagcctggcttggttgaacgcccctccctcctcctcacatttgttggtcagtgtgagattgaacaagagggtgggagcatcatagcaccagtaaagaaaagccagatcttcccctccccactgtttacacttgatcgaaaatgctgagagattgtgagagatgctcagctgccctaggggattctgaagagctgatcaactctggagtgcctaccaccttagctgaaaaataataaaagtctattgataccagctcattagttatactgccacacacacacccttaactccttatgcgatgtcatccctcagacctgaggccggaaaggtcccacctccctctcccttggaaggagagagcattgaaagcacctaagaggaactacaggcttctttgtggggaagattcaggaataaggctggcttctctgaaccttgattcttctctcctggggttaagagccccatagggatttgctctccaccctaccatgtggggtagagggggctttgaaatctgattgttcctccttagccccgagcatggtgaatggacacttcatggacctgtacgtgggcatcaggggaaaggtcacctcagggccggtgcaaaagcgggggccaagactttctgtttcctaggatttcttcatattggcttcctctaagccaatatcctagagatgggttgcatctcctcctgtttgcttacctgcttgttagctgtttccccaactgtttaaaaacaagatttggagtctaacgtgctcagcttgagttctagttctgccatgtgtaagatgttggacaagtcatgaagctcctctgagttcccaagtcctcatctatagaatgcggatggtaacaattaactcacaacgtggtcagaaagatcaagtgaattcagcaaaggactataaaagtggttattgttggcactggctattaggaacagtctcagacttctcatcctcaggctgtcccacccccagcttccagcctttcttcagaggaaaatattaccatcccgttctggtcaaacatctcagaaccagcatgagagttcatatagcctcatattaggaaattaaagccggacacacacacacacacacacacacacacacacacacacacacacacacaccccttctgtactgtttctccaggcttggtccctgggaccgtttctcaccagttgccaaggcttggtgaaggccgtcagtcatccctatgaccctcatcctgcttttggttcaccccagtttgatgtacttcaccctcggacatagccctggaactttgacccactccctcagtgcttcccatcagcccagcttccctctcatctgccttaccaaagatttcttactcggtttctcatctgacccttgtggaaactattaccattcactgttgtcattcccacattgcagatgagatgcaatagttcactcaaagttctatagattggggtggtggggctgatgctggatctcagcccttccttgcctttccactccatgaccccctgccctcccaccccatctgcctcaggtgttgcagtggctctcgggcccaggggaggagcagctggcaagctttgctatgcctggggacaccttgtctgccctgcaggagacagagctgcgattccgtgctttcagcgctgaggtccaggtgagaaggggctggagggcaggtgagaggaggcagggggagactacctaggagtgaggaccaggtctgagcgcagcctcccttctccaggagcgcctggcccaggcacgggaggccctggctctggaggagaatgccacctcccagaaggtgctggatatctttgaacagcggctggagcaggttgagagtggcctccatcgggccctgcggctacagcgcttcttccagcaggtgcatgcagagccttttccttctgtgcccccccatttccatttattcacttcctttctgcctggagaggctaatcaagttgttaaaagtggaggctgaggggcccatctcctaggtttttgctcttagctctgccacctccttgctgaatggcatggggcaagatactaaacctgactgtgcctccatagatctacctcacagggctgctgtggggattacacgaggcaatacataaaagcccttagcacagagcctgccactcataaatgtcgtatgagtaccggttattcttttatataggctcttccatctccataccaactccgagtgacatggttaggcagtgatggtggaacagtgagaaaacaggagagtgacgggcattgggaggccacaggcaagaggacaagggctgtcactgggcatccttcgtgagcaacacaggcccttaccctttctctcccatccccaacccctttgacttcgtaggcacatgaatgggtggatgagggctttgctcggctggcaggagctgggccgggtcgggaggctgtgctggctgcactggccctgcggcgggccccagagcccagtgccggcaccttccaggagatgcgggccctggccctggacctgggcagcccagcagccctgcgagaatggggccgctgccaggcccgctgccaagagctagagaggaggatccagcaacacgtgggagaggaggcgagcccacggggctaccgacgacggcgggcagacggtgccagcagtggaggggcccagtgggggccccgcagcccctcgcccagcctcagctccttgctgctccccagcagccctgggccacggccagccccatcccattgctccctggccccatgtggagaggactatgaggaagagggccctgagctggctccagaagcagagggcaggcccccaagagctgtgctgatccgaggcctggaggtcaccagcactgaggtggtagacaggacgtgctcaccacgggaacacgtgctgctgggccgggctagggggccagacggaccctggggagtaggcaccccccggatggagcgcaagcgaagcatcaggtgagatcccagcccaactggtgctaagaggcggagccaactgcccagtaggaaaagaagatgacattgttgggggtactggctccctcccacacctcctctgccactcctattgtgcctgcagtgcccagcagcggctggtgtctgagctgattgcctgtgaacaagattacgtggccaccttgagtgagccagtgccaccccctgggcctgagctgacgcctgaacttcggggcacctgggctgctgccctgagtgcccgggaaaggcttcgcagcttccaccggacacactttctgcgggagcttcagggctgcgccacccaccccctacgcattggggcctgcttccttcgccacgtgagtgatcccctcaacttcttccaagtgctctcccttctctgttccagcctcatccatctgtccctctttctcagtacccacggccctctcctcccatgtgtggtccatgaccttggggcccagccctgttctgtgggcacttctgcctctactcagcctctgcgccctgctctcaagagctgcctggactatgctctctccacagggagcccttccctccctggtaggctgagtgctccctggtgacccatccctcatttgggctacagagaggatagagagggggaagagagaggcttgtctgcagcggcctcaccggggactccttatctgttctttactggcacagggggaccagttcagcctttatgcacagtacgtgaagcaccgacacaaactggagaatggtctggctgcgctcagtcccttaagcaaggtaactttttctccaaccttcaggagaaaagtagagaggccagaaagacctaaaaacccacccaacaaatccctcagggcaaaaaactggatatgcccaggaacatcacctaccaatcatctcctagaattgccgagggtgggacaagcaccggactggtgaggccaggttcttatccagtccacctgagggactgggcaggactcctgtttcctctgggcctctatttccacagctggtaaatgggggcaatagtcactatagccagctcacagggaggatctaagcatcagaagagctcacatcaaaagacgtacaagtgactaaaagttcaaaggcagtggccgggcgcggtgactcacacctgtaatcccagcactttgggaggccgaggcgggtggatcacgaggtcaggagattgagactatctggccaatatagtgaaaccccatctctactagaaatacaaaaaaaaaaaaaaaattagccaggcgtggtggcgggcacctgtagtcccagctactcgggaggctgaggcagaagaatggcgtgaacctgggaggcggagcttgcagtgagccgagattgtgccactgcactccagcctgggcgacagagcaagactccatctcaggggaaaagaagaaaagaaaagaaaagttcaaagccagaaagtaaaggggattactattttgattcttcttccatttcccttcaagatatagacagtgattgctggcctgcaggcccccacctgctttctttccagggagaatggttttgccttactttagggagcatctgggcttcatctatacccaaaagcctagggtatcacccacctaccccccaacccctgagcttggcccccagaggctccacccctcccctcatccctgtctgtgtcctcaacctagggctccatggaggctggcccttacctgccccgagccctgcagcagcctctggaacagctgactcggtatgggcggctcctggaggagctcctgagggaagctgggcctgagctcagttctgagtgccgggcccttggggctgctgtacagctgctccgggaacaagaggcccgtggcagagacctgctggccgtggaggcggtgcgtggctgtgaggtgaggccctagctccagtcactgctgctcaaactgcccagccctggcctcagaagccgtgtaggttggtgacaggagaaccaggctccaggtcagagggctccaggctctaatttctaaccagctgggtggccttgattgagtcactgaacttcactggacttcactttcctcatttgtaaataaagaagctatgtcctcccaacatcccatgttcgtacatctgccttgtactctcctgttcctttcctaattgttatctttccccatctaccccatacttcctcctgcacctcaacacccaacacataccttgtctcgtctacctagtctttttccagccctgaggttccagaacatgttggaatcctgtatcctcctctggaatagacctatttccctttcagttctttgctgattctcttcctggatccccagcatgcaaaggcttccccacaggtggctataaaccctactatgcagagcaccttgccgtcttcagaggcagggctgtgctgctcagctgggtgcactgtgcatggtgaccagttgatggaccctaggctgagggcttccctgacttcctgactctacctgagaaccagtgcattaggccacttgccctataaatctatttttgctccctgtaaaatacaaacaaagggcccctgggccaaccacttttccttttcctttctccagatagatctgaaggagcagggacagctcttgcatcgagaccccttcactgtcatctgtggccgaaagaagtgccttcgccatgtctttctcttcgagcatctcctcctgttcagcaagctcaagggccctgaaggggggtcagagatgtttgtttacaagcaggcctttaaggtacgattcctggagtgagtggtggaggtgacaggaagtcattctcttcttgagaactcaggatgttctggaaattcagccccaacagaggttcagaatctgcatcatctagaataggctttggcttgtaatcgactatcgagttagggtgtcaggggatgttagaagtccctgtctttggtctacctcatgaggttttccttatcattcatgcagaacacttaggaggcattccaaaccagactagaagagggactttcccactaaggacacacatgcctttggaattaggggtggttcctagggcatgaggagaaagcacactatactttgactaaagaatccaagaagagggaggccttgctttagggaaacagccttgatatccagataagcatttatagcaacctatggtcctggatcaggcagtgtggaatggattctaagggtttctagactttgtaccccctgcacagagggtaagcatagagtatagcatagaggaaaaggcctggatccaattccggctctaataagctgtgagaagcctttgtggaagttgcttcatgtttctggcctcatttccccttctgtaaattatgtttgttacgaagactaaacgtagagcacttggcacgtgataggtgttgagcaaacgtttactgaacatctatcagatgccaggcgaagcccagtgcttgccatgtggcgccacccagccaggactcactctgtcttcacccgctgccctctgctcttcctcagactgctgatatggggctgacagaaaacatcggggacagcggactctgctttgagttgtggtttcggcggcggcgtgcacgagaggcatacactctgcaggcaacctcaccagagatcaaactcaagtggacaagttctattgcccagctgctgtggagacaggcagcccacaacaagggtactgggcagagctgaggaagggggtgcttggagtcagggttatagcaggaagttttctggagagtgtgcgaactgcttgggaaaacagtttataggatgaagaaagaatggcttataataagattcaagatttggcttgagagattactgaagtagaaatgagcctaagatataccaaaaagaaagagaaagctggcaaatttccgggaagcaagagcaagtaggggccaggtgcagtggctcatgcctgtaatcccagcgcattttgggaggccaaagtgggaggattgtttgaggccaggtgttcaagaccagcctgggcacatagtgagaccccgtttccacaaaaaattttaaaattaactgggcatggtagtacgcacctatagtcctagctatttgaggggtgaggtaggaggatcgcttgagcccaaacgttcaaggctacagtgagctatggtggtgccactgtacttgagcctgagtgacagagcaagactctgtctttaaaggatttttttttttcaaattttttaataaagcaaatggctgggaaaaaaggtgagaaactgctcgcttggatttaagaactgctgctacttgctgtgtgacctggactagttttttgtttgttagttttatttttatttttgtttttttgctgggctttaccttggttttaattttctgaacttcattctgctcatctgaaaaatgaaatactaatgtcttcatcttagtgtaatagggatgattaggtaaggtcaaatatatggaagcatcttgtaaactgtaaaggtatgtaaaaatgtgagggtttgttttttgtgtgtgtatgtgctcttaatgcccaagatgcagagtagaaattaggcagctgggatgccaaacagccaggatgcaacatattggagagaagagccagatatctgaggaggaagtcacaccatcattgccatccatgttgtgatagtcaacagaaggagtaaaaagagacatcagaggaatgaaagggaggaatgaggattgggaaggaacgaaaaaaaaaaaaaaagaaaaaaatcaaccatgacatgctagggctagagagaagggcaggaagaagttggtaacaagtgtccctattccccagagctccgagtgcagcagatggtgtccatgggcattgggaataaacccttcctggacatcaaagcccttggggagcggacgctgagtgccctgctcactggaagaggtgagggccagggtgctggggggtggcccccaggagtgaagaccttgacaatgaggatacaaaggggaggtatggtggaaagtcaggaaaggcatctcgtccccaaatcagtgggactggctgggaggccctctgtgagactgagggtcattccagggagccaagagggctttcccacaccagcaccccaccccccactccccactctctgcagccgcccgcacccgggcctccgtggccgtgtcatcctttgagcatgccggcccctcccttcccggcctttcgccgggagcctgctccctgcctgcccgcgtcgaggaggaggcctgggatctggacgtcaagcaaatttccctgggtgaggcacctctcaaggggtggctcccaacagctcggtcatggtggtgatgttcaggctgcttgctgctgagcaattcctttttctagccaagaagcccagttgccatgacaactatgtacagcttccccaccgctaaaagagccttccatctggttgctagggtgatgcttacaacagcctgttgctaagaagcacttcctctgtacctctctctctagctcttcttgggtttctatggaaactgcctcagcttcctgttgtaccctcctggttcaccacggcaatccttatagtttcctgtcgcttcttccctggttgctctaatgatgctgctgacaatttcctgcctcttggtagggggttcccttgcaactggatcgctatggtgactcacagcttcctgttgctatggagctttttcttccctgatggagcagcttggttgcttaaggtaatctggagggattctgtactctgctctcaccctagcttccccttcagccccagaaacacttgactcttctggagatgtgtccccaggaccaagaaacagccccagcctgcaacccccccaccctgggagcagcactcccaccctggccagtcgagggatcttagggctatcccgacaggtaagttcctacaacgaggctgggaacaatgtgatctctttggctgctttctggatgggcttttctgatcattcaaccccaggggggttgggggaaaactgtgaacttgtgctcccagctgaggctacagtctggatttattatcttgtctacctttctcctctccccgggacctggctaagaggcatcaaggtcataggttaaaaggaatcttaaataaggagtatagtgctggggtggatggaaaggggagaatgccaatggcctggcttggacttgggttaaaatggcaaaactcaggccaggtaaggtggctcatacctgtaatcccagactttcagaggctgaggtgggaggatcacttgagcccaggaattcaagaccagcctgggcaacatagtgagactccatctctacaaaaaaaaaaaaattaaattagccggacttttgaggggtgcgcacctatagtcccagctactcgagaggctgaagcaggaggatctcttgagcccaggaggttgagacttcagtgagccatgtttgtgccactgcactccaacctgggcaacagtgagcacctgtctctaaaaaaataaaagtaaatagcaaaattcaaggattttgggtaggaaagagaggtgaattgacaggcttgtggggaggaatggaggaaaagagagagaaagacaagaaatatgtccctaaattcactgtagcttctctccccccagagtcatgctcgagccctgagtgaccccaccacgcctctgtgacctgggtgagtcagcatccccaatttctaccacatccagcactcctaccatcttgcatgtaccttccttcctgtccccggctacttgggagtcagcttcttccctctcccaactcatctccctcttctctcctggcttctagagaagatccagaacttgcgtgcagcttctcctctcagcacactttgggctgggatggcagtggggcataatggagccctgggcgatcgctgaatttcttccctctgcttcctggacacagaggaggtctaacgaccagagtattgccctgccaccactatctctagtctccctagcttggtgccttctcctgcaggagtcagagcagccacattgcttgccttcataccctggaggtggggaagttatccctcttccggtgctttcccatcctgggccactgtatccaggacatcactcccatgccagccctccctggcagcccatgttctcctcttttctcaccccctgactttccctgagaagaatcatctctgccaggtcaactggagtccctggtgactccattctgaggtgtcacaagcaatgaagctatgcaaacaataggagggtgtgacaggggaaccgtagactttatatatgtaattactgttattataatactattgttatattaaatgtatttactcacactttgcctctaaggagctagagtagtcctctggattaaggtgataaataacttgagcactttccctcaaccagcccttaactagaacacagaaaataaaaccaagactggaaggtcccctctacccctcccaggcccagagctagctgactgtgtatgagcctgggagaatgtgtctcctccacagtggctcccagaggttccacacactctctgaagctccttctcccacactgcacctactccttgaggctgaactggtcacagacaaactgggatccagcacagtccagcagttctcaaaatgaggtcctcaggccacagtgcgtgaga

SEQ ID NO: 38599 - DNA, 120533 bp, Homo sapiens
tccctctctcctcgcccgctgggtgctgaagttgggcggatggcagcaaaccggctccgctagaggaccgagccgcccagccccgctcccccggacccatcggcgcgctgcccacacctccaggcgaccgggtaagacgctgcctccaaaacaagcggtgctaagtaaatgacatcaaaatgtctgctttgcaccaatggatggatttttttcaaggtaggggggaggtgaaggaaggagggggcggagagcgcgaccgcccatgccccggcgggggcggctgcgcggcgctggggtctcagctgtggccgcggcgccctgagcgggagcgggggccgcgccgcgggtccgggaagttgaatcccgcgtcgctgcctggacgcggtccgctcgccgccctcagctgctgcagggaaccgggcgagtgtcctgcccgccggggaacgctcggccaggtcccagagttcccgcggagagcggggcgcctgctgggggcggccgggagggccgggccaggggcgcgggagaccccgcggggacgcgaggtgttgcgggttttgtgcggttggttgggaacgaggagaatgtgccatcaacagtgtccaatcgactgatcaccttgggtgctgtgtttcctcccttatctctctttacctttgggaaaatgcactgctcaggtggggaaggtgttcgaagaagaggttgcgaaaatgaatcctttgaccagcagtaaaataccggaggggtgtgtgtgtgtgtgtgtgtgtgtgtatgtgtatgtatgtatagggggtggggggtctcttttgttccttcccctccccttagtcaaaggaaagggagtcctggcgtgtgcggcgcggggtggattccacagccaccgagggggcgaggacgaggaacgcccaccaaccgcgagtcgctgcccgggtgggcgcatcggagcctcctttgctgtaggtgatggtggtctttccgtgatcgatggaatcatagtttaatctctgcctccccgccagcctccctgctgtccctcatcgagtgctgcggcagaggctgggtgcagacacggccgctttctcctcttctctctgcctccctgtctccctgaataaatgccggaggactaggggatggcggagggacagagctggactcggaagccgcgggtgggagctgctcctcgcgagcccgaggctgctggcaccttgtcgcgggcagcccgcgccagcctcgggagtccctgggctccgggagagcgagccggggtcgcctggccacaaagatgcccgcgcgcccgccctgcgtacgggacccgccctgcgccctgagccctgcgcctcgcccggagcccgggacgtcggttcacgtgggagaacccctgtcgcccggggacgattgaccctggctcctggcataactctcctgacctcccctgacctttccataaatgcttctttcaaaagattcactataagatttgtctggagaacttcacactcttcagagttatttctttcttttcttaaattgttttacggcgagattctctccagcgtgggatggctttcacaaataataaagagaaatcttagtttggttcccatctagaataagcagttctgaggctgggtgccatctgcatttccggcgttcatacatactggttttccgggtgatgaacccttctgaaaatcatttaattgaagacgtgagaattgatttttattagtgtagtggaaaataatgctttcctcctcgattcacaactgccagacgctgcgtgtacgaaataatttgcaaaccgtgaaacatttaaagtacattgtacttgtttccgaagtcttctgtagtgagagtattatccaagaaatatgcattatagcactcctatctaatggaagggtgatttaatacaaatgaatgagaagtttgacctcctccagttgttactgttgttaagccatttcttctgttaacatgaactaaaacagtaattagcacactcatgggagactggatttattcactagtttttatagtcttttgaaacccgcacttagagccaccataggagagtagtttatttagtttgaggtaacaagaaaagaagtgttcgttattacaaaaagattgagtggtattacttattaaataagataaatctccatggcaatgacacgtgatctcagagccaggggcactcatccttcctcctgaaattagtctgaacgattaagaaaaccgtcgaatttacagaacaaataacataaggtgtctgttatgctgattgatttcgaccctttttgctatagttccgcaactactccttggcgtttagtccccacggaagggaattaacaaggagagttaatttactatcctgttcattctaaggcaaacagcatttccttctcaaataggtatctctttggttgtagggctcttcctctgaggtacttatttatttgaattcatcatgtttaaggtctaagttccttattcctgtgaccattttatacttttgcataataataaataataataataataaaccttccttaacatttcctaccacgagggccacggtctttgaagaaaaggagaaatatatattcttacccgtttgatcttactgtaacagccaagtaaaagtgaaaattttaaatctgaattgatcaaaattctggttgacttgcagagtaaagtctaagaaagattttaccttttaatctaaagccgtagagataatggcctttgtgtcagaagtccgtttgctaaaatacatgggctttcctggaaaaggaaggtaggcatggatgatgaggtacgatgccaagagggctgggagtccattcaaccacatttctgctgagaatcctgtttctgatactctccaactctgcttacttaacactgagaatactgcactaccaaagagggcaaatcgaaggaccgctatatacccagaggttgagaataatgctatgtgatgttaaaagcattttatttcacctgattggtatagttagagtgtaagtgtgaatgcattgtggaggcgtaaaattatatgacatttccaagggagtgtcaagggtcctcagacaaatatatttttatggaaaaccttaaaataatcctttgctataggtagccaataggtagccaagactttcagtgtgagattgatggatactcccaccttccttctctccctacccacacttatctctgaaaaaaagacactttcctaacttccaaagaaattcatttagacgatcattcctgctattgtgccagcacctggcacagtatgtggcaaaggcaggtgtaaaataatttttcctaaattaataaattttgcagggtcgacatggctcgcaaaagtcttccaaggtaagaattgcatttttaaaatcagcacttacactgtttaccaagtacactagttgggctcctaaaactcgtgtttatggtcctacatctttggaggaagcaattttcagaattgtcgttttgggaatatatatgtgtttaatacaacatttatattactgatttgtttcccaattataaaagctctatatttgcttatcttagatcccctacgatacaaaattacctataggcagatatggatgtgaagagcatgaattttgggtcaagctggctttagcttgtattgtggctcctccctttaaaaactttattgctgtaggcaagttactaatctgtcctgagcctcagtttcctcagacatacaagagggatgaaggcaggatgcaagcataaatacaatgcaatgtatataaagtactgaacatagtgcttggcatgtactgagtgcttataattatctcaatacctaaagaactgctattgaaaacacagcatggtttaccacaagtttatttgctttatataaacgtaccattgttttaagaatttgaatcatattctagaacaggggtccccaacccctgagctgcagacgggtaccagcccatgacttgttgggaagccagcagcacagcaggaggtgagtggctggtaagtgagcattacctcctgagctcctcctcctgtctgatcagcggctggcattagattctcataggagcgtgacccctattgtgagctgcgcatgcaaggaattgaggttgtgcactccttatgagaatctaatgcctgatgagctgacgtggaacagtttcattccagaactattcccccacccccactgccatccgtggaaaaattgtcttccatgaaaccggtccctggtgccaaaaaggttgggatggctgttttagaacttcatatttctaaaaaaattaacattcctttgttgctgtttctcaagaaattaaaattgatatttttaatgcgatttagtgatatagttcaccttatgaatgtctttatttagccattcttttatctttggattttgatcctcatgcctaaattttgtatgcgtatctctattgcagtttctcctttgggcacgatgcttagaacagctagttcttgccaacataatgccattctttaaaaaatctttgctaacttgataggtgaaaataatatttttcaaacttttatttctttggctaccaataagactgattactttttgacatactgataagcagtttttgtctttgaggatggctcgttcaagtctttagcctgtgtttccactgctgttctggtacatttttcttatttgtttgagtgctaatattaattttttaaaaggcagaagcaaacaaggaaaggaaatgctcagtgacaaagatcactgtggctaaaccagaaaagctggatcagccagggcattggggttcatcatatactgctacacccctgagttttccaacctttacacttctttttagaagtccggaatcagtaaacaatttgctcacaaacaccttactatgagaagcttgtgtctgaagagttcccagatagtcgtggattgtttctgccagttgccaatgttatggaagaacttctgagtttttctgagataaaggggttgaaaggaaagatgggagtacatagagatcatagggacattcatttgatttctcatcagaatgagtcagttaagctaaattataaaaccatgtcaggttagaatcataccttacttcaactactaagctctaggtgaaatttacacatgttaaaagtaagaatttaatgtgttaccttaacgagctctgtatctgcaatgtttcacatgattcagtggtcttgtaagctcctgtttttgactttttaagttctataacttttgacaaatttggtttcaaaagtttaattatctagcttggaaaatctataaagtccttaggtattaaactatctagaaagtataaatgtttttgttttgttttttgaggcagggtctcactctgtcacccaggctggagtgcagtggctcagtcatggctcactgtagcctcaacctccctgggctcaggtgatcttgccacctcaggagctgggactacaggtgtgtaccacgacgcccagctaatttttgtattatttgtagagtcggggttttgcttgtcttgaactcctgggctcaagcaatccacccacctcagcctcccaaagtgctggattacaggcgtgagccactgcgcccagctgaaagtgtaaaattttataatcatcagtggtaccagtttatcaaatacagtaaaacctgagtaattcagaatttataatgatgggaggtccctataggagaagcaatgacctatggtggaaaataaaatctatttcaaatagaaatggatttgaatttttactctactatttattagatatgcaggctttttcatgaaattatagaagtattttatacttagtattctagcatgattaataaatatctaaaatcactgaatttcttaagctttgtatgtgagatttttaaaaattccctgtgtcagtaaatataattctattgtagtcaatgattgtggttcacaaagcaaatatttacttccttatcttgggtcacaggcttttcacagtacagtactgctgattggctgttgaaatacacaggttataattcaagagccatggcattacagtaaaacagacacaacctgggggaaattatgacataaatggaatgagcaggtgagtgtttatttcattttaaaaattttcttgaatcttcccaataatatagtgagttaaatccagtgaagtctcttgtgaaagttgtcactttctctattttccagtctctatgaaaggtgggagcctgttattttggtgtatttatgataagtcatgtaatctacagattttatgagtcagttttggctcttggtagacgaccctatgtccacgtcctattaccctaaactctcctattttttcaggatttgattaatcaaactcaacaaatatttgaaagtttgctatttgaaacacagcaatccatattatttaattcacatgaagtaaaaaagcttatggaaaattgcccttaaaagaaggagactttaaaagcagagaatgtaatttggtggaaagagcccaggttttagattcaaataaccagggatttagccttcacttctttgagccttagtatcattatctgtaaaactgaagacaatttaaaaatgttaaaggattaaaagaaattatgtctataaaatctttcatatattggtactcagtatggaagtgttaggtattgtattagacttaataaatcaaaataggtacaagaaacatcatgtaaacaataagggcttgaaggggttttaatttcgtgccagtatttgtcttaactaattggtccttattaatgtttaggttgttctccatgtatttcgtgtgttatcctttcctgactagtttgtttcaccaacctgcttacaaacatatttgagcacccactatgtgctaggctgtgtgatatttttggatacaaagattaattaaacgtggcccctttccacaaggagttcacatataagcttcttcaagttatttttcttttatctagtgagtactggtcattctaagctttgaagtcatagctaaatacaacatgggagtaataggcaatgatttccttagggtttagcaatagaccaattgatctcaaaatttaggagcctctacaactaatgttcaagcaagctgctaagcagagactcagagataaggggaagaaaagcaggaagtggctctgttggtggatgatttaacaacctccaccatagtatcagaacaacaacagactggaggcttaaccctctttgtgaaccgacctcaacacccaattccttctcattgaaataaagaaaatgtgtacatacatctgtactatgccttttcccctctcacttgtaggctaccctgcgtaatcattgtaatgtaagatattctaaaacgctggtgtaggggatgaacaaaagggaaggagagtgagatccctgcccttcttccgggtccacatttcccatgcactagcaatattttagaattttttcctgatactgctgcagttccatctttgattacaatctgtttataatatagtaccttgaccaaaaccccagaatcctcagtttggatgaagaataaatacatttaagtttgagaaagaaaaccatctccaatatcaacttgttaaaatcactagggcaatttctaaatctagcagttagatttgctccgatctggaaagattttgtatgatttataagatcagagtgaagacttcaaacccgttctagaaatatgtgatgaatagatagttaatatatctaagtatggaaatgaaagacattgacattaggaatgaattaacttgaaggtaagctcagcactcctgtcagccactacatttaacattcttgtcattaaatctttgaccgggctcttaataagtaaaaatgtatgctaatgtaagatttgaacctatttctttctcaatttattgccactcagcactaccatacagtaatttacctgtgacctatgagtttagtatgatcaaaattcactagataaaagcaaaggaaaactagtgtcttttattagggcactaaggcatagacatgctataaagcaatacaatgacctatataatttacaaactattatgattaactgaatgccgtgttgtgaattggagtattaaatactccaatttactccagtgtacattggagtattaaatactccaatgtactctgatgtactccaatgtactccaatgtacattggagtattaaatactccaatttactccaatgtacattggagtaaaaggcttcattgtgaattggaatactaacattttccctacctactgtttgggtgaggcttgacatttgattttccccacactctcttatgattattattgttattagtatttctaaatagataaattgaggagaaaggagcatctttgcttttcatacatctaatagttcatagaaaaataggtgtttactcatattttatgtaattttaggatatttacataattttgttgcctgaaatttaaaacatatcaagagctcaaatgttctatctgccaggaaaaaacaaacaaacaaaaaaccctactgtcttattttcttctggtaggaataaactgccctgattgtaatttctatgctagtttatcagtaaataatattggcaattttgactcaagctattggagtccatgttttcttcatctactcaagtccagtaacttcaattttcactgatgaagaaacattttaaactaaattactttcagtaaattcaatgtctaatgacccacctatgtttatataaatgatggatttagttgaaagttacatttatttatcattttgagtactcaaaaccaaacaatagagaaatccttcccacactggaattgtctccaaaatgtaatattttgaaaagatgattttatgtgtcaatgtatgcatatatgtatgtttccccttttatttatgggaaacaactgatatggtgcctacgtaatcatagccaaatattcaggaagaaaggatacatacttgagaatagagggggaggcacaaatgagatgagaaggagagtcaagtaaaaagcaggaaggctgggctcagaaaacaagactattagttaaaaactcattatatcttaaagtataatatcattcaatacgttattatgtaactctgctatattatgtaaccacttccagttttgtgaattcatgtgacctaatcttaagaaggtaattttttcccattaattcagtaatttcattgactgaacatctgggtaatgcaagtggggtttcgtaaggtagaattccattaaataaatgttaattccaggaaggaaaaaatgtgaagcccttttcttgacctaacataggttatgttaaatagtttaaaattctcgtaggtgatactgaaattcaatcacattgataaagaatctattcccaagttttctttctaaatgcaactatttcgagtacatcttatataaaatcaactgtatctttgtgatgtaaagacctttatgtcttgtttcaaaataacagcagtgaataaatgtgtatgataagctttttatttttattgagcaacaggacattgcaatgacttaatatctaaaatatttattaagactttgggggagtaacaagtgagcttggaaaagcttgtctgctcattgccactgagattatttttaagagaatgtggatttatggcttagtaggatcactgaatgtagttactcagtgaggtggctgattgcaaccaaaatcaactttggcacttggtgtgctggcctctgactgttgcccccaagagagttctagtctggttagattttagggaaaaagaaataggttatgttcctgaaagtagagttcagaggatacagtctaaaatgttatgttagagagaggcagcaacaaaggaaagagagaaaagtctttcggtgcattggtaaatacagcctgtgtgggtctgaatttccaagtgtttgcattagatttccaagttttctttagtttctgctactcatcagttttacctcttctgttttctgcctcctttttcttaattaatgtgctgtgtaattcaatccttactctgtaccaaagaatagcaaaattaaaaaaaaaaacatgaacaagtctgagggagcctaaagaataaagagataagacctatatgtaaatttctgttattattatattctaggagagaactaaaatgctgtgagaactcagcagcatgagattaattttaaatggctagaccaggatctggcaaaagtgtcatagaggttgtgacattttctcggattattgaaagatagaattttgacagacaaagaaaggtgtctccaggctcaaaaacaatgtaaataaagatagatgcagaatcaggaaaattaaaaccattttgtgcacaatatttcaaaagcatacagtactcgcaggaaatcactagatgataaggctaaaaaagaagacatatactggcagctgctaatatcagagtaaaaaggtggaattttccttgctaggcagagtgctgctgaagctctctaagcggaggattaccgggcgggagctgtgctatgggacaggcgcttcatcagtccatgcaggggggcggtcaagggaagtaggaacaccacaatttcagctgtccaggtgagagaagaggcctaaactgagaaacagcaaaaggcagggtccatgggaagatgatgatgtgagaaaatgtttgagtcagagccttcaagacttggtgaacaaaaagatctagaagatgtaagaggagctataaagctgtcagggagcattttagcctatgagtctgggaaataaggatgtcataagacatggacaagtcaaactcatgaagaggttagtgaggaaataagttgagttcagtagtttgacatagccatcagaattcttgcagatgtttagcacgccattgattaaaaagcctcagggatattatttgattaagtaggaagtaacaagtatgatcttaggctatgtcagtagagccatatagcgtccagaatgaagttggcaatcgttacgttctattctgcatatccaagtcacaattgcaatgttattttgaacttatttttgacaccatggttagaggtcaagaatataggtggtgaaattcacttacaaaacaaaataatttgtgtgagacatggttggaggaatttgtactttcttaacctggaagacagtggtttccctggaagatatgtgtgtttcaccatttggagaaaagccgtggaaaaagattatacattctaaattgtcccaatgatatgatgaaaataataaaaccaccttgcagagttgtggagagataatatgtgcagtgcccctggaacacatttcatattcaatgtgtcttagctcttattgttaccttaggaatagcattagaatcagcggacatgtatcacaaagatgttgccatcctattggaaataaccgttttttcttttttgagatggagtcttgctcttgttgcccaggctggagtgcaatggcgtgatctcggctcactgcaacctccacctcccgggttcaagcaattctcctgccccagcctccaaagtagctgtgattacaggtgcccaccaccacagccagctaattttttttgtatttttagtagagacagggtttcaccaggttggtcaggcttgtctcaaactccgacctcaggcgatccacccgcctcagcctcccaaagtgctgggattacaggcatgagccactgcgcccggcttgaaataacttttaagagtcatagccagctggttaggtaagctgccttgaaaggtagcaagtttaatgtcactgaaaaaatgtagggtggacaaatacttggcagagatgtcatggaggaaactcaatgactgggagggtgaatgaactacaaggcctcattctaactctgaggtccagatggtaccagagaatttggactgcaaacccaagagaatgactagagctagaaataaaacttgaaagtcttttacatacaggtaacaatagtagaaaagtgtcaaaggagagagagcagagagcaggtgagcttagaatagaatcctggagcatatctgcatgaatgggcatgtggaaaaagaaggaaactaaatatatacacatgcatacatacatgtatacatgcatatattcatatatgtacacattcatacataagataggataaaaatgtgttataaagagaatgaagacactgtaatatgccataaaaccgaggatgtggagattttttttaccagttttattcatatgtataataatcctacaccaaagattagaaagaagatcagtgagttatgtcatgtggcagaaagggtgagtaagatcaagaccaggatgacacatcagattttgcaatgaggaagttacttgtgattgttaaaagcacttggtgattaatgatttatacatcatctatttccaaaaagtttggggcagcttaaataaaagcactttcacacaaggcagtaaaaacaaaataaagatgagaaaccatcaagagaaataaatgggggaaatagtgaatgtaccacaaaacctgggtaagatcatttttgtaataggagcactacgttttagctatgtggttcctggcagccaaaataaaaggataacaggaaagattacctataattcattggttaacgaaggaaaacagatcttcagaagaatttttgtttcctggcactaaattctatgaggagtatatcccatacattcttagataagagacagtgacatgttagacaatgtgatgaacagtggttctgctgaagatgcaggtttgctttaagttgctgtttctttaaggccttgaaggtcaagtgtgcaatattaagatgaggttggtaaaagccaataaggcagtaatatttcttgtgggcatagaccagatgggcatctgaatactcctgggtgtgaaaaatcagcataagagagcattagggaagaggacatccaagagaggagatgcaaggatagttccatgaacgtgaggagagacagcaccaagtgccctgcaacctcctttccttggcacttgccactccctctgcctaacaagctgtcccccagtctttctcatcattcaagtttccattcaaatgtcaccacttcaaagagactctaagaactgtcttcctaatgtggtcccttcttcatccctcctcatatctctcactctctaacaataatccattttatttaacagtatttactgctctgttaaattattgtatttattattagtctccctcattccagaaactagaatgtaagctagtacaccaagcagtgccagtgattgatatgttgaaggaatgaatgttttatgaatgggaaagaactcagctcagtactgatgtgataataaataggatggtagtattgggcatggagtaaatgcttcctaaaatgttagctgagaagaagatgataattatgataaggacataattttgtcctgagaatatcaagaacactggggtttggaggaagagcacatattctctgtatacttttctgtccactcacaaggtgcaggagtactaatattaatggtactaatatgaattgatcatgattataaggggcggagcctaagtgggaagagtacaaagagtcctatatcatggcaaaccccttttcctctcatattggatgagattgtttgatagtgcctgatatggttaggctttgtgtccccacccaaatttcatcttgatttgtaattcccataatccccacgtgtttagggagagacctggtgggtgctgattggatcatgggggcggttttccccatgctgttttcatgatagtgaatgagttctcacaagagctaatggttttataagaggctcttcccctttcactctcattcttctctctcctgctgccatgtgagaaagtccaagcttgcttccccttcaccttccgccatgattgtaagtttcttgaggcctccccagccatgcagaactgtgagtcaattaaatccctttcctttataaattacccagtctcgggtatttatattttttctttttttaaattattatacttcaagtcctgggatacatgtgcagaacatgcaggtttgttacataggtatgcacgtgccatggtggtttgtggcacccatcaaccccttatctacattaggtatttctcctaatgctacccctcccctagtcccccacctcctgacaggccttggtgtgtgatgttccacttcctgtgtccatgtgttctcattgttcaactcccacttatgaatgagaacatgtggtgtttggttttctgttcctgtgttagtttgctgagaatgatggtttctagcttcatccatgtccctgcaaaggacatgaactcatccttttttatggtggcttagtattccatggtgtatatatgccacattttctttatccagtctgtcattcatgggcctttgggttggttccaagtctttgctattgtggaaagtgctgcagtaaacatacatgtgcatgtgtctttatagtaaaatgatttatactccttttggtatatacccagtaatgggattgctgggtcaaatggtatttctggtcctagttccttgaggaattggccacactgtcttccacaatggttgaactaatttacactcccaccaacagtgtaaaagcgttcctatttctccacatcctctccagcatctgttgtttcctgactttttaatgatcaccattctaactggcgtgaaatggtatctccttgtggttttgatttgcatttctctaatgaccagtgatgatgagctttttttcatgtgtttgttggctgtgtaaatgtcttcttttgagaagtgtctgttcatatccttcacccactttttgatggggttgtttgcttttttcttgtaaatttgtttaagttccttgtagattctgaatattagccctttgtcagacagacagattgtaaaaattttcccccattctgtaggttgcctgttcactctgatgatagtttttttgctgtgcagaagctctttagtttaattagatcccatttgtcaattttggctttcattgccattgcttttggtgttttactcatgaagtttttgcccatgcccatatcctgaatggtattgcctaggttttcttctaaggtttctacagatttaggttttacgtttaagtctttaatctatctttagttaatttttgtataaggtgtaaggaaggtgtccagtttcagttttctgcatatggctagccagttttcccaacaccatttattaaacagggaatcctttccccattgcttgtttttctcaggtttgtcaaagatcagatgattgtagatgtggcattatttctgaggcctctgttctgttccattgctctatatatcttctttggtagcagtacaatgctgtttttgttactgtagccttgtagtatagtttgaagtcaggtagtgtgatgcctccagctttgttctttttgcttaggattgtcttggctatacgggctcttttttggttccatatgaaatttaaagtagtttttcctaattctgtgaagaaagtcaatggcagctagatggggatagcattgaatctataaattactttgggcagtatggctgttttcacgatattgatttttcctatccatgatcatggaatgttttaccatttgtgtcctctcttatttccttgagcagtggtttgtagttcttgaagaggtccttcacatcccttgtaagttgtattcctaggtattttattctccttgtagcaattgtgaatgggagtacactcatgatttggctttctgtttgtctattattggtgtataggaatgtttgtgatttttgcacattgattttgtatcctgagactttgctgaagttgcttatcagcttaaggagatattgggctgaaatgatggggttttctaaatatacaatcacgttatctgcaaacagagacaatttgacttcctctctccctatatgaatatcctttattttttttctcttgcctggttgccctggccagaacttccaatactatgttgaataggagtggtgagagagggcatccttgtcttgtgccagttttcaaagggaatgcttccagcttttgcccattcagtatgatattggctgtgggtttgtcataaatagctcttattattttgagatacgttccatcaatacctagttaattgagagtttttagcatgaaggggtgttgaattttattgaaggccttttctgcatcaattgagataatcatgtgtttttggtcattggttctgtttatgtgatggattgcatatattgatttccatatgttgaactagccttgcatcccagggatgaagctgtcttgatcatggtggataagcttgttaatgtgctgctggattcagtttgccagtatcttattgaggattttcgcgtcgatgttcatcagggatattggcctgaaattttctttttgttgtgtctctgccaggttttggtatcaggatgatgccagcctcataggatgagttagggaagattccttctttttctgtggtttggaatagtttcggaagaaatgatatcagctcctctttgtatctctggtagaattcagctgtgaatccatctggtcctgggctttttttggttggtaggctattaattactgcctcagtttcagaacttactattggtctattctgggatgagacttctttctggtttagtcttgggagggtttatgtgtccaggaatttatccatttcttctacattttctagcttatttgtgtagaggtgtttatagtattctctgatgtagtttgtatttctgtgggatcagtggtgatatccccttaatcattttgtattgtgtctatttgattcttccctctcttcttcttgattaatctggctagcagtctatctattttgctaatcttttaaaaaaaccagttcctggattcattgatttttttgaaggggtttttgtgtctctgtctccttcagttttgctctgatcttaattctttcttatcttttgctagcttttgaatttgtttgctcttgcctctctagttcttttgattatgatgttagggttttgattttagatctttcctgctttctcctgtgggcattttagtgctataaatttccctctaaacactgctttacctgtgtctcagagattctggtactttgtgtctttgttctcattggtttcaaagaacttatttatttctgccttaatttcattatttacgcggtagtctttcaggagcaggttgttcagtttccatgtagttgagcggtttggagtgagtttcttaatcccgagttctaatttgactggactgtggtctagagactgtttgttatgatttccattcttttgcatttgctgaggagtgttttacttccaattatgtggtcaattttagaataagtgcaatgtggtgctaagaagaatatatattctgttgatttggggtggagagttctgtagatgtctattaggtccacttggtccagagctgagttgaagtcctgaatatccttgttaattttctgtctcgttgatctgtctaatattgacagtggggtgttaaagtctcccactattatcgtttgggagtgtaagtccctaataggcctctaagaacttactttatcaatctgggtgctcctgtattgggtgcatatgtatttaggatagttagctcttcttgcggcattgatccctttaccattatgtaatgcccttctttgtctttttttatttttgttggtttaaagtctgttttatcagagacaaggatggccaaccctgcttttttttctttttctttccctttgcttggtaaatattcttccattcctttattttcagcttatgtgtgtctttgcacatgagatgggtctcctggatacagcacactgttgggtcgtgattcttcatccaatttaccagtctgtgtcttctaattggatggagcatttagcccatttacctttaagattaatattgatatatgtgaatttgattctgtcattatgatgctagatggttattttgcctgttagttgatgcagtttcttcatagtgttgatgggctttacaatttggtatgttttgcagtggctggtactggtttttccttcccatatttagtgcttccttcagggactcttgtaaggcaggtctggtggtgacaaaatctctcagcatttgcttgtctgtaaaggatgtcattctcctttgcttatgaagcttagttttgctggatatgaaattctggtttgaaaattgctttctttaagaatgttgaatattggcacccactctcttctggcttgtagggtttctgcagagacatctgctattagtctgatgggcttccctttgtgggtaacccgacctttttctctggctgcccttaacattttttccttcatttcaaccttggtgaatctgacgattaggtgtcttggggttgctcttctcgaggagtatctttgtggtgttctctgtatttcctgaattggaatgttggcttgtcttgataggttggggaagttctcctggataatatcctgaagagtgttttccaacttggttctattctccctgtcactttcaggtacaccaatcaaacgtagatttggtcttttccatagtcccatatttcgtggaggcgttattcattcattttcattcttttttctctaatcttgtcttcaggttttatttcattaagttgatcttcaatctctgatatcctttcttcgcttgatcaatatggctattgattcttgtgtatgcttcacaatgttctcatgttgtttttcagtgccatcaggtcactttcgttcttctctaaaatggttattctagttagcaattcctgtaaccttttttcaaggttcttatattgggttagaacatgcttctttagctgagaggagtttgttattacacaccttctgaagcctacttctgtcaattcgtcaaactcattctccgtccagttttgttcccttgctggtgaggagttgtgatcctttggaggagaagaggctttctggtttttggaattttcagcctttttgcactggcttttcctcatctttgtggatttatctacctttggtctttgatgttggtgaccttcggatggggtttgtgtggacgtcctttttgttgatgttgatgctattcctttctgtttgctagttttgcttctaacagtcaggcccccctgctgctggagtttacaggaggtccactccagaccctgtttgcctgggtatcaccagcagaggctgcagaacagcaaagattgctgcctgttccttcctctggaagctttgtcccagaggggcacccaccagatgccagctgtagctctcctgtatgaggtgtctgtcaacccctgctgggaggtgtctcccagtcaggaggcatgggggtcagggacccacttgaggaggcagtcggtcccttagcagagctcaagtgctgtgctggaagatctgctgctctcttcagagctggcaggcaggaacatttaaatctgctgaagctgcacccacagccaccccttcccccaggtgctctgtcccagggacatgggagctttatctataagcccctgactggggctgctgcctttctttcagagatgccctgcccagagtggaggaatctagagaggcagtctggctacagcggcctggcagagctgtggtggggtcagcccagtttgaacttcctggcggctttgtttagactgtgaggggaaaactgcctactcaagcctcagtaatggcggacgcccctcccccgactaagctcgagcatcccagcaagttcagactgctgtgccggcagcaagaatttcaagccagtggagcttagcttgctgggctccgtgggggtgggatccgctgagctagaccacttggctccctggcttcagccccctttccaggggagtgaacagttctgtctcactggcattccaggcactgctggggtatgaaaaaaaaaaacactcctgcagctagcttggtgtctgcccaaatggctgcccagttttgtgctcgaaacccagggccctggtggtgtaggcacctgagggaatctcctggtctgcgggttgtgaagaccgtgggaaaagtgtagtacctaggccggagtgcaccattcctcacagcacatttcctcatggtttcccttggctaggggagggagttccccaaccgcttgcgcttccctggtgagacgatgccctatcctgcttcggctcgccctctgtgggctgcacccactgtctaagcagtcgcaatgagatgagctgggtacctcagttggaaatgcagaaatcacctgccttctgcgttgatctcactgtgacctgcagactggagctgttcctatttggccatcttgccagccaccaggtatttctttatagcagtgtgaaaacagactaatatagtgcccatttaaattttggagactatctgtgctattattgcattaataatgtcgcagggttctttctaagagtcattagtcaatgcatccttttatgacccttcctggtagctaaaaacaaaacccttattatattgaagtgtgtgtgtgtgtgtgtgtgtgtgtgtgtgtatgttggcagtaaagagtccatcaaaattgcctaaagtataaagcaagttgctgacatacaaatgtaaaagcagaggtgctggtagagagaagctcatcagaattgaagaggaaactagaaccaggaaaggaaagactggagatagactaggaagtgagccaaacatctctttgaatgtggactcgttgtttaaaagaactacggagaggagaagagtaactagaggaaacttaacagcagcctgaggtgggtagtagaaccaaacaaaactctcttgacactgattttgggtctatggagcttcttggccgtgaaaagcaaaattatcaatggagaagggtcaggaaaaataccatggtatttcctagaatatcaattgtattcattcttgagaaatttaaaatgtttccatatcaaagtaaaaacaaatattaggaaacagtatatcatttttatggattcatttgtttatctatttgtatgttttttaggttagatctcatgtttggaagaaattttgattattcaggcaccatgttgggctttgcctcagggccccagggggcaagtttgcagtttagagatagtggaatttccccaaggttccggacaagcaaaaggttttagactcatatagcatgataagtttaaatggcaccctgacactctccaagtccatgggtcctttttttcctcatctccttatctctaatattttaactcctaaccagaagaaagatgttgtgagacaaatgttacaaattgtttttttctaatggctttacttgaagcatctgaaatgataaaaagtatttacagctttgcaaaggacagattaaaatacaatctaattttccttccatgctgaaagaggaggtttgatcgtgatattgtctgtattacttagtccattaaccaaatgtgcggctgctaaaacaaacacacaagtaagcaaagactttcctgactataatttgttagattgttccacaagaggatgtccaatctagtgaatgttgcctgtgtgcaattgaccaagtaagaagatactcttaaaaaatggaaatgaacatttaaaggaaaaataattgcctcataaactcattggcaaagtaccctttggaatgcaaatgtgaaataaggtagattttaatatacactcgtctcttatgtgaaggcagaacagtgaactgtcattcaaaagaaggggataaacaggaaattgaagttgaaataataaaaatgaaaaaaaaatggcgtttagctgcagatttttcaaaccatggagtaagaaactacatttacttcctgtattatcgtttatttgcttgtttctaatgtttgattgcatttggcttttatagaaatagtctgggaaagaggagtaagtgattttgattaaacaaattacttactgagcacccactatgtgctagcactgttctgagagatgcagattgactagggaacaaaacagacaaaaatgcctgcccccatgagatggctatacttggtctttgaggtttttttaattggttcatagagctccatttggactcctttgtagagcaaggctataaagattgatctgtctgtctacacgcaaacacacacatgcacactcttgcattcatacattaattaggtacaaatacataaggctaagtgaaggggtaccagaggcgtagtggctgtatcagattggaatgtaggggaattttctacaccttaattgttttaaaaactgacatcagtctgtttcaaaccaatatattgtactactacaaatgtattaattgcagtatagaaatgttggaatgagaggtcaaaagaaggagattccaccctcttgccttctctcattcaaggaaatatatggctcatagcatctgaagttctgggcacaagggggagaagtgagcttattttttctcaggctggaaatctgacttccctccaggaatttcccaggaatgaatgcctgtttcatcttcatccctgtgccatttctgccatttgcctgccaaacttgtttcctagtattctgaggtacatttctgagaatttagagcataattaactgaagcagaagaattttgagatataccagaacatttagatcacatttaatggagatagaaaacctaaaggaatatgttcctcagatgcatattaggtgataagatggaatgcagcaattttattttgtctaaacttttgggaaaattatgtacggaggctgtataatgtgctcagccagaatgggaatgaaatgaatgaagagcagaagcagcctcaaataacaaaaaaggaggtggcactttttgggggacgggagaggatggatattttggagattgccccataactgacatgaactcagggtttccaatcatatcataggagaagcactatttcctgaaagcactcatttggagcaatctgagctccccttttacctgtgatttttttaaatgacatatacacaataacggatggctttgttttcaagaatggcactgaagcaagaaatgagaaattatcaagagctgttagggatttgattgctgctaagggaaaatgaaagaaaagaatctgaatgtattccaggaaaatatgtaatgatagctaatgcacctgttggtgttttatttgttttgaaatgatagatgtggagaagacgtagcaggtacccaaccaacacttgcaacgatttcaggtgaaacagagcaagtgatatttttacagctaagacttttaaatattattttttttaagttgtgtgtttgggtggagttaaaatttcattaccatagtccccaatataatagataatataatataggctttaagaagttgattttgtacttgaattttttttttacaaacagcataaaacattcattacagaatttatttggtttaacttataaaaacagctaaaggcttcaagatgaaataaaatatttaaataaagtattgttaaatttgtattaaacttgtttttgacatttcagacataactacaatattaggtgtttggagagaacatggtgccagtgattatgaataccaaactacttttcttttgagacaaaattttcactgttattgcccaggctggagtgcaatggcgcgatctcggctcactgcaagctccacctcccgggttcaagcgattctcctgcctcagcctcccgagtagctaggattacaggcgcccaccaccatgcccggctaatttttgtttattgagtagagatggggtttcaccatgttgaccaggctggtcttgaacttctgacctcaggtgattaaccctcttcggcctcccaaagtgctgggattacaggcgtgagccaccatgcccggcttatgaataccaaactactaaaatattattttaatccagagatgccatcaagagaaatgagttctagctctggctgtagaactctgtgaatcctagtatgacagagaattatacatacagccaggcacggtggctgacgcctataatcccagtactttgggaggccgaggtgggcagatcacctgaggtcaagagttcaagaccagcctggctaacatggtgaaaccgcatttctactaaaaatacaaaaaattagctgggtgtgcctgtattctcagctactcaggaggctgaggcaggagaattgcttgaaaccgggaggtggaggttgtaatgagctgaaatcgcaccattgcactccagcttgggcaacaagagggaaactccatgtctatgtatatataattactatgaattaatgtcattggcatgtttatgatggctaccattactctccaggattgttgatcaacagtgaaagcagttgccttacaaaacagtgaacttagtgaattctcccttcctgaaaaaaaaaaagtcctgaatgtaaaccccaaaccattcaagggccagcctcttcatcccttttcttctaccctctcctgcttgcaaaatcccatatacttaccccagaaaattgtttctcttttgccacttctgtgtgcctttcctcagctgttttcagcctgaaatgctgtgcatgcttcccttcacttttctaagtcccaaccatcctttaaggtctaaggtaaagtcctgaggcctttatgattccttgcctggccacctcatagtgacgtccgcttccattgaaactgcctgcatcagaacgtgacatgtgcattcctgtcttctctatgagtaacccctttccttctcatactcttaccaaagggtggcttctacacagtccccaggagtcgaccttgacccccttctcagttacacccatatgtaaactatccataaccagggctcagtctacctcttcaggactccttacctctgttctgtttctccgtttctgctctcccagttcccatcatcctcttgcctggactgttgtggcagcctccctgcctccattgccatttcgctccacttctcttccatgcaggtgccaaagtgttcacatgagactcctgatgccacactacagtctgaaagcattcagtgcctccccattacctacagaatgaaatctagagatttttgcatggctcctcccctgattccttctgcctgtctgtccttggctgccaccacctctcagacaccttatgcctcagccacactgatgaatgaatgaatctttaaaaagtaagccatgctatttaggcctccttgtttttgtccatgctgtcacctctggatgagatgttttacctgccttcatccacttggaagacttcaccttacatactgctgccagacctcacctcaagcatttttttaaattaaactgtctctggctactcctggcatgatcataattctgagcttgcctctccagcagcgaacacttggtatagaccttcatgatttcacagctaagttataagctcattgtgagtggcaactaaatcatctttttattttttattttattttatttttggtaggaggctgagcccggggtggcagcaggatgcggtaggcgcttttctaaatgcccagcacagataataggtccttaataaatatttatttgttagctgtccatggagctgtcaaccctctctagaataagccacagtttatagcacagcaacaaggtagacagaacaacaactacatggcaggtagcctgagattaaattggacgatgaagtagacgtatttgggatgcctaggacagagttattgaacctgactgggttctgaattccatgaggctgctgtccctaaggtcatcatttagttctgtgtaaatcccaaagtccttacattggccctcaaggcccagtgtgatctgtctgtccacccccatgcctttggtactgatcaccttccaggctcttcctttctgattctgctctggccatccagcctctcagctgttcatgcaataatgagccaggacattcacaaccaggccattttccttcctcctgcctgaaatgttcctcccccagatatccatgtagctcactttcttatctcctttttctttctcagatgtaaccttttcaggggtgccttccttttcttttcttttttttttttttgagacaagagtctcgctctgtagcccaggctggagtgcagtggcgtgatctctgctcactgcaagcaccttccttagccactatttaaaatataaattcccccatcctcctccttccaacctgtttctctctataactcttaaatgttccatgtgattttaggtattttattcactactgtatcctaggtactaaaatagagcctaactcacagtaaccattcagtaaatgtttattgaataaattaatgaatccgtctgacatgtgcaacagcttttcctatgtatccaacagatacatttctctttgaattatctttacgtccatgttctaatttcagatctgggagctggttaatgtctgactttagtcaaacatgttctggattcagagtcatttatcttgggtttcactcctggctctgttactttctaattatatgaccttgagtgagtcattcaatttttttaggcccggttattcccatttataaaaacaggcctagtgatacctagtgaattactaggagtataacaaacatgtcaacagctatcgagttctataagcatgttattcaataacactttttatctactatctgtgcaatgaattgaagaaacaacattgaattaagatgagtttgaacataatcgtcaaacagatatggatttgaattatgtctctaccccttattagctatgtgactctgaaaacctgggttctgctctttttctgtaaatacataggatattttatctcacaactgattgaaatatcaaatgagtaatgtgtcatgtttcaataattctaagatacatatttttcacattccagaaatcagtacacattttacaatcaatgatatctttggttcaataagatgtggtatcctcttcaaagcttttatatgtgaagctggatggtaattatggtttagaatcttccaggtcactctgacaattttaagatgtttacctctcttcctctattgggaaaaagtagcttctactgactaatgataatgtggttttgtcttaaaacgtttaatagccattcttttgtggattgtctttaaaatttgtttcctgattttacccaaaagaaaagaaaagataagatacatttttaaagcattaacaacagaataatttgctcaatttatttcttctcaagaataggctggcatttggtttttcggggtctctctacctgtgtgtttgcctcagtttggtttacactttctcttgcctttggtttgatcatggaggacaagaatagacgaatatcctggcaacctcagcaactgcactttaacataatatggttgctaggagaaaagggtggtagcagcacttgagaggaagtgtggctctgctgtcctggaggagccggtgacagaagccaacagctcacaacagcatcctccaccccgccttctgctgaaggtcacggaaatataactatcgtatcagtggtaataattatggcatatattaaataaattatgaacacaaagggaataaaaagttacttctagagatgtcatcataaagatatgaaacatctcagcccattattccttaaccactgtttgattaaactgaaactcctaatgctgtgttacagtccagcagcaggtcattactcaaatgttagatcctcctgtatatcttgtgatttattgtattgtccctggttttcagctaacgaaattggaaaagaataactgaagagtgctgtctgggttattgtaagaaattctacacccattagccatattctttattcactgagctataaaaattctgagatggatgtaatataccaccataatgcttttcaatagcaaaagcttgttgtagaattcattttattcattcagcagttatggctgagagtctaccaactgccagccactgagtatcagggcagtgactaaaaataaatattttaagatagaatgcataaaacaagacacatacacaatgaacatggaatgcctaatgtttgcattgtagtttttctttatttgaagggcacaacaaaatgctttgggcctaacccttattagcatttgaaagaaagtaatattcagaaaagaaaaaacattcgaggatctgcccacataggccaggcctcagttgacaactgtgattagattcctccacatgtagagaggggcctggagaaactctaaggaaccatctctgtgacattgacagcgttactcactcactatcatgagaacggcatgggggaagctgcccccatgatccaatcacctctcaccaggtccctccctcaacacgagatgagatttgagtgggacacagagccaaaccatatcagaccctgtttgttttactagtaaagatatgtatcaatatatagagttccagtataattgattggtttgttcctgcatagtccaaatcacattggtaagaatgtgacaactctagaactagtctgtctgaattttcacacaggttcacttacatacatacatgttattcttgtaattttacttgacaggtaagatgtgttaattttgcctgttttacccctagagaaaaactagagacaaagtgtgtctctgtcatgttccatttcctgtcctccttgctggtgtcccatcagactctctcagagcatcagctggggtccaactgttagcactgagttaagtgataaggcttatcattttccttaatagaagactgtgcagaagcaaaatgccttcaagtacaaaggcagatcgttgcattgatggcagaaatgccaaacaatggatttgataccttgttggtaggtaccaattcataaccacctgtattagtccattttcacactgctataaagaactacctgagattaggtaatttatcaaggaaatgtttagttgactcacagttctgcagacttaacaggaagcatgacttgggggtctcaggaaaacttataatcatggcagaaggtgacggggaaacaaggcatgtcttcttttggtggcaggagagagagagagagagtgaagggggaagtaccacatactttcaaacaaccagatcttacgagaactcactcactatcacaagaacagcaaggaggaagtctgcccccatgattcagtcacctcccaccagacccctccctcaacatgtggggattactgttcaagatgagacttgggtggggacgcagagccaaaccatatcaccacataacatatgtagtcaccaacagtagcatatactgttaactgctaaggccaaccctaccagtctccagttccattttatgaaggaattcttccgtatatagaaatgacatctgccatcacttttaaatcggtagcatacaatatgatcactaatagatgcagtcttcccttggcctccatggcggattggttccatgaccacccgaggataaccacatccatgtacactcaagtgcccagttggccctgcaaaacccacatatgggaaaagtcagtgcttcttatactatgcagttttgcatcctgtgaatactgtacttgcaggtcacttttggttgaaaaaaataaaactgtgtataagtggactccgcagttcaaatccgtgttgttcaagggtcaactgtatagagtattcatagtctttgaaatctaacacactaggttcaaatttttattccgttgcttggaacatggacaaattacttaaatttttcaaaactcagatttcattttgttaaaagcaatacgatagccaaattaagtttaaccgagtttgagcaaagattgatttgtgaatctggtagcctctgagcctgaataggctcagagagactccagtacagccacatgttagaagatttatggacagaaaaaggaaagtgatgctcagaaaacagaactgagggcagaaacagccagattgggtacagcttggcatttgccttttttgaacgtgttttgaacagttgaccacctttggccaaaacttggagattggcacaagagtaggttacggtctgtttacaccttcatttaggttatagttcatgatgtctggggaaagctttaagccaaatttaaaatatttaaggggctgctttaggctaaacttgatttaacgacttctaaaatggagagaacatttacctggtagacattcctctaggaacgttcctataagaagtaagttagataaaaggaagacttctagcaataattcttagatatattggcatttaaactatttcctttttttctttcctttccttttttttctttttctttttaggtgatgggtaataattttacatacatataggatatagagtgatagtttgataatatgtgtatacaatgtataatgatcaaattgggataattagccttttgctgtatgaattctaattccagttctaacatttgattctagtcaaaggttgatacggagaattatgtcaggatataaacaagtatctgggagaaataacaagtttctggaagaaagaacagataaactatgtgatgaataggagtttattattgcctcttacaaaaaatatatgatgtagacaagaaaaacgtggcagtatgtgcacataaataaaattaatttggtctttaactacataaattgcctgatattagcctcatataaaatttggattaatcagaatgcccagggtatgtagtctttagataaatggtctgccaggttaattaaggcttctttatttattaagtcttctttaatttcttaggaaaaattattgccaaattgaaagtgtattaatttccctttctgccctatcaaggagaatgtactaaatatagcccttgatttgggaactagtagcatcttgaaaatatcgttattaaaagctgttctcatataacaagctatagattgaaacagaaactggaagtagagtcgctatgtgacatttgagggactgggtgccaggtgctgtgataagccctttcatacatattttcttatttaatcttcacccactctgaaagtgcttttctgcttgtggaataataattgtacagataaggaaactgaagtgtagagaatttaggtaatctgcttacgcttagttactgaactaatgaatggtgcaaccagaaacaaatacaggacttctgattacaaatcctgacatcttttttttctacccaaacgcttttgtattgttcttcacaaagccacttgtgaaatacaaaatcactcagattccagcaagggagaaacttggtatggacaaaatgcacacttcctctaggacagatacagcaattttttttccgaatatattttagaaaagggtttgtctcacttatgcttctctaattatagcagggtaaaaaaaataattcaagttaagtcagggtaatacttatttgaacttaattgtctgtacagagatatttaaaatttagcccaaatattctccactaagtcttcaaataaagattaattaaaagtcctaaagctatctaaacataaatcaataagtagtaaatgttaaaaataaagagacaaagttgcttttctctcttgctaggagaaaaagagaaggtgaagcatgaaagtcatgctttcattttaaaagtatgtgcagagtgagtagatggcacttttatttcaactaaatcatgtgtatttagtgtctgtgtatcttactggtgtgttcattttcatttttcaatccactgtatctcaagtgatcagataattcatcatccaagtcaatttcattttagaacgtgaaaaggggcactggaaacattttttttggacggggggacaagagatacaaccatgaacatctccaagcaaatcagaataaatgatcacttaacattgaccccaaaaatctgctgctctagtatttttgtcggttccttctcttttactccatcaatgcaccaggtgtagttctggctaattttctggtttataatgtcaatttcagattcaggtttagtctgttaagatcatagaatgatagtattcttattggaagcaactttattaaaaatctgatttttgaggtccccttatgtggcagacaaccccacactttaacttgactttgacttttaaaacagagttgccacccggcatctgatacattgattaaaccctgtttactttgaactctttgtggttcctctcaattgcctgtcccttaggtttataattcatggagagaagcaaagtagcacaggacttccctgaggtagctgatcaccatgtggggggctgagaccacagaaatcactgcatgaaagatacaataatgatataagaaggagacaagcaaagtgccaaacaaaagcaggtattttataacattttagaatcaataaatatgttgaatgcatattcggttttaagagtgggaagtgttaaaatctggaataaatttttccaaaacaaatttaagtgagaaatctaaaagcagtggttcctgatatgtcatcattgaagatattagttggtcatcatggaaatgtttactttctctccccttatataagccactacaggaactcctcctgactaaggtcaccccctcatccatactccaatacctgaaagactctatatttccctcttttattcctgtaacccacttctctttaattgctgataggccttcagcagcagcagtaatcactgtacatccaccctcttttctggatactccttttactttctcgatctaagaaacctgacttttccattaagtcattactttcctggcagctcttggaagtgatagtttttcacccgtttctaccactacccaagaggcagaaaagaggcaatgaggagtgagaagaattacttattccacctattgaacagtggtagaaaggggtgaaaaactgtcatttgcaagagctcccttaaaatctccaaatttgagccccacatcatcagattagatcaccctgtaccactcattattgccatcattttcttactcctgtgtcactcaccctaattttcaccaatcttcactccaggcatactgtcgctctcacaaccttcctcctctttctaatcacttcagagatccctcctagagtttcttgaccttctctttcctagtgatcttgtcctccacactatactagacattcactcccatgtcatatctccttagactgaggcatgaattcagtctacaacactgagattcttctcagtgttgcccaagtctttgactccactgcacgccctgctcccaggcttccaaggatcctttggctgcacaaaggacctaaaattcatgaacttactgttctttagtcccttaatgtcctatcattcctgggtgccaaagttttcttttaaaaaaaatcatttataaatcactattgtgggaggctgcggcaggagaattgcttgagcctaggaggtggaggttgcagtgagctgagatggtgccactgcactccagcctgggcgactcagattctgtctcccaaaaaaaaaaaaaaaaaaaaaaaaaaaatcaaaaaaacgctattgtctaagccctaccaagcacataatggttgttcaataaccattgaattaaaggagagaaaacatttgggatcaaaatttacatccataggtcatttttccttgcttttgctcataagaaatatttgataattgtttcatgcaattacaaacattttattaaaagccacaaagaatagctgactagtttactttttccatgattaaggaacaaataaatcaaagtgcctgttaagctattacgttttgttctgaagttgcaagccaacaagttgcaacttgttgaaacagccagaaaacaaacaggttcttgatgcttcccctattgtcaatgttgttatatttagaggaagaggccctggtatgaagaagggagagtccactttgggccatgtttttcagatgctgtctatcatctttctgaagtctttcaaaaaaagtaaatttacctgaaatagaaattaaagttagaagtgttcagttttgaataagtcatccaacctgaagacctaaaagccagttctatgaccctattattcatccaacttgatatgttaaaaggagtaatataaaatattcctcatagaaaaaatttcctaaagtttacatacattttacattttaatgtgaatttttacttatgtggcaacgatcatatagctgtgacagtctttgaattggaagggacttgagatcaacatctagtttgattgcttgcctgttacagaaaagtgaaaaggaagcccaaagagattaaacggccagcttgacgtgataaagaaatgaacacaaactgacactcagaatctccaatctgcagccactaatgcttattgagcatttaagtcgggagtaaacactttgccaagcactttacatgcattgcaaaaccctcagtgaggataggttttattgtcttaaatgaggaaacagcccagagaggctaaataacatttctatattacacagcaagttaacgacagagctagacctcagccacattgaactccacttttcctcagcacttgctactcttggctaacattatgcccttgcagatgatgatgtatcttccatctggcaggcctgctgaccctccttccctcgtcttagcagccagctgaaacatcatgacttggagaagccactccagccttcctctgagttccagtagcacgttgttcaaagctctgtcaaagctgtttatcttggaaattatttctacccagattataagatttctacccagatctttcttcccacaagactatttgctccttgaaaactcctgcttatcatttttccttacatttcttagacctaacacatatctagaacacagaagatgcctaccatgttaattggttgtgtattataacactacagacaaactgtgtgttttagaaagctgaagctgctttgaattttaagagatgaaaacaatttggatcctaagtatcatttgtaatgttttgcaaatcaagctatatattatagaccctaaagaattaagtgccttcccatacagagatttatgcgtccttttattcctcaacaaatatgaataatatgtataattagatcacttctcataatctgccaataaaattgcacatatagcattctggtaaccagtttgatatctttcctttttaaatacttactttagagaatcccatgaagtagttttcgaaattcaattttatatctctataaaataatgtatctaatatcccaaagcctgctatattacagattcaattattaagtgggtacatcttcctagagtaaatacacctggtatttaatttcaaaatttatttttttaagtgtgcatttttccagagcacaaagtagaaacattttaaattgtgaacataacaatactatttcagaaatgtttttcctattttattcatgttgtgttctttttgccacttcagttttaaaaaaatatctattacatggtgaccaagatataacacttaaatgttttaatagactatcttcaatatccaagaatatttcattatgaaacataatggttttctctttctgttactcaggatctcaatgattcgctgagaaataaacaaaaccaaatttcataaatactaacctaaccacaaaaaatgagccacttaaatttctatttttcccaaattattttcttaaaaacatgactctttcagaaattcccggaaacacataccaagccaaccatattaaactcttaatggatatatctgagattatgcatcattattaatatttttgtttttggagacaagtatttatcttcttttatgtatgaagattatgttaatcacaaaattcaattcacaattatattgtgaatgtaattataaaaagtgatttaaaatgtttaaaaattaaatattctaattcagaaattatttatagagctttcattgataaaactggttatactctttgaaagaaggtataaaagccctccatgaagatatgtgccatgtgtaaatgaggaagggaaaagaaagaaagagagccaaaaaattattttgagaccacctgccattctttctcccattgattgattgtgtaattttcaaattactgacatatcgagagtatctcaaaacactacaagaaaagcctgacaaaaaattaaaattattatgttgaagctgatctctttcctagtaatcctgagtcaaccttcttaaaagtgttcagtgttctgaattttcttatttgattttcaaaaagtatcaaaatcaaaccatggaaattaggtagagaaaagcaaaggtacaaggatgagaagttatctataatattatctaattatcaacattattatgatattatctaattaccaactttaaatgcatatcatttaaagagttcagtaggccactgagcacaatgctcacgcctgtaatccttgcacttcgggaggctgaagcgagtggattgcttgagcccaggagttcaaaaccagcctggccaacatagcaaaaccccatctctgctaaaaaaaatacaaaaattagccgggcgtggtggtatgtgcctgtggtcccggctacccaggaggctgaggcatgagaatcgcttgaacccgggaggcagagattgcagtgagccaagatcatgccactgcactccagcctgggcgacagaatgagagtcagtcaaaaaaaaaaaaagttcagtatagatgtgtgtaatatatttaggcatagtacatatggaaagcctcctccattgatgataccagatattacataatcgtatttatataatgcactttcatatacattgtgacatttgggcccgagaacaatcctgtggggtactagagaatttcattcctgttttcacagttgggaaaactaaggctaagtaaatttaagtgacttgtcaaagattacccagggatttagtataggtagggctgaagttcaagtcccctgactgcaagatcaatgatcttttcactagagcactttgagtctccagaaagctgcaaaaggaaatttattgtatattaatccccttatctaccaagtcaagattgtgttgagtaggtgccattctgggtgcctttctgttctctttgactacgtggattctgtaaagtgtgtgtacgatttatcctcccccttaggaaccttgcccgaaatgtattccagtattctcaccactttttcccttgtttagtcctcatccttaaagtaaggcaagaaatgatcataatcaggagttgagtcccttgcctggtactgaagaagcttgtggaagattgtggaagataaagtgaacattttcctagtggaaaaaagaaagatgaaccaaaccaagactatagtcgcaaatattgcattgacttacaaaaaggttcaccacactgggtaccagtgagaagtcatccttggagaaccatgagtttcagagatacagagaaaatcagatcagattgataatctaaaatgcagttcatctgcctgtagatagcatgaacgcaccataaaaagagccattgtttttatagccattcacacaatagccactgttttcatagccattaaatagctattaatgcaaacctctattgtattaatgactattcaaaattagaatcaaatgagacactagatgtatgatatcttaaaaaataaaagaatgtttcaagtacataatacttggttggcagactaattaattcttgataataatatttcctaagtagcatctttatgttttttggtttctttaagttatttttagtctttgttaggactctctcccctgatagaggaagcgtggaaattgagtaatctgaagccctggtagtgtcaggagttagtcagtccatttccccccacctttcactggttttcaaatgaaagcgaatcatagagggaaattgaaaccataactgcttctgtaacactttgttccttagggggtagctggactaaaaggatgcacaacagcaaaacgcacttaagttacaagttatatgagtcatcagacactgtttgtataattccaaaacattcacaggctaaattgaaccaggataatttgtgagcaatgttctgacctctagcatttccaagtcttatttgactctgtagctgagaggtattttttaagtgtgccactttagttttgtggcatcccaagcccattccgcaccaagccatatataattgtacatgttttatccaaaaggcagaatgagtaaagatgggactggaggcgggtggagacaaaaggcacgctgtgacaaaacaaccacattaactcacaggcagttgctttagagaactgataccaaaatactgtagtttcctagagagagcttcatgaaacatattggtaagaaacttcagtgtcaaaagccaaacagcaaactctcttttgacttgtcctaaagcagtgttacctgagtcttcaactgcttccttcaaaatcgtatagttaaatttgtaccttggtgtttagatatatcaacatgacagcattttatacaggcaaagaagtacccaaagtgaacggttctatgccccgtaaaatttgaacacaggacttgtgtaggtgggtttaaataagctgaattatgtctatatttttaaaagacaaaaattcaaagagtaagtccagtaatcttttggaatttttttaatgattggcttaagagtttcaggtagtaataaatatagtggtaaatatcgatcttgagatatatccagctgaatctggacatcgcatttctactagttttcccaaaggtgggaatttttttctgttttatctaaaaagctcgtggcttgatctaaagatgtgtctggtcaaatattgattaaaaattgagattcttgtttttcatttccccagatttacagaatatgattaaatggaaacaatgttttaaggtcaagtacttttattacaatctttgaagtatgccggctgggcatggtggctcctgcctgtaatcctagcactttgggaggccaaggcgggcagatcacttgaggtcaagagtccgagaccagcctgggtaacatggagaaaccccgtctctactaaaaatacaaaaattagccatgtgtagtggcacacatctgtaacctcagctgctcaggaggctgaggcaggagaattgcttgaacccaggagacagagtttgcagtgagccaagattgcacctgtgtgcaatcctgtgtgacagagcctgtgtgacagagcctgtgtactccagcctgtgtgacagagtgagactccgtctcaaaaaaaaaaaaaaatctgtaaagtatggatgttaagtgtcatatctttgcataatatgtagttatggagattttagctcaacagccattaatgaagacattttcttaaaaatattcatgtgtttacacttggcaaaatcatttgagatggttctccaaactagccattatcttcatgttcaagagtggaatgcaacatctcaggaaaccaggggagtgtattttagaatcacttgtgcctttagattgttttcctaggcagcaacaacatgtgaatatcattctgaagtaagattaatgagtgggaatctatcccaggttcatgctatttctaaaccaaattctttttcccttgtaactttctggctatataattaaggaaatgcaaattccaaaattttctttaaaatatatataaatgtttacattacttggtatttatgaatattttcatccttgcctaaatcattgatttattatttttaaattgttttgttaaatggtcttactttgttaaatgttcttattgtagggcataagccaccagaggaaaatgtgtacagtagtccctttatcctcaggggattagttccaagacccctgtggacacctgaaaccacagaaccctatatatatatactatgtttttttactgaaccctgtatgtgctgtgttttttcaatctgattactgaaacagctgtgactgatggaaggtagcatatacagcatggacacgctggacaaagggatgattcacatcctgggctggagacagcgtgagacttaatcatgctgctcagaacagtgcacaatttcaatcttatgcattgtttatttctgcaattttctttcctttttttttgtgacaaggcctcatttcgttgcccaggctggagtgtagtggctcaatcatagctcactgcagccctgcagcctccaattcctgggttcaagtgatcctcctgcctcagtctcctgagtagctggaactacaggggtgtgccaccacggctggctacttttttttttttttttttttcagtagagatgaggtttcactattgcccaggctgttgtcaaactcctgggcccagcagatcctactgcctcggcctcctgaagtccttgaattacagatgtgagccaccatgccgggcctggaattttcgatttaatatttttggaccatagttgaccttgagtaactaaaaccacagaaagccaaaccacagttaagagagtcgggtattatatttttacctctacctgttttagaagcaaacaccttcagtaaccaagaagttaccagtttcccaacttttcctttttcataaattgataataatttttatcttagctaaactgatcggtttccttaacatcatacagcagatagcagttatgaaaaggaaaatttaaactgggaataaaaaatgattattcatacactgttcaatccttcagttaatctaagagaagcagttaatcaagagtaagatgctgctgccaagggagttgtctgctaatgattatgtggactagacactgatgcctggaaaagatttattaacagtttatcttttatgtggaaaaaaatattcataacacatttggtagacttaatctagacatattaaccagcatgctataaaagttacaaaataatttttaaaattatatatacttatattacatatacaggtataggtgttttttaaaaaacttaatgcatctttatcttttctctacagtcagttaaactattaccagatttatttatttaacagcttataaaatatgcagtgatagcagagaaaaactaagtccaaacagatcatgaatgtggttaatttcccttaggaaaaaaaaaatcaccaagtcgtctttatcaacttcagaataacactttttgaacacatctacttagattttctaaatatcattttcttacacgcagactaaagtaccatgtctccttaatgtgttgatggcagaagcaacattcactaaatgactggaccacttcctaattgttcattttgactgcttaatcaccagcattacagttgggttagatccattattttcatttttatcaaaaatggacttatttctatttctagatgaactcttagagttctaatttcaaaaatataaatgttttttattaattggattctattggcaaaaaccacatatgtctacttccccctactcaaacctcttaataagaaataaatatatatacatatatacatatatacatatatacctatgcacatttgtaaaatgtgtttcataatgcatgcataccaataatgcagaaagaaaaaaaaaagtgtaccattgtgatcagagactttgaagcgtccctaaaagacacactataagaaaaaaagcacagtccaaacagtgtttgaaaaaaatccttttataggtgggagcagttcttgagattctgcaaacacatagtcacaaaatacacaaagtaggatgtgttccagggaaaatcattaggtgagcaatttcaaatagttgaaatattactcgtttctttttcccttacaataatctgcggacagctgcagtgtttaccctaggccaaagtactgaatctagctaaaaatacatggtactatctcagggaggtctaatctgaaatatgaatggataaactattttggatatacccccaaaataagctacctgcacagttacttccagtatgccacactctgcaccccacagtcaccaaaagcatctgcacttgggcaaataaggaatctctcatgccaggaagagtacaaggaagaccaccagtaccatgaaagagatgccaacaagctgaagaactgacacctgagaaaacaaaataaaagactctaacataagaataatgatttcctcagtttataagatccaaatatctcgcttataaaataaacatgtaaaaaggaaacaattagacatattgggaataaaaaagcaatttaagaaaaatgtgctttatttaaatttaggcatttatttgtaaacttatgaataattggccaagttcaatgcatatgaaatctttaatcagagtaacaaaataagggttcagtcttatatcaaactcaacatctgtattagttatttactgttatataacaaattgccccaaaatttaggagcaaaaccaataaatactatctcacagttcctatgggtcaggaattgaggcacagtttacctgagtgcttctggcttagaacatctcacaaagctgtaattaaggtgttcgctgtgggcaacagtaatctcaaggctcaactagggaaaaattcacttccaaactcacttacgtggatgttagcaggagacccctagtccaccctgattgttggtcctctagcaaggactgtatcagttccttgctacctgtgccctggcatgaaatgacaaagtgaggaatggaagggagagggagcccaaaacagaagccatgatcttttaataacctaaccttggaagcaacatctcatcactttggtcttattctgttccttagaggtgagtcagtaaatgtaacccacattcaaggggagaggattatacattggtgtggaatacttgaaggcagggatcattatgggtgatctcaaggtcctcagaagtcttctccctttacataatcacctggaaattagatccagggatggagaaggcttcttgggtagtttcttaattagagctcattaagtatcctctctcttcactgcagactgaagagatgagacattatctgcctcctacacacccaacatacagtggtgagacacacaaaggataactgcttataaacatttcagaaaggggaaatggaaagctcaaaaaagccactgattcttagaaatcctgacatccaactgggcaaatgttgaaagttcttcattagattgcaaagcctagaaatgattttccatggctctcagatctgcctgagttatcttttctttactttgggatagcagcatgtgtttgcagctgactagtatgtgtatttgtttttatagaagattagaggatatagattcgatagatagctttcgatagatagtcaaacattaagcattattcctaggttgtgaaatatttttcatcattatgtatatctgtgttttctacatcatctccagtacacatttttagctgtttgtttgtttgtttgttttagacggagtctcactctgttgcccaggctggagtgcagtggcacgatcttggctcactgcaacctctgcctccaagtgattctcctgtctcaccctcctgagtagctgggattacaagcgtgcaccaccacgcccagctaatttttgtatttttagtagagatggggtttcgccatgttggccaggttgatctcaaactcctgaccttaggtgatctgcccgcctcagcctcccaaagtgctgggattataggtgtgagccattgtgcccggccttttgtatttttcttaaggatgggagaaaacttacttaattcaaatacccaatgatgatgtaatgaactgatttttactatcagatcacaagaccaaaaaaagtgtaaattatactaccaacttactaattcatgtcaagaaatattactgctagcattcttttcctgcatgaataataatgtgaaagctaagtcataatgagaaggttgcatgataaactcctgggttcatatgggacatgtgtgtgtatgtttagtctagggcaagttatgttattaacctcgctgtatcttaatttcttcctctatatgatggagttagttaaataataatgcctacctcttgatgtgtttgtgacagttaagtgatttaatatattctgtgtgcttagaattttgcctgctgctattagcaatagtaataatggtgtgtaagcacatggaatcgaaagaagatacctgttctggaagcaacattgtaggacttagcgtttccttcaaggtggttataaatgtattatctatcaaagtgtttgtggcatgacttcttcctctagagatcgttcacagtttcttttcagcataacttacgggcaggccaatttataaagtgaaaaatgaaatcagtcatcactggtattttgttttaccctggtgatacaatagtaatttttttcatacttagaatgaactttcagatagcctatgagttataaaacatacttctaaaaccactacatcaaaatttatcattagttccaaaaatcaattcatattgagtatgatgaatcatggcatcatgtcattctgtgtttttttagtattttttcattttttctgtttagaaaaatacaagaatcagatgatcatgattcatgtgatgattaaatttataaaataattctaaaacaattattttagcagtaatcaggatagctgaaacccatgagttagtagggacgtaattatctttcagaagtctgtctctcagacatacacagataaatatgatcccatgaactcccaagaactttcctgaattgtcagacaataaaagtgaccaggttagaaggacagcctgccccctctacagttgtttttcttgtatgaatctctttaaataaagtcatttaaatctgcatggtaagctcatgattttcatacttgcagactgggtacatgggctctattttttaaagggtaatctcttggacacttaatggatttgttaaagaaaaaaatgtaagagtaatgaaggaaatgtagctatgaaacttcagtaatatttattaatgccattcatcgttacggagagaatcagacattttgtgatttttctttcagagttgtgctactcaaaagttattatccttgggactaatcctggtatgtgactgatagcttctgatcagcaacagaatataaattaatgcactgcttcccttattcttttgcaagccccttatctcagtgtgaaccggtaataaacattttacagactggaactttgagcagtactgagctggagtattgcaggtgacgtcacttctgtttcctgccctctgtacatgttatggcacaagggtctggttttgacccagctgctcatttccagtgttatcctgatggaattcacttaagtgctttgtatcttggtcttctctgcgtgaggaggatgtggtacctgataatctctgaagtccctcgaagagctataattcaaatttatgcaatgattacatttacgttagttatagccatggctagcaatagagaaaaggctaagtcaatcatggaaattaaatatcagtatcaaagtgttgactatggatactatacaagatagaaacatgattataataagtaaaacaaacagtatgtcctgtgccatttgtatatataccttactacaaccatggaaaagtacatataagagagaagactgagcgtaaattaaaacacagttttaaagcattctgaaactatgacttgtacattcattttgtttctttatctgaattttcgtaacgttatcttatttacaaatataaatacatagcatacaaacgtactcaaaaataatatccgtacaatttttaagtctttttctaagtactttaatggatggaactgccgtattttcactatttggaatttcctatggcatctctcagttccttgttcttgcaccacttaaggcttttccagagcaaatgtgtgtatacttttggccactctggtcaaagacaccattcgctggacagtgcttacaaaacgtcctattacattaatggaggcacagctcctcctagctaaagctgtctgtccacctctccttgagactgtattccagtcttctgaggaaccttaaatcacttccatttttaaaaataaaatttcctcccttaaccctgcagccttttccagctgttctctatcattcctttccctttcacaaccttttagaatgagtcatttaagccaagtggctccctttgctcacttctctgtccctcacccgccttcaatcagtccaccatcctatgtctctgttaacagcccagaccttctctggttgcagtgacccccatgtaattaaatccattgactctttatttctatgtcagttggttttagaatccactctagaataaaatagaaaacaaatttgttaagggattttatgtagcacccaggtctctaagagggccaggaagacaggctctataactgatcatctaggagtaagacccaaatggagcaactgtagagaaaacaccactgctacttctgttctgcattgataaagctccaggctggatggtagtagctctgctactctcatccttgagtaaccaaatccttctactaccttgtatgccagaagaccaattctccccattgtggctgtctcctccttctgctaaataaaggaaatagtcattcatcaaaatttcagtgagttattcatcactacatgctgacagcctgaggccacctgtcacacctgaatgttatgcatcaatactgcaaatattcctatttcataaaatgagatttacaatgatttttaatatttatgcatattttataggtgtgtgtatgtcttcaaaaataagccctttatcaggagagctgtattacagtttttcatgtggcaaaactgacattgtttatgcaaaatgagaataccattatataatttgtggcatcaacaaattcaagcaagttcagtttgccatttcagatttttctttgttaaaataaggctcctctgtttaaatgtaattgatgtggtagcaatactttacttgcatttcaattccaagatccaagccataaagtggtatttactgattcagtttcttgtttgtttccctttctgtcctcccctataaatattgtccaaaagttaatgaattgtgtccatcaaagattagtactaattaccttatttccataaaaacagacttaccactctgccagctttttcttctgcaagcttgcctgttaggaaatgatccattagttaaaaattaaaaagaaattagaaaatgtttgtctccataaatctggcaacggcatagaccttggtttgtttcggcttttttccaaaagagaattttaaaaaatctattatgacaactgtaactattttctttactctatttcctgaaagttaatgaagaaaactaattttcatagtctcatgatgtattctttgtaaacaagacacaaatgttttctcaccattgcaattcagataaacatttaattagagatacaatcttatcttggagaagatggtgacaataatttgtaggggagagtttcagaggagggaacttttcagataaagaacttcagaaatctgcctacggtctttttgagtctttccggagtactaggccatgaatgtaaaagtgaaattctacaaagccaagctaaaaaggagaagagctgtaaaccaaaagattcccaggtcttacagtaggcagaaagccattcagactccagccagaatggacacagagtccaaagtaatcacctggagcatttaatatggactctggtggggtcaggcctgctggtaggactgcactggccctggaatgatggctactctagactcatgcagtaaagcttaaatataggccttgattggtatgattaatggcctgtcaggactaagtctaacttccattaaaagatgagaacaaaatttttgtatctaatgatgtaaaattaacatagtatccagtgaaagattactagagatgcaaaaacacagtaaaatatgattcttagccaggagaaatatcatccaagagaaacagaattttaaaagaatgtagatatggaactagtatataaatagcatagcagttataacaatgtttaggaatttaaatgaaaacatgaacatgatgagaaggaaaatggcagatataaaaaaattacaaagtaaaactcataggtaaaaattcaaataaaaccattggatgggcttaacaaaagattagattgtggaaaaaatggaagatttagtgataattgaagatttagtgatagaatttatccagcttaagacacagagaggaaaaaaaatactgaaatgaaaattgacacagcctccgtgtcaagctgtgtaacatatatgtaattgaacttccagaatttggaagggagcagtgcacaaaatttatttgaagaactaatagccaacagttttccaaatttgatgaattctgtaaagtcacagttccaaagagttcaataaactccaagcaagataaaccacgccaatatacactattagtaaaagccagtaataaacagcagtcttaaaaagagccagaaaccagatacatgcacagtgtatggagaaacaaaagtaagtatgactacaaacttctcccaaacactatgcaagccagaagataatggaatgacattttaaagtgctgaaagaaacaaccaggaatctttatattctccccaatctatcgttcaagattgaagcctaaataaaagctttatccagtcatcaataactgagaaaatatgtgtcaaacagaactgtaatgcaagaagtattaaagttattcagccacaaagtaagtaataccatgtagaaacagatctgcacaaagcagtgaagtctgtcttaaatggaaaatgtgggtaaacatgaaatactttctttccttttctttttttccttaaatatttcttgattggttaaaacaaaaagagtaacatgtattgtaggattaataacatgtaaaaataccatgtaaaacaataatagcacagggaactgggggcatgtaaaatcaaagtatgctcaagaaagaaaaaagagggggaaaaaaagaaggagatgaggcaaatagaaaataaatggcaaggtggtagactaaaaccaaccgtataagtaatcactttaaatgcaaacggtctaaacgtttcacttagaagctagacattatcaagacccaaccatatacatgatctacaaaaatactcacttaaaatataaggtacaagtaggcaaagattaaaaggataaacaaagatatactgccaagtcagtaaccataagaaatctggaagaacatatgaatatcagagacctggagttcagaataaagaatacagccaaaaagaggacatttaatcaagaagacataacaatgataaatgtgcatgtaaacaataagaggacttcaaggtatccaaaaaggaaactaacagaactgacaggagaaacagaaaaattgacaataataattggagattttaacattcctttccgaataattggtagaacaagtagaaaggctagagaaaggataaagaagagtgaatagcactgtcagccaatctaattgaaatttataaaacactgcatccaaatgcagcagagtatacatccttttcaagtacacataaatatatatcacaatagatgctgagccattaaccaattattcttaaatttaaaaaaatctaaatttaaggtaaaattttaaatatacacagtatatttattccaaaatggaattaaattagaaattaacaagagaaagatatctgaaaaatacaacaaatagtagtcaaactacacctttccaaataaatcatggattaaaaaaaaaacaggagaaatgagaaaatgttttgaactgaatgaaaataacaatttttataatgcagctaaagtagtgcttaggtgacattttacagcattcaatgctttttacagcattcaatgcttcttatgttagtaaggaagaaagaactcaattacctacaatttcaaaaaaataagctaaaataataagagaaattttagttcaaaattagaatgaaataatgatttaaggcagaaatcatgaaaatcaggcaaacagaattgataaaattaatacaatattgataatcataatgattttagattagaagtcataaaaatccagcaaacaatagagattattgataaaagatggttaactgtaataataataaaactgataaacctctaatgagactgaaggggagggaacagaaattaccaatatcaagaatgaaaaaaagaggagggtagcgcgataaatcttataattattgaaagaataaagaaatgctatcagcaactttatgccaatgatgaacagcttacataaatttcttgaaagacatcaaaatgagaaacagaggctgggcatggtggcgcacgcctgtaatcccagcactttgggaggccgaggcaggctgatcaggaggtcaagagatggagaccttcctggccaacatggtgaaaccccgtctctactaaaaatacaaaaattagctgggtatggtggtgtgtgcctgtagtcccagctactcaggaggctgagtcaggagaatcacttgaacccagaaggcggaggttgcagtgagctgagatcgcaccactgccctccagcctggcgacagagcaagactccgtctaaaaaaataaataaaaataaaaaacagaaaaatctaaatgtctctataactattaagtttggaatccaaaactttaaaacttctccccaaataaggtccaaataactggttaattatctcaaatatttaaagaattaatatgaatcttcacaaagtatttcaaaaaataaaaggaggaacacttctcaattcatttaatgagaccatcactgcccttgtatgaacattaaattaaaaaaacctacagatcaatatcctttatattgatagatacaaaaaacctttaaaatatattagctattcatatccagcaatatatagaaaagataagagatcataacaaactgaggtttattccaggattatgagtttgatttgatacttcaaagtcagttaatagaatttcttgtattagtgaaataaaaaagaaagccatatgatcacatcagtacatatttaagaaattacaaaattcaacattaatttgtgattaaaaagaaattagcaaagtagaaatagaattcccacaatctgttagcatttatgacaaatcaatagcaaacaccacaacagtggtgaaatctgcttcctttttattatgattaagaacaaaccaagaatgttggccaggcgctgcggctcatacctgtaatcctagcattttgggaggcagaagcgggcagatcacctgaggtcaggagttcaagaccagcctggacaacatggtgaaacctcatctctgctaaaaatacaaagattagccagatgtggtgtcacatgcctgtagtcccagctactcaggaggctgaggcaggagaattgcttgaacccggcaggcagagattgcagtgagccacattggaccactgcactccagcctgggtgacagagcaagactctatctcaaaaaaaaaaaaaatttatcacttcttttcaacattgttttagatactctaaccagtgtaataaggtgagaaaaagaaatacagatagaaaaggaagaagaaaagctgcctttatttatagaagacatggtttttgtaggatatcctgaggattttttttttcttaactactagagttaagatgtaaatttagtcaggatacaaaattaagatgccaaagcctactgtatttctgtatgctggcaatgaatgactagaaattggaactaaatgataccatttataatattacttaaaatctgaaatatatatagataaatctttttacagtatgtaatgccatttaccaaaagcgcctgacattgttttcatttatatgattgaaaataaagttgctaaaagtataaattttgttaacctcattaatttatagaaaagtgagccagaaagttttatgattactcaatatatcacattaataaagtattattttactatataaaattatgacaccaacttttaaaagcaatttgtaagtttatattgtttcttatgtgtcattataaaccctattgtattttataagtaataaaatatttttaaaaggaaaaaatgtgcaagacctaaactctgaaaaaacaataaaacagcactgagaaatttaaaaagatataaatatatgaagagataccatgttcatggaccagtagagttaatatttttaggacctttaatttcccctagttaatctaattcaacctcaatgaagatcccaaaaggttttttgtagaaattgacaaagtgattctataaatgtatacagaaatgcaaagcatccagactatccaaaacaattttgaaatagaagcacaaagtagagaggcttacaaaagctgatgataaatttcctataaagatagtgtaagtcagctgggcgcagtggctcagtaatcccagcactttgggaggccaaggcaggcaaatcacctgaggtcaggagttcgagaccagcctggcccacattgtgaatcgccttctccactaaaaatacaaaaataagccagacgtggtggtgggcgcctggaatcccaactacttgggaggctgaggcaggagaattgcttgaacctgggaggcagaggttgcgttgagctgagatcatgccattgcaccccagcttgggtgatggagcgagtctctgtctcaaaaaaaaaaaataaaaaagatactgtaagtcatttgctcacattagagactccaaatataaactcacagatatatggtcagtatgtcttggaagacaaaaagcataagccatgagagaaaaaaattaataaatttaatttcatcataattctaagtagctacaatttagttttgttgtcaatgataattttcttccttttacttttttgccccaactttctcattatgaaattttaaaacatacagaaagatataccacaatttagttttgttgtcaatgataattttcttccttttattttttgccccgactttctaataatgacattttaaaacctacagaaagatataccatttaaaaggccacagatgtcataaaactactgctgaactacttcagtatatattatcaaagaataaaggccatctcctacttaatcacagtaccattatcacagctagtcaaattagcaataattctatagtctcatctaatatccagagtttccccaattgtcccaactattatatacagctatttttttcccatgcaggatctaatccaaactcacctagaacaatctccctgtatttttcccctacacagcactgattttgcaaggagcccaagagaactgtattttagaaattcccatgtttgatatgtcttattgtttcttcttaatatcattcaacttcttcctttgtcttttttgtttctgtaacttgaaaattaggtctagaaatttggtgatattcaagttaaatactttgtgggaagactagtagatgagtgagtatctcctgttgcatcagttatgaggcacacaatgtcaggtggtccctcattagtgatgttttctaaaagtggtcactaaaacattgcttcatgatgaaagtacatttttttcccttataactagtgcagaatatgtgatatttgggccccatacaaaggttttgttctcagtctctcatgttacagtttcagaatccattggtaatcattgagtaaatcaattattttattggtgaaaaatgatgttttttcattctatcattagctcgcacttttctgtaagacgaagccttgtattcccctatttagtgttactatggacatgaatttgtatttattcagtctagtaaaatctattgcatatattatttgttagatgcttaaattactctgactttggccaggagcctcttcaaactgacttctgtttctgtttatgtgaacccattggtctttaagcatttctctactgtctggcacaagatgcccttggctcaccttaggatttttctgtgtcagaccttgaatcactatttctccatccagctctggttcctttttgtggggaatggtatttagaacccgggatccagatactctatatatgttcatcgctactgccgtatcattgcttctgagactttccagtggaaagagcaaggaaatacattttaaaaatcacagggtcctgtgaataattctaattcagttgcaatattacagtttttcttaacttctgtatttctcttttctcttatgttgataatattggttcataagaatattccatttacttaaatttttatatatttttgttattatattgtatataatagtttcataatgacaataacagtgtcactaccaacagaatcctaccaggtgaaattaagatttccttgtttatatccaaccaaggatatacagagtgtaatgtttaaaatttgcctaaatggattcttccatgtatagttatattaacaatttagcatatattaaggtttatttgtgtttgtattcagttttagaattaaaaaattttgagcattaaatacatagctcaaaagtcaaagttctgtaaaaagttacactctaagaaatctgacttctaactgtccctatttccactactgtattcccacccgcctactgtaaataagcactattaccatcggtttgtcccctatgtgtcattgttttgtaaaagtaagcaaatgtgtatgcaggtatgtatgaatgtgtatgtatgtgtatacacacacaaaaacttttcttttttatacacatacacaaatgaatacattgttttctttttcatttctcatttaacacatatgctgaaaattactcgatatcagtttatagagatctttctcatttttttgacagatgcacagttctccattttatagatgtgcagtgccctccagggagttttcttaggctctactaaccattcagactcagaagactctcagtctgcttagaaggataaaggatgagaaccctgggggcaacatcagttgtttctctctattgttccatgcagcagtccgtgccagtgacagcccactaggcagttcaagagctcttttctctaggtgacacatctcaggtgcaagaatgtgagatccacatcagacagggtagaggtagggatgggggaggcacccagcctcccacagaagccagtatctcttggaacagttgaatagacacagttttcagggtctccatgagacgtatgcccagttacaaaagtgaaggtacttataatttatttacaattctccctagttcagatgcaacttacaagtcagggtctcatttttatcagaagcaaaattgctggggtgtagttggtgttctacctttatcaagttgctaggattaatgttggacagttaaacaaaagtttaaacaaaagtttcagtttacttaaagctagattacctaatttatctttgcaaatactttttaaatataacacaaaataaaatgtatgaactcatttatctatattgtttcttactcatcatttcataaattcatccaagtgaaataatcagcccaatcttgctcttagtactaatcagcatccggggagggcagtgcagggtttcatgctgaactgcactaaaccgggagcagatgatggtccctgccttgccaagtctttcgtaaaagtgtgcttccaaagaagagcttaaagagtggattttagttttcttcccaaactgagatatccatatagaaagcagactaccagtcagtcagtaaataatctgtctctgataccaaccatggactgttgtatataccaaaaaatcctttttaaaatattagcccaattaatgatgagagcgaagattgctgacaacatccaatttacaaaaactaagaaggaatttctaataaaccgtatcctgtttataacatctatatacctggcaactatgaaggcagccttttcccccatcaattacggaattaaagaaacattttttaattccatctgctccacagttgtatcaacatggtaattaaagagttccagcgatttccaacatccattctgctttaacagggagttttgtagtgaggaagctgctggaaatgaagagtgttcttagtaactttttatgtgactggttaaagttaagaatgcagacccaaactaaatgaagaggatgcattaagagaaagattactcatgttgaattgattttgcctacctgttaaaaccctgaaacactaacttgcaatcaacagagcaagcactgctggctgtgctgattgtgtataaatgaacagccagaagtaaattcagtgttatacaaacaagccacagaaaacacgatcagttttggaaatgtaaaaaaattgtgtaagtttgtctcataagtaggggtagctcttttctggaggatgttggggttcatttcctcatcaagaatgttttaaacgctgaaaacaatcttgtttttatatatcgagtgacatgaaatacttgtcttaatagtgctaaaatgcaacggaattgttacacaacttgaggtagatctgagtttcatttccttcttattttaggtctggatattacacttagcaacatacagtaagcttgaaatctctctcattatattttatcatcaagcaatcagtacacagaacctgagggaaaatggtccaacaggacagtcctcctggctggatatccaccatttgcccctgcagaatattaccttctctccctttcctcctctgtcccaggagactgatctataatggttacatcaattggttggacccatagcaagcactgacaggagatgaaagggaggatggagtggctgggaatatttgtttcctgcacagtcacctaagctgatggcttctcttgacctacctatattcacagctttggtgggaagaccactctccacccatccctctctgtcactagattctgttaactactttctctccttgtgcctgcatgcctcagaagggtagtatcacctactgcttatcacctaatcccagggtgctgcactgtccctggggtttctcaacatttgccaacaccgtttttaaacaacccatttctaaacactctaagtttgactgcacccttggttactttctgggaccctgactgctaaaccttctttgatagagtatcctcagattttcaaaggcatgtctgtggcacctcaagctgaatcaaaaagtcgtagatgctaataagactctctaaagtggagcaagcccatttggaggaaaagacagttactgcatctcctgggctggggtggaggagggattgaaagagacaatggagcagagcaggatgattgcacagaagatgagagatgcatttccttatggtaattctagtgaaataacatttacactgttttctgaaatatattagaagcccattggtagatgcatttgcagtgaaggggacacctacatcctacaaactttcattacaaactaactcaatggaattgttatgtcatcgagatggaaagcaagacactgcctttggcctgatgtgtgtgtagtaggaacttaatacatgcatgtttgctgattttctgagtttgtaaagctttagttataagccataagacatatattttttaactttggatcaaatatttcacaactcatatgaaatggaaatcaaatactgtaagtttatgtgtgtgataaaccatgaacaggtattaagtgctgaatttataggctcccttgctgaataaaataatttaactctagtgattccaagttattacagaaaagtatggaagcctagaccatggaggaagattgacaattcatgcatcatggatggactcagccaaccaacctttcagggcatgaggcctctacttctgctagctgtgataacttcttgagccctctgagggcttagccctggaagtttgtgctagatcatgttgcctaggaattcttgacagagaaagaaggatcagagactctggagataccagtcttaaatttaaatgtgcagggatattaactggacatccagtaacgaagtgatctctctgatttcagtttccttatttataaaatggcaatgtctaccctataggtttgttacgagagttgtatgacaatctatgtaaaaactcctcaataaaagaagagctacgtgcatcccatttctatttaattatattacctatttctacccaactgggtaacacattgctgaagacctttacttcatgagactgacttttgctgagacctatgataacctatgtgtgttatttgttaatgctttaattacttacgaattatttggaatagagcaatgctattatatgttttccatcagtgtggtgaattgcttatattttttcatatttcttaatatttctgcttcttcatgacaaataatcatcattaactgagcagcctgggcagttggacactcccttagatgctgggaatacaagtaataatgtgataggattcttagcctcaaaagacttgtagagaaagtacaaaagtataaaaataaggagacttaacatcaattgacagctcactatgtgcccagtgctgtgctaactacaaagatcttattatttaatactcacaatccaaacaacaacctggtaaattaattaatatctcaattttataattgcatgacttagtgctcgaaatagtttagataacttgcccaaagagtaagaggtagaggtacagttttaactgtcagctactactataaaatagattatccctaacaatgctagttctgatatttgatacagacaagaagtgttagaacatggctactcaatatgtaatctgtgggcctgtgctcatttgcaaaacagttgttattggttattatttctctaaaccaataacaaagacagaaattgagaacaagcatttagaaacctttatagcaatttgacacagcagttttatgtctattaaatctaatagtgaaaactaattggggcttgtgttttgcaagtttttttcactttattattcatttttattgtatttgacaaaagtagtgctccatggctgattggaaatttaaaaacaaaacaacataaaaaccaccttggtcctacaccattgatagagtcactcttctaaccaggaggattagtgaggttggaaagtgtcatggatgaagtaggaattatgatgacaatatgaatagctgatgagagccaagtacctactctgtgcccattgttatgcttagtaccttatagtttatgtgtatgtgtgtttatagtactatattatatatatatgctcagtaccttatagtttatgtgtatgtgtgtttatatctatgtctatagactgtgtgtatatatattgatatatataagatatatatgagtgtgtgtatatgtacatatacacatatgtacatatacaatatgtacttatatattaagatatatatgagtgtgtatatatacatgtgtacatatacgtatatgtacatatgcgtatacacatgtacatatacgtatatatacatatacacatacgtgcatatacacatgtacatatatacacacatgtgtgtacatatacacgtgtatatacacatgtagatatacacatgtgcatgtacagatacacatgtacacatatgtacatatacgcatatgtacatatgcgtatatgggcatatgcatgttatatatgtattgtgtatatgtatatgtatgtgtatatatgtatatgtatatgtgtatatgtatatgtatgtgtatatatgtatatgtgtatatgtatatacatacacacatatacgtctatgtatgtgtatatgtatatgtgtatatatatatgtatatacacacacacacacacacacacacacacaatcttccatgtggtactgagggatggctgtatatatacagccagtatccatggaagattgattctagaacccccaagaatatcaaaactcttgatgttcaagtcccttacagttggtcctccatatccacaggtcctgtatgctcaggttttgagggatcagatcaaatccactgttaatttaatcacagatgtggaacccaaagttatggagagccaacttgtatacatagacataactatttaacatcctagaaatttataaagtagatatttgttgtgcctcctttatctgattatgttctatattttgctgccaatatccacttctctcccaagagttattctttgctaaaagctgaaccaactgggctgctttcattaccagtgctcttccatggatatgtgagaatagagaatcatcatacttccccacacccccaccaaaaaagaaaacaacttgtcattttacttattatttcttctgtatatcagagagtactttagtgggaggttgggaatagctgtgtcagggctgctgagtagagcctttattccttcatcatcatgcaaagtctttctagtagctgctgcccactcttcctggaatgagcaaaaatgttttgctatgtgaggagtgctgagtgaattgattctatcacttgtatacttcctggaagttgatgtgttttttaaaaaaacaaaaaggacaaagatggaaccagcatgagctttgtaacaggaccagtttgctgagaatacattatattaaaggtagaataatgggaagacatgattttgattcaacagacataataaataacgtactgaagtgaaagaagaccataaatcctctccaacaatttttttttagtttttaatttttgtggctacacagtagatacacacacacacacacacacacacacacacacgaggtgtatatatgtatggggtacatgaaatgttatgatacaggcatgcaattcataataattatatcatggagaacagcatatcctctcaagcatttatcctttgtgttacaaactatccaattatactcttttagtgattttaaaatgtacaattaagttattattaactacagtcacactgttgtgctatcaaatggtaggtcttattcattccttctaactattttttttccacccattatccatccccacctatctcccaccccacaccccaatacccttcctggcctctggtaaccatccctctactctctgtgtccatgaattcaattgttttgattttcagatcccacaaataagtgagaacatgcaatgtttttctttctgtacctggcttattttacttaacataatgaactccagttccattcatgttgttgcaaattacaggatctcattctttttatggctgaatattactccattgtgtatatgtaccatattttctttattcattctgtagctggacacttaggttgcttccaaatcttggctattgtaaacagtgccacaacaaacacgggagtgcagatatctcttcaatatgctgatttcctttcttttgggtatgtacccagcagtggggttgctggatcatatggtagctctacttttagtttttggaggaacctccaaactcttctccatagtggttgtagtaatttacgttctcagcaacagtgtacaatggttcccttttctccacatctttaccagcatttgttatggcctgtcttttggatataagcccttctaagtggggtgagatgatatctcattgtagctgtgatttgcatttctatgatgatctttgatgttgagcaaattttcacatgcctgtttgccgtctctctgtcttcttttgagaaatatctattcagatgttttgcccattttttgatcagattattatattttgtcctatgaatttgtttgatctttttatatattctggttatcaatcccttgtcagacaggcagtttgcaaatattgtcccccattatgtgacttgtcgtttcactatgttgattgtttcctttgttgtggagaagctttttaacttgatgtgatccctcttgactatttttgcgttggttgcctatgcttgtgggatactactcaggaatttttgtccagcccagtgtactagagatgttccctagtgttttcttgtaaaagtttcatagtctgatgtcttagatgaagtctttaattcattttgtttgtttgagatggagtctcactctgtcactcaggctggagtgcagtggcgcgatctcggttcactccaacctctgcctcctgggttcaagtgattctcctgccccagcctcccaagtagctgggactgcaggcatgcaccaccatgcccagctagttttttgtatttttagtagcaatggggggttcaccatgtttgtcaggctggtctcaaattcctgacctcaggtgatctacccgccttggcctcccaaagtgctgggattgcaggcatgagccacctttaattcattttgatttgattttttgtatatggtgaaagatagggatctagtttcattcttctgcgtttggatatccagtttttccagcaccatttattgaagagactgtcttttcctctgtgtatgttcttggtacctttgtcaaaaatgagttcattgtaggtgtgttgatttatttctggattctctattctgttctattgatctgtgtgtctgtttttatgccagtaccatgctgttttggttactatagctctgtagaataatttgaaatcaggtaatgtgattcctccagtttttctttttgctcagggtagctgtggcaattctgggtcttttgtggttccatataaattttaagatagcttttactatttctctgagaaatgtgtttggtactttgatagagattgcatagaatctttagattgtttggggtagtatggacattttaacaatattgattcttccaatccatggacaagaaataactttccattttttggtgtcctcttcaatttatttcatcagtgttttatgattttccttataaagatctttcactgctttggttaacttaattcctaggtatttaattttatttgtggttgttgtaatgggattactttttttggtttctttttcagattgtttgctgttggcatgtagaaatgctactgatttttctatgttgattttatacactgcaactttactgaatttatcagttctaatttttttttaagtggaatctttaggtttttccaaatataagatcatatcgtctgcaaacaaggaaaatttgacttcttcctttccaattcgaatgccctttatttctttctctaatctgattgctctactcaggacttccagtactatgtttaattatggtggttaaaatgtgcatccttgtcatgttccagattttagaggaaaggctttccatttttttcccattcagtatactagctgtgtttctgtcatatatggcttttattatgttgaagtatgtttcttctatacccggttttttgagggtttttaatcattaaggaatgttgaattttataatatcagatgatttttcagcatcaattgacatgttctttgtttgtttgttttgtttttgagacagagtctcactctgtcacccaggctggagtgcattggtgcgatctcagctcattgcaagctccgcctcccaggtacacgccattctcctgcctcagcctcccgagtagctgggactacaggtgcccaccaccacgccccgctaatttttgtatttttagtagagacagggtttcaccatgttagccaggatggtctcgatctcctgacctcttaatccaccctccttggcctcccaaagtgctgggattacaggtgtgagccaccgcgcccagctgacatgttcatatgttttttgtccttcattctgttgatgtgatatatcacattgatcgatttgcatatattgaattaatttttgcattctagggataaatcctactgggtcatgatgaatgatctttttaatgtattgttgaatttggtttgctagtattttgttgaggacttttgcatcaatagtcatcagatatattgacctgtagttttctttttttgatgtgtctttgtctggttttggtatcaagataatactggcctcatggaatggaagtattccctcctcctctatttttcagaatagtttgagtaggattgttattggttcttctttaaatgtttgatggaattcagtagtgaagccatcaggtcccaggcttttttttacagggagactttttattatgactttgatcttgttacttgttattgttcccaccaacttacattcttataatcttatgttcccaccaacagtgtacaatggttcccccttttctcctcatctgttctgattttggatttctttctggttcaatcgtggtaggttgtatgtgtctaagaatttgtccgtttcttctagattttccaatttatcagtacacggttactcatagtagcctctaatgatcctttgaatgtttgcggcatcagctgtaatgtctcctttttcatttttgactttgtttatttggatcttctctctttttttcttagtctagctaaaggttttcctattttgtttaacttttcaagaaaccaaatttttgtttcagtgatctttttttattgttttcctcatttcaaattcatttatttctctctgatctttattatttcttttcttctactaatttgaggtttggtattatcttgcttttctagttcttgaagatgcatcattaggttattcatttgaagtttttcttctttgttgatgtaggcacttacatctataaagttcactcttagtactgcttttactgtatcctataggttttggtgttttgtgttattataaccacttgttttgagaaatttctcaatttccttcttaatttcttcattgacccactggtcattcaggagcatgttgtttgatttccatatattttcatagtttccaaaattcctcttgttattgatttctagttttatttcattgagatcagaaaagatggttgatattatttcagttttttaatgttttaagacttgttttatgacctaacatgtgatctatccttgagaatgatccatgtgctgaggaaaagagtatgtgtgaaatgttctgtaaatatctgttaagtctgtttggtctatagtgcagattaagtctgatgattattgactttctgtctggaagacttatccaatgctgaaagtggagtgttgaagtctctagccattactgtactggggcctgtttctttagatctaatcatatttgctgtatatatctggttgttttatttatttctggttggatgcacatatatttaaaattgttatatcctcttgttgaattaccctctttatcattatatagtgaccttgtctcttcttacagtttttgtattgagattcattttgactgatataagtgtagctactcctgctcttttttgatttctgttggcatggaataccttattccatccctttattttaagtctatgtgtgtctttatagaagtctgtttcttataggcaacagatcaaggggtcttatgtttttatccattcaggcactctgtatgttttgattggagagtttagtccctttacattcgatgttattattgataagtaaggatttactcttgccattttgttgttttctggttgtactgtggtcttctctttcttctttctttccttcttgtcttcttttagtgaaggtgattttctctggtgacatgatttagtttcttgttttttgtattttttgtgcattcattgtatgtattttggtttgaggttaccatgaggcttgcaaatactatattattatccttaattttaaactgataacaacttaacactgtttgcataaacaaataaagaagcaaaatgaaaattaatgaacactctaggccttaacttcatcctcccagttttttttttttgagatgtagtcttgctctgttgaccaggctggactgtagtggcaggatctcagctcactgcaagctctgcctcctgagttcacactattctcctgcctcagcctgccgagtagctgggactacaggcgtccgccaccacacccggctaattttttgtatttttagtagagacggggtttcaccatgttagccaggatggtctcaatctcctcacctcatgatccacctgcctcagcctcccaaagtgctgggattacaggcatgagccaccgtgccttgcccatccccccactttttaactttttgtttctatttatatcttattgtactgtctatgtcttgaaaagttgttgaagttattatttttgactggttcatagtttagtctttctgcttagaataagagtagtttacataccacagttacaatgttatagtactctgtgtttttctgtgtactttcagtgagttttgtaccttcaggtgattacttattacttattaacttccttttctttctgattgaagtactctgttagcatttcttgtaagataggtctagtgttgatgaaatccttcagcttttgtttgtttgggaaagtctttatttctccttcatgtttgaaggatatttttgtcatatttattattctagggtaaaagtttttttttccttcagcactttacatatgttatgccactctctcctggcctgtaacatttccactgaaaagtctgctaccagatatattggaagtccattgtatgttgtttcttttctcttgctgcttttaggatcctttcttcatccttgacctttgggaatttatttattaaatcccttgcgataatcttctttgggttaaatctacttggtattctgtaaccttctataaccttcttgtaattggatattgatatctttctctaggtttgggaagttctctgttatccctttgaataaactttctacccttctctttctctaccttctctctaaggccaacaactcttagatttgccctgttgagtctattttctagatcctgtaggcatgcttcattgttttttattcttttttcttttttctcctctgactgcatatttccaaacagcctgtcttcaagttcattaattctttcttcagcttgatcaattctgcttttgagactcagatgcattcttcattatgccaattgcatttttcagctccagaatgtctgcttgattctttttaattatttcattatctttgttaaatttatctgatagaattctgaattccttctctgtgttctcttgaatttctttgggtttcctcaaaactgatattttgaattctctgtccgaaaggtcatatatctctgtttcttcaagattaatccttggtggcttatttagttcatttggtgaggtcctttttttcctacaactatcaacagtgtcttgatagttgtagatgtttgtctgtgtctgggcattaaagagttaagtatttattgtagtcgtcactgcctgggctcctttgtacccatccttctcaggataactttgcagataggacttgggtgttgtgatgttagctgtgtctgctttagggggcaccccgagcccagtaatgctgtggttcttgcagacttgtacaggtactgccttgatggtcctgggctctttagttagcaggtgatgaatcctgccaggactgggtgcttcccttcaaggcagcatgttcccttctggcccagggtgtgtctagcaatgtcatacagaagctagggccttaaaagagcacctcatgactccgattagtgccatatcctgtttggctgagctggtatccaagatgcaagacaaagtcttccccactcttccctctcctctcctcaagtggaaagaaggtatctattttggaaccacaagctgtgcagcctgtggttagaagaggggaataacagcattccagtagctggtagccaccctggctggtgtcttgataggtcacgtgcccctgagtctactatctctgcacccaattcagcactaggactcctgtaaaagttgtagtccttgtagcttagactgcctttcaagttcattagggccctagggtactttagcccacagtggcaaggtttgagggaactcaagttccagcctctgggagtagtgattcccctccagctagggctaatataaacacaccctctgtgggagggcatcagctgaatttggtccagttttcccttcttctctaacagtacaccactgagttcaaagccttacaattgttgtgttgtccctcccttagagcctagagatgctcttcacacctggccactgctgggggtagggaggagaggtggcagtttacatggtggttcaagtctgtttctctctacctcttcagtacctctttcagtgacatgatattaaaaccaggtattgtgagtatgcacctgatttttagttcttatgacgtgctcttcttgtgtagatagttgttaattggtgtccttgtgaagggtggggtgggcgggaggcacggggatctgccatcttgctccaccttctcaatgccatctttattcactctccaacaaatttttaccttgagtagaacacagattttttgaaaaggttaactgattatttgattctatctttcgtatagatatcagctaggtttaagacagaatatacagaatgtagctttggaaagcataatgtttgctctcatatgcttaatatctggagagatggccaagtaaagctgttcttcaatatacaggtattatgaagtacaaaagagagaatcacaggtaacctacattgttttagttgtaaaaaaaataacatataggtatgttacattaaacacaaacataaatgggatacatttcatgtgttttaactccttctggggatatttccacatagtattaatctcttcattcccatttaagatatttaaacattgtcttgtattgaatttccacagctgttatccctgtttgtataagtatcttaaatcattatatgaataataactattaggggaaacagtctctggaataccctttttcaaatgttattgtttttgttttgcatattttttcacattttaagtggtttttcttctttccttattttaaccttatcttctttacgtgtattgaaatattgagcatgtctgctctctgaaaaacagttttatgaatctcaaaatgaacatgtcacatagatgaaagtgctgtcagtattttcctaagtaaacacattatgactctatattaaacagagagtttttattttagaatggcacagtgaatgtaatagggccattctaaaggttcttgttgtcaccatgcagtatttctgacaaaagctgctctaactgtaatgcatttttgtccccattaagatgttcaccccaagctaatgctgctgttctaaaataaaacaaagcctgaataagtcaggtaaaaattggatttttaaaagcattactttgtccatatttgtcttccagtctttctaaaatttctaagcaattgaatgactttccacttcattttaactgtacatatctggcctctgttagagaacctaagtgctcacctacactagaaagatgccttctcattctccttttttcactcatttaacatacatttactgaactcactggttctcaaggttattcatgatgcttcttatcacatggcattctcaaaatactagcatcaaaataatttttaaatggttgttctagatgaaatactgggttcagaatttcataatgggtttttaaatatcactgcaagatagatttattgtgatagatttattgtgtatttggaattccaaaatacacaaacattagtaggcaccgacattttaagaaaaaaaaaaaagtgcgataaaccttagtagagacatttctcctgattagattatttttttcctctctgagcaaaatagaacaatggctccagctcacaaaatatcagtgcttcgttggaacttaattgaaacttataattattttttcttgtgtaccaagagtactaagatgaatgacccagcctctgccctcaaagagctcagagccttgtaggaaaaacctacaaatggcaaaactctaagtcagcagggaattacaggccaaagaagatggagcagtgctgggcaccttcccaaaggccaggagggtctgcaaagattttctgggggaagtgcctctgccaggtgctggtgagaccaaaaagggtgagactgtttaggatgtccgagtccagtgagagaagccagcttgtacataaatacaactcaaagtggcaggtgcacagtactatgtgtgaacactgagagggcctatttctgcccaaagagcagaaagagagggtgaaacacagaatagaagttcaacaagcccttaatcttttctctcacttggggcttcactaggacactccgtgtccttctgactctgggaaacagacttcccctgcacaccaatcacaatgcctagtaggtgagaccttcagggtcacaactcagtgtggcctgagccagtgcttcctaggtctcagtgacctgagacctgacctgtaactctgtattggttgatactgttaacatgcagattgagacacaggaagcctcaagtggggcttgagatcctcatttctaacaacctcccagatggtggaatgccacctgctggtccaggaactacattttgaatagcaaagacccaaattttgacttatgttaaaattgttatttggtaattaccaaatacatctatcacccttgcattgatatttaaaaacccattatgaaattctgaagaaatatcatcagctttttattgtaaatatggaaacagaagttggtccaggagtaataataacattaggaacaattgttacagttgggattacaaattatcaagtgcttttcacttggctccttgttacagttgttagtaaaaactagcaataaatagggtttcttttattccttacaattactgagtgaagtaaatattttcctattttgcaaacaaaggcagaggttaagtgactaattcaatgccacacagccagtacaaggcagaactttgtgattcaattccagatctctcttactccagagccagtaccccctaaagggcatagtcaaaagaagcaaatagaaagttgatagaagtgcagaataataagagtgaaaaatgtgatgacctttagcatagaaatggcttaaccttctggggatgaaaactagcagctgagctacacaaggtgcctctgtcaaacagctctgtcgaataatgcttttaaatgcgaccaatagatatacatgagccaaaacaaggaggcagctggtgctaatctgattcagtactttaataggggaaagcaccggagcaactattttatagtctttttatatatttatctgtaactaagtatatataaatgttatgaacatgaagagagaattgctgactcaccatcaagtgacatttcagtgaagactgtatatcaagtaggaaaagaaattacatgggtatattcactgatggagccagactgtgaccacccagagtaaggaccagaaccatattcttagtaattattcactctgaatgcacaaagaatttatttcttgaatttctgatcattttaatataatcataaaaatggcgattttgaaaaaaaaaaaatgcgctaacgagtatacccttccaggagtagtagtattactccaggacaactctttttaggtaaatgggtcatgaactaagaagtgacattgaaagcttgctcagttgcatagatatatgctggcttagctgaagcagggtagttatcagaaattttaaattgagaagtgagttgcttttcctcacaggaaaaattcgtcacaactaagaataactatctgtacttggtgaattgcttccttgtccaccccagtgctgaagtgggcttcacaaatttggcttatttagcagataactttgtggggccccacactgaatcaacaactacatggtaaaaccggatgctttcaacaaccatgacaagacagcgacggttataatgaagtttgattgttggataacgagttgattgtgggtactatgagtcactttagactcagttcatttacatgtgataaaaagtacagtgtcaatggtgaaataataaaccaaaccattagtctttcttcctcactgactaagcctttgtgtagaaccctgagataggaagatcccagccaatggatacaaaaactttacatcccaccatataagtgaaatgatctctcagcaggaagataatgatgaaaaccttcaacatctgtagcactaaaacactgaaccacactaactttttggcaacattatgaacaactctcctcagtgttaccttgaaagagctaccacatactgcgcacttactgtaattgcaaagatttgttccaagtatttatgtgtcaaattcattcagcccttatagcagaatggatgtacttatgtgttctattattatcaattattatctgccaatgaggaaacaaggataagaataggtaaagtcaggggtccccaacccctggtccatggacaggtattggtctgtggcctgttaggaactgggatacatagtaggaggtgagcagcaggccagcgagctttactacctgagctctgcctcccgtcaaatcagcagtggctttaaattcccataggagcatgaatcctgttgtgaactgcacatgtgagggatctaggttgcacactctttatgagaatgtaatgcctgatgatctgttgtcgtgtcccaacacccccagatgggagtgtctagttgcaggaaaacaagctgaaagctcccactgactctacattatggtgagttgcataattatttcattatatattacaatgtaataataatagaaataaagagcacaataaatgtaatgtgcttgaatcatcccaaaaccatcccccacacccatccgtggaaaaattgtcttccatgaaactggtccctggtgccagaaaagttggggaccgctggagtaactaaccaaaggtcatccagttgataacagaggcaagatttgtacagaggcagcctgactctagagcttgtttactcaccatattgtaatacagcttgggagtggtgatacgagagactgccctgtttatatttgtaagtttaagtcctaaaaatttggtgacttcaagagtgagatgagagctaattctgatgtgtagactcatttcttttccaattcagcctaattttccaaaattgatcttactgcaacggcatcttgaccattaagaaagatggaggagcattctttttcttcccaagttaagaatatgaagcttttatttttatatttatatataatatatatcaaaatacccagatgttatgtggattttaaaataaaatataagagtttacattgcagcaggtcattcagacttaatttttcccttcctctgtgagggatactttgggaaaggatgaggagcaccattcagacttgacactgtgctttagggctgtaagaattgtatgtgaaacttccaaatctctgccttgggaaaatagatatttttaataatcagagaaatctgtcatattcatcatcctcaataattaatacttattttgcatctacaatagagaacactaggattccaggaaaacacacacacacacacacacacacacacacacacacacacacacagcccttcctcttaagagtttttcaatcctattggaaaacaatatctaaacaaaaggatgaagaataatattagtcagtgcacaaagattgacaatataatctataggaatgtacaaattgatagaaatagggattcatcatctcactcccagctgtattttgaagacagcagttaggttaggcagcccatttcaggaatagtaacctcagaaccaagagagattttctgtctaatcatctatgtaaacttgaggcccctttaaatcaacctctttcaaggacttgttcaccagtaacttaaatactcaagaatgcttggcttgaggctcttcttacaggtgaattaagatcttatctgagtatcagtcagactttccatatatggaataaagagtctttctattgcttctattcgttaatccatgttctaacctttgggatcttacaagtgaatgcatatcctcttatcctgtgcatggcgtcactgatctcagtgattagaaaattatgattctgattatctttctcttcttcagaggaaacacctttgttctaaaagtagtgttcttatgagacgctcatgagtttttgttaactctcctccttttagtcttctgaacatatttcaatttatttcttaaattgtagtgagcagaattgaacataactgtttaaccagcccagagaatatctattacatcttgttttagaaaacgtatttctgttaatgcattctaaattgccattgactattttaacatcatactgttggttaatgctgaatttactgtcccgaatttttcatatgttcctgttaaaccatgtttctcccatcctagccttaacagtgtttttagacccaagttcatatccttacatttatcctttttacattgtattttgttttatttggcccattgttcaacctgtgagatggttttgatcattgcacctgaccctggggaagggaaagaagtaacagagtaaaactgtggacagctagaagttagagcagaatttcccctcatttcttggaagatataactaatgcacgacaatgaaaaaccttctctgattagtacacctgatttatgtgtgttccttattaataaatttgcctaagctttgaggggaaaaccattatgcttgggtccgttagtatttcttccataccaactttccctgcacctcaccgtaaggactagatgaagtgtttttacaggtaggatgccagctgtaaaacactttccatccttgctcagctcaaaaaaaaatctgaagtcccagttttgtgcacaggtatgtccttctttgcaaaggagagaccagtttctcctgccttgttcttctccaccatgtgaagtcaaatgggtttttgacactcttcctctatagggaggtagggatgacaaaaaagaattgacctccacatattcaaaaatatttgagagtttcagtccatagttatgcttcattttacataacttttcattttttaacttataacattaagaaaatgtgtttggcttaaaaaattagaattggtgaactcaagggaaaaaaaacagcagacagatttttcccttctgtatttactgataaacccacaccaatcccctcagcaccagtttgcagtggtgcacaggaagtagaagcaaataggggttccaggatgtgatcacctgagggcatgcagcaattttccgtgcttacttaccacgttcagggatttgggaaggaccttcctaggcactgtcactaagcagctctttgagatagtgcatcttccgcctgctctgtgtgtctaattattcagacgccccagctatgtagcaaaatattatacctcattgcttgctgggcggtccagaagtttagactggaaacacagataagatgctgaactgctggtattcagggacttagagaattctctatcagtcagaaaaataggagtgatctgttccaaatggtatgggaactacacaaaggaaatcaatgagtaggaatttctttccagaaggaagatgattatgggacaacatacacaattacttcagaagagcgcaaataaagcgtttgcctatgatgttttttttaagccggttgaaagacatagaagagagtgaaagtcatgcaaatctttttatttatttatttatttatttatttatttatttatttatttgagatgaagtcatgcactgttgcccaggctggagtgcagtggcgcgatctcggctcactgcaacctccaccctctgtgttcaagcagttctcctgcctcagcctcccaagtagctggggtcacaggctcccgccaccatgcctggctaatttttgtatttttagtagagatggggtttcaccatgtatggtcaggctggtcttgaactcctgacctgaagtgatctgctcatctcaacctcccaaagtgcgggatttcaggcatgagccaccatgccctgcctcggtcttgcaaatctaacaactaatatttgaacccctctacagtgatttcaaaccacaacaatctcagagattttgtgaataaatggatatccaagatgacatttacctctgaatgtttcaatattgagtatttaacagtgagaaaattaaggtattcaattctcaagaaagtttttgagtctttctgcaaattttcaggatataaataagaaattcctgcctggtataaagctgtatatatatatatatacacatatatatatatatatatataaaaaatattgtgtgtatatatatatgtatatatattatatacatatatacatatatatgtatatatattatatacatatatacgtatatatgtatatatattatatacatatatacatatatatgtatataatatatatgtatatatattatatatacatatatatacatatatatataatgtgtgtatgtatgtatgtgaaaaagaaaatatagataagtataaaacataataaaataaatactcccatacccaaaactctatttttctttctttctttttcttttttcttttcttttttgagacaggctcttgctttgtcacccaggctagagtacatggtgcgatcctaggtcactgcagcctcgaacacctgggttgaagcaatcctcctacctcagcttcccaagtagcaagtacctaggactacatatgtatgccaccatgcctggttaaattttttattttctgtaaagatggaggctcactgtgttaccaggctggtctcaaactcttggcctcaagtggtcctcccaaagggctggaattacagatatgagccaccgtgctctgcctcaataccaaattcatgtaactgtaaatattttgctttttcttcagatcttttttaaagaaatgattaaagttgaaattctttcttttgcaatcacagcctgatcgttatcttcccgaacacccagtaatggatccagtccatgctctgtaactgcgtatgttacacatattctccagaaaagatatgtattattgtttgttttgtatgcttatgaaaattatgttgatactgtatttaatattttgcagcttttttattcaacattgttttgtgattgcctcaagttgattcatatagatctaagttactcattttaagagctgttttatatattaacatataacaatatcaccattttaaaattcattcctggaaaaatgagaatattggttgtgtcttagctcaggctgctataacaaaatgccataagctggataacttaacaacagaaatttatttctcacagtatttctctgaaagttgaagtctgagatcaaggtgccagtatggttgggttctggtgagggccctcttttaggctgcagactactgatatctcgttttatccccacaggatggaaagagagcaggagagtaatctgggggtcccttttttaagggcactaatctcattcatgaggcctccaccgtcattgtctaatgaccccgtccataggccccacctcttaatatcaccctgagattagatttcaacatatgtgtttgaggaggacacacacattcagtatttaacattctgctcctggccctccacaattcatgtcttcacatgcagaatacattatttccatcccagtagcctcaaaagtcttaacttgttctagcattggttctcaagtctgaagtccaaagtcttatctaactatcatctaaatcagatatgagtgattcttaaggtatcattcattcagagacagaactcctctccagctatgaacatgtaaaaccaaatattaggttggtgcaaaagtaattgcgatttttgctacttttaatggcaaaaaaccacaattacttttgcaccaacctaataagttatgtgcttccaaactacagtagtgggacagatgtagaatagatatccccatttcagaagcaaaggaataggaaagaagaaaagagtgatagcttttaagtaagtccagaacctagcaagtcaaactccatatctcagggctggagaataatcctctggtgcttgatgctgtgcactccaggcccactgggggcagaggtcccattttccagacccagtagagttgagatattgctctgcacctctgccaaattgggatctcaatcccagggttctgctgggcaggcaccaaacctccacagctcctcccagtcctacccccatgcctttgattggaggtaatctaacttgttgaaaatcaggcaattcttcctccaccctttgcaacataggatgaagccctgatgatctctgaatcatttttttgtagtcattcttcccttgtctttaagaatagatcatgtttgcagctgaaaagttttatggtcttccctgtaaaatccaaaaaatctgacaacatttcttcattccttcccattcagttcaaactggcagttttcctgctgaggtagctaattcagtccatgcttcacaccatactaatctccttatcaaatggtggcttggtaatactcttagtgttctcttttaaacatgctttctcattttgtgcaatatggattggctgagaattttccaagctcataagttctagtttcttgttgtttgataagtccctcttcacatcatttctctcttctcacattttactaaacagtcaggaggaacaaagccgtgccttcagtacttagctgagaaatatcctcagctaaatagccaacttcattgctcacaagtcccaacttccacaaaacactaataatatgaacacaattcacccaagttgttggccgcttaataacaaggattgcctgttctccattgcacaagatggagaaaaggacagtgaaatttagtgttaatgaagataataacatgtttttacttcagtctgagaattcatcaaaatggcctttactatccatatttctactaacattcagtccatgattacatatgtattctttaagaagatggaagctttctctacagctcttctcttccctttctgagccctaaccaaatcacctttaaaagtcccttcatgacaatcttggcttcttctagatgtacttcacaactcttggttagttccaaagctgctttcacatatttaggtatttgttatagcagcactccacttctcagtaccaatttctctcttagtttgggctgctataataaaataccatatgtagggtggcttatcaataacagacatttatttctcacagttctgggggctggaaagttcaagatcaaggtgattgcctatttggtgtctggtgagggcctgctgcctggttgtagatgactatcttctttccgtgtcctcacatggagagaagaagaaccaactctctgtcctcttcctataagagcactaatcccattcatgaaggctctgctcttgtgacctaattacctctgaaaggccccacctccaaatatcattatatttggccccatctccaaatatcattacatttgggattacatttcaacatatgaatttgagggggacataaacattcagtccataacaggttgtttccaatttaaggtgttaaatatactgtaattagtgtcttcaaataaaggtttgagtttctccagtgtataaacataaaaatggaatttgtcataggttatgtgtattgtgaactacatgtagtcaatattgttcttcaaagtgatttctcaatgtatattcctaccattagtgtgaggagtttttaatttacccaagtactcttccaaaattgatattgtatgactttttaacagtggaaaatttgaatgtggaatacttttttatccacatttctctgattaatagttctgagcatctattcatttaatttggagtatttatattttcctcttttatgacccgcctgcaaatttgtttgccaatttttctattaggtttttatgttgttaaattgcaatgtgttacttattattacggataatattcctttgtatcttccagtatgattctctatttttcttgtttctattttattgtttccttatttgctcaaaactttttaataaattaaactatataaaaaaaagcttttccttttgagcttgatcttatagtaagaaatccttttctgctctgaagctatagtctacgtttttatgacagttttagaatttgtaacatctatttttgtattcatgttttgagtttatttttgcatgtattatcacttggaggtgtaattttttatatgtaagtgcaaatatctcaacaccatttttgagtagtctgtcattcttgaatgataaagttgcatactctaatttaagccaggactgcataaatgcctgaaggttactcagctctctgagagttttattattttgatctacatatctgttcccatgccattgcctaattattatgacttctatattattgatagaacaaacacccccacttatttttattttcagacatgtcttcagtcttccatgtaagttttagaattcatttgttaagttccatgaatgattgaattagaatttttactgtgatcacattgaatttatttatttatttatttatttattttgagaaggagtctcactctgttgcccaggctggagtgcagtggtgcgatctcggctcactgcaagctcctcctcccaggttcatgccattctcctgcctcagcctcccaagtagttgggactacagtcgcccgccaccacacctggctaattttttgtatttttagtagagacggggtttcaccatgttagccaggatggtctcgatctcctgacctcgtgatccacccgcctcggcctcccaaagtgctgggattacaggtgtgagccaccatgcccggccttgaatttataaaataatttaggacaattaagattttggtcttcccacttgagaagataacccaactctgtattcaggtcttattttatgttttttgataaagtttcgtaatatttctatagagttcttatacaatttttgttataaatattaccagttactgttttggttttgctattgaactatgcctttatttttcttatatattcaaattcattattactagtgtattagaagtatatgatattttaaagcttaaactggcatccctcttgaactgcctctaataacttatctgccgaatctcttggaagttttatgttgataaccatatcatttgtaaatagtaaagtttgtattttcttttccaatttttatttattttttctaattttgttgcattggctgcaaaattaataattttgaatgttgggtatatagactttattgttttcttcttatcgttaataggaatgctgtaaaattcaccattctacaaatatttgtgtacctagtatgtgccaagcattgttacaacaatgaacaaaacagacaaaagtgcctaccttcatgaaatttattggctccttggttagacaaacaaacaggtaaaacttgtagtatgactagtgatgatacattatatggagacaagttaaacaggaaagggtaacagctcatactggggatgaggtgagggagttcatttttaaataagatggtcatgaaggcttcaaggagaatgtaacatttcagtaaatacttgaaggagtgaaaccctaagtgtgaaacaagtgcaaaggtcttgacacgtaattgtaccgagcatggctgaggagcagcaaggaggccattgtgattgaaacagacaacaagaggcagagaaaaggagatacattcaggggagtaacaaaaaagcagactgtaagaacttcactctgaataagatggtaagccactggaagttttggattggatttgaatggaagagtctttgctgaaattatctgacttaggtttgaaaggctcatcctggctgctgtcttgagaatagaataaaatggaattgtaatagaaggagataggaggtggtagaaacagaagatgggtagcagataccagttaagaagtctcacatttgctgatctgctgatgtgacatccagatgaaatagaggaatcaaggatgagtccaggattttttggtgtgaaaaatgagaaggatgaggcttttcattcagtaaaattggagaaactgtgggaagaacatgtttttgggaaaagataatgagggcagattagagcatgttaagtttgagaaagccaagtgaagatattgagtaggtagttggatatttgcatcctgaattcaggaaaattatcttcactgggcatgtaaatttgaggattttgtgcagaaagctggtagacccaaaaaagtctcaatgagttcatcaaagaagtgatagagaagaaagacagaacactgtggccattcaaaatttgaaagcgaggaagatgaaaaggaaacaagaaagtagactgcaaagaagtgatgagaaagcagacaggtgagtatggtgcccaggaggcaagagaagaaagtatttcaaagagggtggagttaaaatagtcagtttggactactgtagacaaagtatcatagttgggtagcttaaaaacaacgtaaatttgtttttcacagttttgttggctgggaagtataagatcaagatggtggcctatttggtgtctggtgagggcctgcttcctggttgtagaagattgtcattctgtatcctcacatggtggggaaaagcaatccagttccctggcctcttcttataagggcactaatcccattcatgagagctcagctatcatgagctaattacctcccaaaggccccagcttttattaccatcacaattggggtttggacttcaacaaatatattttgcaagggcaaattctgtccattgtagtgtaaaatgctgttggcccagaaggagatggcaaaataactcttggacttaataatatgcggacattgagatgtctacaaaatctgtttcattagagggttagggcagcccacccattttcgtaattgatgtagtcttaaatttaattcttgagtgtatctaaacagagaaacatagacttttattttagccaggtcattaagttcagcatcctattttaccaatttcagttctgtttcttatattctaccccttccctctaattttgttttcttctgactgaagtaggttccagcaaatatttgagtaatcaactcagtgagtttatcagaaataatcttcactcttgaatttttacttaggtgcatataaaattgtaggatgattattatccctcagcacttggaacacataactccattgcccaccatcttcagcatctaatattgctcatggaaagtccactgtcaatcaaagcattacttgtgtgtgggtaattcagcttttgtctttatcatctagatgtgtttttactattttgtttataagtgtagatttctttttatttttattcatcctactcagcatgtggtatactcctttatgtgaggctttgttctgttttgttttcttccagttctagggagttcttggccaattttccttaaaatattatgactttcctgacaatccattatttttccccttatgaagaaaatcttgttgggtatatattggggcctttcaatgttactggtctgcttatctcaattctcttttcatgttgtagcttttcttcactctttgctgaattctgagtatattccttggcaccatcttcgggattgtttgggaaagaaatgattatgtgtaaatcttttaatagctatttgtgtttgtttttacattcccgttatgtcttttcttatttcatatttgccaatttttgttttataatttattttattttattatttatttttaattgacaaataataattgtacatattcatggggtacataatgttgttccagtacataaaatgtagagtgataaggtcacttatcactctatggtaataaaggatcattaccatattcatcgtcttaaacatttatcattactctgtgttgggaattttcaatatcctccttccagctatttaaaactatatattattgttaactttagtcatcctacagcgatgtggaacactataacttattcctcctatctagctgccattttatatcccttaaaaaatgtatccatatccctcccttactcctacccttcccagcctctggtatgctatgtccttctttttacttctatgaaatcaatgttttttaaacttctacatatgagtgagaatatgtggtatttaacttctgttccttgcttatttcacttaatataatatcttccagttccatccatgttgctgtgaatgacagggtttcattatttttaatggctaaattagtattccatgatgtatatataccgcattttctttattcattaatctggttttggacaccttggttgattccatatcttggctattgtgaatagtgctgcagtcaacatggaggtgcacgtatccaaaaggcatccaaattggaaaaggggaagtcagataagttttataatttattgttctcccatttaaattgtattctttcatttatcacattgtttatcttaaatatatgtttgttaaactaattttaggtgattctgttattagcatttgatcaggaatatattaatctcctaattgttgagttggttgtctgttttctggtgttaatatggatttttgctttcaggtaacacattgagtgagagatgtatttcttactgtcacttactcttcataatgtaatgcttttcatttgtttccactaatcccttaagacccttagtcttgaagcagctcttttatcagtatctcaggattccctgccatctgccagtgattttggaaaattccctgacccagtcactgaacaaataagctgattggctgaagtctgatctggatggctttctctgcatcctaccctttctgcagctaggcattactgaatagtagaaattattttttcagtacctttttatgaagggcacaatcacagcccctgattttttgcaggcaacctggaatcagactcccactcctcctaggggagcatctaacacctcactggagtgtggacctttgcccgcttctgtttcaatatctgaattgcagaattactgtggctttagaccccattcacctacaactgtggttttctgctctgtttctggtcgaaaaatatgtttatctggttttcaagaatgcagtattttttaaagtgtttatcattgtattcagaactgaaaatatcattttaaaataatagctcataatgccaaaataacctgaagcactttatagttttaataagtactgctctcagccacacatttgacaatatatgtgtatgatttacatacattgcctatttatgaaaaacatcattcagtagattgcattactttttctaagagttcatgctaaatttgatattactcaaagacaaaactttttattttaatcctcagtacagtcttagatcaggattggtcctataaataggtagcaactcatttggccttatttgtaagatcacagataggacattctgtatcccaatatttattttatctgccatgatatataaattccaccagagtaattcccctgaatttgatgacttttattttcccccaactctccgttaaataaagataaatttgggggatggaagaagagaagctaatgcctttgcaacactgacacctaacagaaaataaggccttttggtaatgttattaaggttaggcctctggaggatgagtcaaaagtgccaaaaaggatattgtgtttcaaaggaagtgagagggcgccaagaataaacttgatcttcctcatactcttatatagttagaaaccatgcaacaatcatttataaagctcaatttaccttactgtaaacattagtggaaaaacgagttacatacaccctctataatcaccgaatggtgtccataaaaaaggcagatttaatcattcttgagtaaagaaggaagttaaaaataaattttcaaaccttatcatatttactttaccaacaatcttgattacgtggcaactttgttgctataattttatgcagcagataaaggtagacgttcctccccaaagtttttagtatatccttctaaaaagttttcctgagaatttttagtttggcctctcaagtttccttattttaccttttcttaaattacctccctccttccttagtgaaatgagccttccttcagcatacgcaacttatccttattgcttttttcatacccaattttttgttttatctctttcagccaactgggtcctgaagtagctgaaatgcgaaaaaggcagcagtcccaaaatgaaggaacacctgccgtgtctcaagctcctggaaaccagaggcccaacaacacctgttgcttttgttggtgctgttgttgcagctgctcctggtatgtcatgttacctgtaggatgccacacccaggcttggcaggcactagtgtgaacatgcatgccaaatctcagaactgtagaaactgctcaacatgtctttttttgttctttctttgcaagtaggacttattgaagactatcattggtttaatgcaaatactttcacaaacaaaatatataatatttccccaaaatctacatttaaattgataataaggtaaaaaaaatgaagaggtgttttatatcatgtttttctccatccatgcttcttaaagatatgggtaaaaataagattttagttacatttgtatttatcaataagcaatattctccaatgttacaggcaagaacattaaaataacatctagtaatattgcatgtagtattgcatgtgtttttttttttttttagttctctgctgctacttgatagggtgttgagcattcagctgtatgaccagataactgtaagtcagggtaacaacctctgcccagaattcctgccaataaggacagagagaagagtcattgactcacaactacctatctaaaaggtcagtggctgtgcttggaatgaagtccaactcagttcattgaaaaatcctgaaattagagccagagaacctgcttcccattgtggtgttatcactggcaggctctgggacatcatgcaaactcataatctctttgtcctttgatttcctcattggcaaaatgatgaagagttagacaagctaattcccaaggtgccatctagtgctgaacatccatgatccagggagctcagagaacctgctcgagttccggattcgtaaagtgcctaacatttatgcagatgagattcctcaaggggatgctagacttcatggaactttcctttgaaccatacattttggggtcttttaacatacagtttacaagtggatcttctagcccagcagtggtcttctgggtctccccagactaattcagaacctagagaaaggcccatatgttggagtcatctctctgtgtattatctctacagtttcccaacatatattgaggtttcttttttgatatgacaaaatgttgtatcattgtggccaaaagaaggtaaagagggctgtactagagtggtaaccttggtgacgaacaagttccatccactctagaaaactccagtttcagaaaaacatagtcattgtagtaatctggaaagcttaagtagtttttatagatatcaatattgcttcccagatgatgattctttgttacagaaagtcatactgtattagtccatttttatgctgctataaagaagtacctgagactgggtaatttataaagaaaaagaggtttaatggactcacagttccacagggctggggaggcctcacaatcatggcagaaggtaaaggaggagcaaaggcatgtcttacattgtggcaggcaagagtgcatgtgcaggggaactgccctttataaaaccatcagatctcgtcagatttattcactgtcatgaggacagcgtgggaaaaaaaccatccccatgattcaattacctgccaccgcgtccttcccatgacacatggggattatgagagctacaattcaaatgagatttgggtggggacacggccaaaccatatcatatacataatttgtttcctttcattattaagccttaataatttaagatggaggaaacagagtttgagatgaagtaaatatttcaatcatagttgtgtaatctttttctgtgtcatgcctaaagagattatctagctctggtcttaatctgtgaagtaccatgtaatgacttactatagtggttctgaagtcagactgccggggttcaaatcttatcctcacccatctctatctgtgtgaccttcagcaagttagttaaatgccagtaataaaaatccctgcctcgtaaggccattgtaaaattaaatgagataaaatacataacaagccaagagcagtgtctgacacacagtaagcatttaataagagttagctctctgggctatggaacacttcatattggaaaataaagatcactttaaagaggaactggcttgaaatactgttttaaaaaaagatcagtttgtggctataacacaaaaattatcttggaaaagctattttattttaaattctgtataaaacatcaccaatatattgttacacagggttgaggaatagacttctagtgctcatttgcactataccaggttcctgtaatcggtatatgattttccttagctgccaaaacttatctctgaattgctttgggattaaaacaccagaacagatagaatactgaagtttctttgtgctatatgtattagctgccatataaatatttagtgagatttgcttttatcaatttttaaaggacacattaaataacaaaacatttaacattagcacatgagcaagagattattgcagtacacaggcaatagatggagaacaaaacagctttcggaagctgcatcaactctctacacctctagagtagatccccaaacattgggtacattggctgcatgctctgttagctctagactagcaatgcccttgtcaggaactgcatttcttgtcaatgaacattggatgcctgagtctaggccataaaatatacagtctgtaaatttacaagtccttctatatatgataaatgatagaaaatttctaattattataaaccacttgattattatttatttatttatttgtatttgagacaaaatctgctctgtcatgcaggcttgattgcagtggcacagtcacagctcactgtaagctccaactcctgggctcaagtgatcctccctcctcagcctccccagtagctgggactacaggtgcatgccaccacacctggctaattttttttttttttttttttagtggagtcagcatcttgctatgttgcttgggctgctcttgaactcctgggctcaagcaatcctaaaatgcctcagcctctcaaaagtgctgagatttacagccatgagccactgtgcctggccacttaatttttttaaaaggataaaagttaaagttccttgaactatggattttaattatgactatattgtcttattgcaaatgaaaatgtcctttacccatatgtttttaaaatattattatttttatacttcaagtttataaaagaaaattgtacaggctttctgaagtaaaaagaaaaagaaataaatgttcttcagattttccaggctaggtcaaaggagcagaacaaaaagaaacactaaaaatgtaatttagggagtaaaaaaaaaaagttagaaatcaaaatatgaagtaactgtcattcgtgaatgggaccagttgtcatgtggctgaatttacttccttttaaggaaatagagtggtaagaaaataaatttctgtatctagtaataaatataaatacctcaccctaagcttcatgttatgggttttttaacagtgtaatatttccctcaaatttgcacttctcattcatatttcattgtcagctcttctctcatttttaaatagattcctgtctttataacattaccaccacattttttgcggggaggatacagagagtgagtacataactgctgaatgtttccacagtttctttcaaaattctaaactgtttagacaggcttcatagtgatttaagctggtccattctctatctctgtcatagaggcactttctccccccacgtcagtctctctccttatctcccttttctcctcatagcccttgcaattaaagaagagaaaacaggaggatgtggtttagaaccattaacatccttaaatacacataaaatggacactctataaacatgcaagaccttctattcatgggaccaagctagggtgaagagaccattttgtcaagaccatttgtctacaggttcaaggttgacactggcaagtggaatgtctcgtttcttcagatagtaaccttcttcccttttctttataagaaagaaaactttgaaagatactgaaggctcctctcaaactgccttcagtcaggacagcgtgaagcagtgaggttgttcagatgctcacatgtgagataacacatataaaagtgcagagcagactagaaactgctgtgtgcttacaaaaaggaggggcatcaaaatggccataggaaaggcagagctttcaaagtttattatgagcttaaagctcattttcaaattgtcctacgaactctcttgcaacatcattcagaggttgcattaaaataacccatgctactttttcacataaaatcttcaggtactaattcctcttttaatactgacgcttctgtgggtgtcccatcaagcaaaacagggttccctgtgtgtaaaaattagaacttcagagacctcagctaccatctctccaaaatgtttacgttgccctctgcttggcacatcatggtggtgagatgacggctatggagaggagaagaatgaagtatcactggccacagccctggctccagcttgcagtttccaagagaatggttctgtctttagctactttataaattagacttaggtaaaagctttcatttgaaaaaacaacaacaacagcaacgtttggaaaatgttgtgtctatttttacaggtaaggaaactgatggcttgctgatgtcagtagacccattagggatcgaggtggaactgagatgcaagcctctgaatgtctagtcccgttgttcggtccactttaatgtgacacttccaagcttttcatttccaggtttgatatgagccatttccaaacacaactttctcagttgaattcacaatctcatgctctcccggtattgcccacgagatttggcccactgcactggactcttctcaagagaaattggtcacagactgaatttagtaaattaactagccttttgaaagctaaaattgtctcttttttggatacattagttcccagagtttccagaccatgggatggatctcactgagtaaatgttaagtgcttcataaatatgctttgggctgcccctccctccgtttctaacaagtaccatggcctctgtaattcaaaacagtgcaaaaataatgtcctgttttatcctctgatgctgtcacactttcgctctctgccaaaggaaatactaagatgcatgctttaaaagtcaaaggatattttttgaaaggaaaaacaaaaatccatgcctgcaccatggtaaagaaaccactccctggaaataaaactcctcacacaggcaaggtgaatcatttcatctgaggcaccagagcatacatggtttcctctgtgcctgtcaccctcagagagctgattcatctcacatggcagaatacgttattcctgcagaataactcacactgcacaagatttccagagtacttgtaaacagaccatcatacatatcacttacaaagtagcaatacggaagtctccagttgggaaactccatcttgccatggcatgggtaaatttcctcaatgtttttatcagttatatcaactttacacaatcaaaagacatctatcaaaatgaacccaagtttctcaggccatatacacaaaaccagagtggacaataggactatggactgaatgagagttaatggtagaaggagcctcactctggtgaagaagtccagagtcccaagaagccaggaggaagaaattgtagataaagaggtggcaggtgcatttggtgacagggctctgcacggtgaggtctgctgaccccagataccccagtcagcttcaaggttcagacccggacaaaaaactcaaatttcagccaaagctgactcactctacatggcaatgcagtgaggactatctatgtctggatgggccaggatgtaccggagctttggggatgaccttggtaatagactggtgctgttcatacccatggccatggctccctctgccctagagaaggctgaacacatgaaaggtcagagtttgactcaccaacccactgaaccattttttatacgagtgatactcctgtctgccccatgttgttgttttttaggttaatacctttggtaaaaattatattacatagatcttgtatttgaattcacaaaactccatattggtcattgctgccaggcatttttgtaaacagataactgaagtttcatgcattaaaatagcaaaaaataggccgggtgtggtggcttatgcctgtaatcccagccctttgggaggccgaggtgggtggatcacgaggtcaggagtttgagaccagcctgaccaacatggtgaaaccccgtctgtactaaaaatacaaaaattagccgggtgtggtggcatgcgcctgtaatcccagctactcaggaggcggaggcaggagaatcgcttgaacctggggggctgaggttgcagtgagccaagattgcgccactgcactccagcctgggcaacagagagactctgtctcaaaaaaaaaaaaaaagtaaaaaatgcatattttggcttacattatttggccagtattagtaggtgtttaacatttgttgaatgggtgatggatttggatttgccaattgagcctactttatgaaatataaaaacttgtgtcacagaaattcttttcaaaaattacaggcacattctcccaggccaccagatttttttttatgcaccatttttcttcatgctcctgtgtgtgtgtgtgtgtgtgtctgtgtgtgtgtgtgtgtgtgtgtgtgtgttttaaaggtagtactaccaattagtagtacagagggaatgaatttggggagggagcactaaatctgtttagcatttctgggatataaagtcaagaagaacaaaatagaagactagggagataggcaatgacaaataatcaaatatcttttccaccttattaaggagtttacacctttttagagatgggaagcaattgaagggttttaagtaaggagaggacaaagtccattttatattttaagtattctcctgagggaatggaaaatgtatggaagaaaatacaaaaagtaagggggatgttaagagacttttataatagccttggtgagagatggtggggcacaacagaaagagacaataaaagggatggagagaagtgcatattcaagaaaaaattaggatatactgccaagaattaatgatagacaagaaagagaaggatgactccatattgcttgcatgagtagctgggttgctggtgatcccatcaaatgagaggacactgcaataggaagttatttaggccaaggatacaaagatgagttcaacttgctctgattgaggtatccaagagttagttgtataaatgaatttgaagcttgcaagacaagcgtggatgaaatatgacaatctgggactcatcagttgcaagagatgagaatgattcgccctggtgagtattccagggtgaaaagcagggagctacagacagaaacctcaggacacaccacatttaaagaacaatggaggagtgagagagttgcaaacacagtggagaagaagtgatgtgagaaatgacatgcaaaacgcagcaagggggccgggcacagtggcccacaactgtaatcctagcactttgggaggacatggcaggaggaaagcttgaatccaggagttcgagaccagcctaggcaacatagtgagtccccatctctacaaaaaattttaaaattagccgagtgtggtaatacacacctgtagtcccagctactcaggagagtgttgtaggaggatggcttgagcccaagagttgaggctgcagtgagccatgatcacatgactgcactcaagcctgagtgagaccctgtctcagaaaaataaaataaaacacagcaagggactgttacagaagccaagagaattgagagtttcacaaagggaagtctgaggttgcagatacaccagagaagtccaatacaataagaatcataaaacattttgtgatttgaccagccaggagggcttcttggtgaactttaagagaaccaagcttctctgtaagatgtacaacgaggaagaacttggagaaagaaaagctactgacagagaaaatgagtgagcccctctttgaagactctaagaccccatatgctcctccttcagggtgaaggtttgctttgagagaagttggattttccttcctgactcattcaaagcaaattattcattttccaaggcaatatgaaattcaaccattccaaatccaggtcaactttattagctacctggacaatatttaacaaattcctccagaaaattccaatcaataatgcaaaaatgaggctgacttctttgctacccttatttataaaatttcatagttgtgttacacctgattaaattaagtattaaccctacttttgcttctctcattaaaagtcttcattatttcttatgggcctaacctactgtctttcatggtctaggtgtggtagacctattacaatctgcctgctcttttaggacatgattcaagaattacttgttctgtttttgtcagataagacaatcaaattcactttttgtgaaaatgaaattgattttataataatcatgctggactgggtgctataaaatatagcatgtataaatgctataaagtccatatctttgtttcagacattaatatgttacatattaatgtacatctttttgcatgggaatatctgttcctaagtgaaacacaaatttctgtcactgacactttgtgtataaagcaatatacttttttttttttgtgagagagtcttgctctgtcacccaggctgcagtgcagtggtgcgatcttggcccactgcaacctctgcctgccaggttcaagcaattctcttgcctcagcctcccgagtagctgggactgcaggcatgcaccaccacacctggctaatttttttttgtatttttagtggagacagggtttcaccatgttggccaggctagtctcaaactcctgacctcaagtgatctgcctgcctcagcctcccaaattgttgggattataggcatcagccgccgctcgcagccaaagcaatatagattatttaaaagtacagagccatttaactgccaattccatcgtaatagtggaacagtaacttcatgtgtttcgttctagaggtagtcttgccatatttgacaattacacgcaaattctaatggcatgtcttcctcggaaagctgactttcaagaggctgtatgggataaggaaagacccatggcactggaattttacagacctgagtacattccagttttatcacatgtaactatgaaacctttggcaagttacttactacctctgagcctcggtttcttcctcagtaaaatgcgattagtcatgtacacaaatccctgcgtaatcctttattgataggtattatttctgtccctttacaagtctcaggcccagaggaatttaccagactgtgtaggatctggctattgcaggcttggcaaggttctgtttgcatgttgtcagttaaggtagcggatgctgtttcttcagtctgtatcacttcgcgcttcccagccctcacattaatcggcacaggtatacgtcagagcagccctggagcatgcactgcacagctgcaggattcccagagtgttgtaacttttatatagcagggttttgtttctctacagatcaagattgttgtcttccatggtgtctgttctcaaggaagccccgcacattcatcccatacgtattcacacacacacactaactggaaaatgcgagggaaaggatgaatgggtagatgaatgagcagtcctgccagctatcagatatatttctgaatattcactaacagggttttaactttttcactctcctttttatgatagggacccagccttctaaagtcagaaactggagctccaattgaattaatgcacttgacacaaatgatcgcatgccattttaataacagtcacactattattgctcctaactaaatagaagtccatttggccttttcacatctaagatatttgctttcccattaaggcattcacttagttataaattataggtaaaattacagtgggttgaaggaatagcttaaaataggattttaatcaacgtgagaactgaggtatagaagattctgatgattggcatgtattttttatttttattttatttttatttatttatttatttattttgagatgaagtctcactctgtagcccaagctggagtgcagtggtgccatctcagctcactgcaacctccacctctggggctcaagcgatttctgtgcctcagcctcctgagtagctggggctacaggcgcacgccactatgcctgactaattttttgtattttagtagagacagggtttcaccatgttacccagggtggtctcgaactcctgagctcaggcgatctgcccaccttggcctcccaaagtgctgggattacaagcatgagccaccatgcttggcctggcgtgtattatgtaaagtatatctttgtattcagacctgtaattctcttaattttaaggaaaaataaactctgtttatgctaaataagaagctttggtcatctaactgaacataaacgtaccgtgtagatttctattttcaccatgtaattacttggtaaatgaagttggcattccaaatcaaatcaatatgtccatgaaggaaatccaggccttggggtttcaaatgaaaattgaatatagataaaaagatggaatttttgatacccatcttttcaaacagatgcgtatatagaaagaaattggcaactgagagagagaatcagagaatgaagaaatttgtcttcagtttccatgggtcaaaagaagaaatgaatgttcacgtaccacccaaacagaaattgaaatagtgtggagaatccattctcaggatggctcttttaaaatattgtaaattaaaaatatttcctacctattggtagttaaaacccttttctaatttatttgttctaagaatgtatgacctaagttctgtattatcccagcatgagacggtggaatgcaaaacgacttcttatcggaaacgataatgacaatgttaataacagtatgcctgcctgtttttaagactaaagtattcccaaatcaaatgactttgggccgggatctattcagaatattttgtaaataccaaaaaggaaaaatggttgcagttatgcaaacctcccaagattaagtttatcctcttcgagtttgattattacactcaccgaaaaactgaatgactccttttagattccttagaaagatataattatcaaaactccttaagagaatgaatagactttttttttttttttcaaataagggtatttacccgcagaaactttttttcagtttttcctttattctgacttggttaaaatattgtatttataaaggtaacacagccatctagtggacagatatttgatagctgattattttacttgagtttaagttcatgaaacaaaagcttaagccaaatgaaatacttgtttcatgacacacggcacatgattacaaaatgtggagtgagcctttagaggggcaacatggggtatttttaggcaggtgttttataacatttccagacacaaatttctaaccactgttcccatccccacacaccccactcaaaaccatactctattataaaaatgtagaaatgaaagaggtgaagttcaaatcataggtttaacattgagtttctatgtgtctgaaatgttgtatattatgtggttaccagcccatcttctggtgtctttttggtttggggttttagtttttttggggggtgggtagtcttttgtaagtgaaacatcagttctattctcctttccttgttgccctgtcctgaagttatctttgctaatggaagaaagtcatacttcccaggatggccctcctcagccatagcaacaccgtctgcagtcattaacggtgttacttttgtccttcctctttcacactttgctgtcaaaaccttctataacaactcctttttgttcatctcaaattccagggaattgagaagttactcttcatcaaattctactgcaaactcagacctctgggcaacagctcctatggagtgatagctgtgggatgatacttagagagggcatttatactcaatgtactggattgtactaggaggtttatttttccaaaccttaagaaaaatcacttgtgtaaacacttgcaataccacaattaactcttctatgtaaagagaaatggcattgcagagtgaaaatgagcctgagacaggaagtcagaagatgggaattccaatcctagttctaataattttgagttgtgggtattgtgtaagtcaaccccaataactgtttccttgtaaataaaacaagaatgactaataacaactctgctgcttaccttcaaggactattgtgaggaggaagtgacaaggtaatggatgaggaagtgttgtgtaataatgacaaaggagaagtctctatttactcaggtggaaataaaaagctctttggtaaacttggaattggaattttaatatgcaaccaacttgcccttccattcaactaagcatctgtaataatgggcctttttgtcacaagcttttattttttgttttacatccttgtgaagtagttcattgccattatccccattatgaatggtgaaaacaaagcatggaaagcttaaaccatcctaaaggaggtatattctacatttggagtccacctcatcattttcttggataacacatactttgctgcctgttttattctcctgctccagccctgcaacatctgatatgtccattctgttctacatttgtattgtgcccctgcatgattttatccccactctgaatgagatcccctttttccaggtctccatctggcaaacaactgcccattttcaacccaatttaatctttacgtcttctgtgaagcctttctcaattctcttatgcaaaagcacaggtaccatcaagggtgtctaagaaaccccatatgcacagttctgtccgagttcttatcacaatgccatgtgatgtttatttacccgtctgagctcctcagtagcagagcctttgtcttattcaccttttatgtccaaccagggaatgttgcatgaaccagtgtttcatacacattactaaagtattgctaactcctctagtatttactgtgatatcttgaatgctgaaaatgaagtatttaaagaataatctaccaattcattttcagagcctgaaggatgttgatttcatttttgcaccaggaactttgaggtagaagctgttaaataaaaagaaaagattgatatcacaatgtgagactatttcaatattgaatagactgcttttaccagtgacagtagttctctcttggagccttgatgtcacactgtattaaatttaggcatcttattgattcttcagtttaatttttctgtaaatatatgtgctttcctgaccagcctctatcccagagttaccatggctactggtaagttttatcttctttgcaaccattttaacagtttttcttaagaaccaattgttttccttacaatagaagagtgtcttccaaaatagaccctgcgcatatccatgatgacagatcagtagataaactgtataattggcagcaggtaatgttttttctcactccactgtccacactcccctgtaaacaaacaatccacccccatagagagggggcacattttcttaagttctcaaatgtcacaagtatttttcctcccttttcaaagtcactatttagaaaatctctaatgggattttaaatgcttattttagtatatttggccaaggatattggcacttttcttccataaagtatttaaggtttgatcaagaccctcacagtgagcactgtgtatgtgtttagttctctttgtggcttttattgcttaaaaagtagaaatgttagttttaaatgttacatacataaaagtcagtgggggagtgtctcttcttggagagatatgggctaaaaagaaaaaacaagacatgtaatcccagcattttgggaggccaaagtgggtggatcacaaggtcaggagttcaagaccagcctgaccaacatggtgaaaccctgtctctactaaaaatacaaaaattagctgggcatggtggcgggtgcctgtaatcccagctactcaggaagctgaggcaggagaatcacttgaacccgggaggcggagcttgcagtgagctgagatcatgccattgcactccagcctgggcaacagagcaacactccgtcttaaaaaaaaaaagaaaaagaaaaagaaaaaaaaaagtgtctctatgggaccctcaaaactgttgatctggtattttccttttagggctttcctcaaacacatataacatatataagttggtctagagcaaatatttccagtgaattaataaaaacaacaacaacaatgcactacttggagcaggaccaggtaggacagacattagtcaatatcaagacagacaaactgttaagtattaatcccttgtctattttctccatttctctttaacttaaaatggtattttcagcagttcttgataactgaaaccttgaaacccattttttaagaccggtagtaaaggacagttaataaaaaggacaatttgtctgttgccaaagttcaatttctacagggcaagactgtggccaatagtagatcaagagctgcacagtgaatagttaaacatttactgaatgtctgttgtaagtagttttagtccaaatgtgtgtccatattttaccacctgtagaaaagaaagatgtaaactcaacctaatatttcgtaatgatcgctctaatatggtagcatttgggatgtttgtaaatatcacagaaacagatagaagagccagaattcatgttcagaaactcgtgattcatgcctgtagactccagatttgtcactctacggcaaaggcacaacggagaaaaaaatttctcaaagatgtttaatgaaatgaagtatacctgcgtcatgtgtactgccttctgtagaacactgtgtggaaatgtaataaaaataaactcaaggagtttattatttaagcaggggatgaaagctcttttgctagttgtgttatagtgccttaatatgtgtttgcacacacacatagaagctcaataaaggttgacagaatgagtatcaatttcctattttaaaaagagctgaatagaatttaccaaaaaattgtacattttatatatacaggaagttttacagaatattgtcagcagtgtatccccccccatccacttttcccatcatgactggaaatacatcaaattccagagaagaactttcttactcattcatgaatctcctctaaaatacttatctggcctatttgtatagtgacatagaggactgaggtttcccaggctatctcaaacctcagacacattcacagcactcacacgcaaatacctccaaaattatgcactgtctctgaattcctccccaaaattacactacgctaaaggctttgctgtctctaaccctgggactgctgcctccagcaggggtctagtcaatgtgcagcaggtccaagggaccatccactctagtttctgctccccagaatccttctgggctacattacctttccctccatggttcgacaccaataaacctgcccctgtccctagaaatgggtagaggcaaactcaatgtatttcactatgaaatcctatgttttctatgtccttttcctgactacagaatccttttcaattcctattgggttctcctttttccagtgagtctgctctctcaggtcagttttcctatctagcctcactttccattgtagatgggcccgcttgtcagaaattaatatttccctttgctccattctctccgtcctcacgcttgcacttgagaatgaaagaaggaattaaggagacattgtcttggtttctcttatcagactttccagattgagaataactgcttgttgggcacctcttcctaaacactttctttccataccaacgatgtttagtgacccttctttgcattcacatagtaagtggtctatgacctcagtgtctatcagcagccatggttcatagcaggcactcagaaatacagggttgttgaacagggtaggcttccaattccaactatagcacctatttagtgttcggttttgggccagcctcccagacgggtctgcacctcactttgctcatctgtaaaatggggataataatattaatggtaaaagaatggtgcccagcacataacaggcactagaaaatcatcatttccattgcttcttattttgagtaagtaagtgaaagaaggaacaaatgagagatgttatctgaacttcttgtgctctctgccaggctcttaagctcctcggcttctagacagagggatcagttggctaatttgggagctcaaattttcccgagccactgagttattctccctaccctgcttcttagtatctcccatgacctcacctgttgtttctagtccacaccgagagttttcggtgttttgccctaaagcactgctcagctttagggagcaattgtcattggacaattcttattcttattcttgttctgggctactaaaaccttcggcattatcctctgtcctctatgatgctgtagaattcccaaacctatgctacacagacacacacccctcccacccaatgctcacctgttccaaatgctcagttactggtctgtccctttcaagaccttggacattgatttactggggtgaaagggcaaaaacaaagtcaaatataaatccggtagcttgattttagcaattgaaggaatgatattatcggtaacaatgtaaatttagcaaaatctgtattagattctgacacattgtatcttattagctctcaatcggggaaaattaatggaaaacagactatgaatagaattaaccaaaaatcaaaatgacattttgtttaaagagtaaggtaatcatatgtgtgtgtgtgtatatacatatatatataatattaaggcatttaatcatatatctcagaaatattcagtaattcagattatgtaaggatgaagtcagaatatttaacaatatccacttttgggagtctgatttactatataattttatttaaaaattattctcttccctttgacatgggcttgcccatcatttaaaaatggtattgctcttttatactttaaatattctcacatagttgaatataagatctcctgtgaaatgtttccccagaaaaatttattcttttcttcaactgattgaatttcccttgacaaaattaaatgttctgttacattacagcctcactgtgaggaatgaagaaagaggggaaaatgcgggaagacccacacacactacaaaaatggagagtatccaggtcctagaggaatggtgagtgtgagaaccacatagctattgtttcttgcatttatatgccatttacatcaactgcgtgcctcagtattaccccttgcttcatggtactcttcaaaatgattttgggaagtgaatgcaaattcaatctggaagatcttattttgtcattgctgttgcttttcagcaatttttctattagctatgttaagttattggctaaaacatgatctaaatttacttttctctttaaaaaaaataaagattgtcttatgaattagcacccaaaattgccctaattcattacttctcatttctgagaattcaagtttttctctttataagagaagtgtctaaacacacacacaaatgatatggaatgtccaagtgagtgaggaagggcacccagcgactcctggttccttttctaccagagcagactctccccacgtgctgcctcccaaacgagaggtacctatggactaaaatcaaaatacaaatagtccagtcatataattgtaagtgctttctttttctgctttttatgagaaggttttaatgatgcttcatggtcatttttaagctttttaaaattaaaaattgttttaagtgaatgaggaagtgcagagattatggaatagtaacaatctatttgaaatacctggttaaaaaggtaaatacatatatatttacctttatatatgtatttacctttttatgtgtatatgtatttaccatatatatgtttatatatatgtttatatatatatgtttttatatatatgtttatatatatgtttatatatatatgtttttatatatatatgtttatatatatatataaacatacttctttggccaaatgtcttttagattggaaaattattaagtaaatcattgaataggaaaggaagatcagaatcattttaaccataagactctccaagtttctgtcttctacttctttaatgtataagcaagtggattaattactagtggtttttgcagtcacctagtcactaaaagatctgtatatagttttaaattccccaatgtcagtgtcattatagaagcactctgcttccaattatgataactccattcatgactaacaattcgtacattaacttttcgtaggaaaaaaaccttttttttttttagaggcaggatctcattttgttgcctagccaggagtgcaatgggatggtaatagctcactgtaacctgaagctcctgtctcaagtgattctcctgcctcaactcccaaatagctgggactacaggcacatgccagcacacccagctaattttttaattttttttttgcagagacaggatcttgctatgtttcccaggctgacctcaaactcctggactcaagagatcctcccacctcagcctcccaaagcactgggattataggcatgaaccaccatgcccaacagaaaaattattaaagtttaggaaaatatgtgacaagtgcacacagtgtattcttattttaaatcaagtgacagatgaaaaaaatggccaccagagatgagaaaaaaaaactgtatcttatggctggaaaattgaaatcctgattagaggcaaagaaaaaattcatgttgtccttagtcacttacagacagtttctatcaacttgcaacacattgttaaagtttgaacatttccaagcttcattaggaatgtacgatgactgcatgcatattatgtttaggccccttgctgtttgaatgcttgtctccctacatgtctcttatgcctgtgtgaatttttgtcaaaaccctgaaataactgacgtagtcctgacagatacttatttggcacatcaggctggactgagtggcaaaatactgaccactagatggcagcaaattgatagaatttctatctgctcctctccttacctggtctagcattcactggtcacaaagttccctttgatcacggccccgttctgtctctgcagccaaaaccccactgcagaggaagtcttgtcctggtctcaaaattttgacaagatgatgaaggccccagcaggaagaaaccttttcagagagttcctccgaacagaatacagtgaagagaacctacttttctggcttgcttgtgaagacttaaagaaggagcagaacaaaaaagtaattgaagaaaaggctaggatgatatatgaagattacatttctatactatcaccaaaagaggtaaaaatctggaaaacattgaggtgggcttcctaagaccaaggataaccgtcaagggatggctgtccacattgggtagggcatggggtgtggagagggtagaagatttcactgggtagataattcagcttctgttgggagaatttccttgaacacatgtttgaaggctaggtttccctactatgctttgactgtttatctctagctgacttgtgtggtagttcacttgcttttcagaactaacactaaggagcctgcttaaacacaatttgctgtgacaaacgaaaatggaaagagagaatgtattttagggtggtatttcgcaaagcatgacccctagatcatgtgaatgagaatcacctggagcatttgtttaaaaaacaaattcttaaggcctaaccaggacttctgaatctgaatttttggaaataggacccagaaatctgcacttttaacaagttttccacatacatactagttggaaaacctctggtataggtactcaaaaaaaagaaatctgacatgtttgttgatgtttatgattgactctttacagaaatgaaaaatgatccttgaccactaatattcttaggtgggaaatggaaattatattacttattctaggttttctgttattgaaagtgcaagtgtctttcccattgccaaaatgtacctaatcaataagcaatacttctagcaaccaaatagcacttttccattgactgtttaaaacttaatttgttcttgagaaatgttccagctaacagagttaaaagcatttggtgaaagagtggttaataatgtggccaggcccttggagccctgtgtgatggagctccagagggcttcaaagcacttagagaacatagaggttcctagaatgtcttctcttttccatcccagcctctttttgtcttttttgtttctcctaaacaactgtgatttttacctttgcatttaaatggcatgcccctctcttgtgcacctgaacatttatgggctacagtcatctgttcctcctccaatacctggcatggtcccaggctgccttacactccttgctttgagatctataaaaggaattagtgtctattttattaacctctaagtttggaatgctacataaacgatttcacttctaataagatatacagtacctaagttatatagttttttttaattagttaggttaaaatgccattggtattccagagtgctccaggactattgtctctacaaaatgagaaaccttctagaattagacgcacaaaggattgatttatttttttatttcctacatgaacatgaaaaatgtattcataaaagcaaggtggggagaatttaataaatgtaatacagtgtgacatcagtaataaatatgtagcctcaacacatttgttactgatgtcacactgtatttctaacaccggtataattctgcatcttaaaactgcattcttcaggcttttagcctgcctcgaattttagtatctaaacaactctacttgtattttatcagtataataattttatgctaatttttattattttaaagttattgcacatagcaaataaaccagatgatccaaatgtgcccaaatatgtgcttcttttgcctgtaattatacaaaatgagagtccttgggaagattatcaagcccatttctgcccccaaagtatgtaagatgtgacatcttaaagtgatagttgtctagattacttagtccattcctttgtgctatatttgtagcatcttaaaatgatgactgttccattctttttcagtgttaggagaaaaaatattctccatactatgtcccttatttttacagtttctgttctttaatgtttagttttttatgtaaaacattttcttattatccacacagcccctgattttctgatgtcactgattgatggagctttgtagaatacttaattttttctttttgaggcatgtttagagttacaatagtgattatttaaatataaactagtgagtttccattctttttgctaaagtaatagaggtttgttttcatctaattttttttgagacggagtctcactgtgccacccaggctgtagtgcagtggcacgatcttagctcactgcaacctccacctcctgggttcaagcgaatctcctgcctcagccgcccaagtagctgggattacaggcacccgccaacacgccgggctaattactgtatttttagtggtgacagggtttcaccatgttggccaggctgccctcgaagtcctgacctcaagtgacctgcctgcctcagcctcccaaagtgctgggattacgggtgtgagccactgcgcctggccgttttcacctaatttctttcttttgaacacaagtttcaccagaaagtcactaaaatctcatttcctgatcaagaacatgacctttccagaatgacatacactaatgtttagtgtcgtaaccatatttactctctcctttatgtttcctaatacccatattttggccattacccgttctttaatatcctcaaaatatcacaaagaaacagagacagaggtgaaattcaacttgttctaattttgccgacttgtaattaactcttggtatagaaattaatagaccattgaagtgccattgtttagccagctgatttctatcctgtcaacagagtaattaaatttaatcattgtttaatggcaaaaacaaacaagcaaaagtagatattttcagttataaaagataattgttaaaaagctatgttttaaaccaaggtatcctgttcattgactcgactcattgatatactcagcgcatggcatgcactttccggctattccgaagccagttcaatctattatgtacctcactgaacttcctgtgcaaaaagtcatccatttctaatcagccacaatacattactgacttacatcaagttaccactcttcagattttgttttctaacattggagagagcacatgtcagattgagagagtcctgattataccggaattagagcactggactaatattcaggtgcacaggattttaatcctgcctttgctacatcccagttgtgtggcctgggataaatcactttacccctctgagtctcaacattcagttcatttgtttacaaaaataacaataaaaataagcacagaaactaataaaccaaatgcataatggcaactgtaaggctatgaagctattgaaaaggtctgttaggccgttctgggctttctatctctgaaattctatacatgtttctatttattcagagtatttgtgctactacttcatcctctctacctaatggcatagcttatccatcatggtcctccttactgctgtccccacactgaacctcagaatctacttaaacacagtactcaaggcagttaataccaatctgagttcctatctgtttctcattttggggctagacaatcttggctttctacctctgaaattctatgcatgtttctacttattcagaatatttttaaagaacatgaacatttgactcattataaaatggtaatgcctaaaaattgtcatgattttactgttaaacagaaggccatttttcttcactagactttcattttaccttaatttgattgcgtatttgtgttcctctttgttaaatatagaaaaacaactacattttaaaaatcatttatatatagataactttttcccctaatgaaactattgaagtcaatgtgctaaaaattacattaccttattttaagaatatgttttatgcatttgtaataatttgagcattgtgttataaaataagagatatcaccgggcgcggtggctcacacctgtaatcccagcactttgggaggccaagatgggtggattacaaggtcgggcattcgagaccagcctggccaacatagtgaaaccccatctctactaaaaatacaaaaaattagccgggcgtggtggcgggcacctgtaatcccagctacctgggaggcccaggcaagagaatcacttgaacctgggaggcggaggttgcagtgagccaagatcgtgccactgcactccagcctgggcaaaagtgcgagactctgtctcaaaaaaaaaaaaaaaaaaaaaaaaaaaaaaaaatatatatatatatatatatatatatattttttttttttaagatatttgcaattaggaggtgacataacttctgttcttggtatagtgtacattttatgaaggaaaaggccaaactaaaaaaaaaactagaaatttacacatttgttttaaaaagtaaattttttaaaagtgatgtcttcaagggaaaacaaatgaagataataaagaggcctttaagcctaatagtagacttgctccacattgcagattttggtggcagcttatatttattattgaaaagatgtgttaggccaatcttgcattgctataaagaaatacctgaaactgggtaatttataaagaaaagtggtttaattggctcacagttctgcaggcttcacaggaagcaaggtgctggcatcagctcagcttctagggaggcctcaggaagcttataatcatggcataagatgaagggagatcaagtacatcacatgggcaaagcaggagcaaggggtggggaggtgccactcacttttaaataaccagatctcgcaagaattcactcactatatcaaggacagaaccaagaagatggtgctaaagcattcatgagaaatctgcccccatgaaccagtcatctcccaccagaccccatctccaacactggggattacatttcaacctgtgattagggtgggaacaaacatccaaacgatatcaaaagacaaacctagcaaaataaataacttgaataaaaaatctacttagaggctcttatcaactgtaaacagcattaagctactgaacaaagaaataactataaatccttcaataaatataagatatgtatctgaattgaagaaaaccatggtccagttaggtagaaatctgcctagtgatggcgttgtcgttaccaggactataaactgcatctgtcacttaccatctgtgagccacttagcagctcgctttagtgcgctggaacctccacgtcctagtgttatgaatgaaggcatggggaaagcccaaaaacccgtgatatctgtgatgttcaagctctggggaatggtaattgtaatcgtagtaggagtttgctttttctgatttttctaacttcccagttaccatctgagagaaaaaagtaatagacctatttgaacaccagaattatctacaaaataatgcttatgtgatagacatgcagattctgtgtgtccatgtagatatgtctttaagtgaaattatgtgaatttagcacattcaatgatttaagtcagtttttctaaacagaactcacttgactgtattttcctaaatgtatttttatgcacgcatattatcattcaaaaaatattgactatttcctatgagccaagcactggactagatgttggggatatgatgataaacaagagacactggccgatcccttaatggagcttacattttaggaagacagacaaatcttgttgaaataagtaactaaaaattgtgatgggctggagattgaattagatggaatagaagtagtcaggtaaggtcattctgagaaggtaaaattcaaattgatgcaaaagccaaacacattgggtttgatcaagatgatgtcataattatgatcaattattattaattactttacattggcttcattattggcacagtgatcttgcctatattattacagtctgagtctcacaacaatctttcagccacgaggaccgatggtaccactttacagcaaaagaaactgatactcaaagaggtgaaatgaatgtttgaggaaattataaatatatctggtagagatagaattcaagcccaagatcttctgattccaaatgtggtgcttttccaaatataccatgctgattaattcttccattgcctaatattttcttcctgatgttaccttagatttctataaacccaaccgtagaacttcacacatgatgagaaatagcaaccttaaccacaggcctgaaccctcccctagaccagcaggatatactttcctatcatccagacaccaccaagagtattacattacagtttaccctaccaataatctttgttctaagagagaaattcaaacaactggtcttatttgcaatgtgccattattttcaggagaaataacaagcacaaaataaaatgtgactaaatgtacacaaagtaaaaatgaaaattgataggaggatcatgtattctttagatttataaaatttaacataggaataccaaatttagttcaaattaaaagcagaaaagaaaatttccagtggcagatgttaccattggtaaaatttgatatggacttataaagggaaaaaattaatcagaattttacttggaaaggaattctaaataaagcaacttcagtaacagtaaaaataagagagaaaaatggagaaaacacttggatgtgatacgtgaaaaacattgttcagggaattaaataacataaagaaaggttctctacagagaaaaagactttcagtaaaaattcaatattctcgtataattatgccaaaaatgtccataggatcaaattttcccttgcatcttgatgactggaataaaaaggcagggtgaaaagttggtgtaccccctttcagcaatgctaacccaccttcatgtcctccttcaatgaataggaaatctagtaagattaaccagggtatatgactccgtttagcccagattttcccaagccacactaacaagatttctctgtcttcattctcctcgctttacctccatacttttgttgaccacttcgctctcatgactttttgcttgcaagtcccttgcttttctgcctccctgtctcctgctccctgtgggaatgaatgcttccaagttcaccgagacctattgcaaagtcacttgtgtctttttaaaacttcagttgctatgtctcaacattgccggacttttcagcactgctaaaactgccagttaaatgcggtcaaacctatcatgctgtcttgtgccctgtctcacaagggtagtgcttttgtgctataaattctgttattgctggaatgcactcttttctccacaccaccttggtatgggtctttgtggcctgagataagaggagacatgcattgcccgaggatagctcttatcttgtgctactcaactttctcttcccttaggatgagttctttacaggaaattcctcagtccctcatgcaatggagcccagataagatggctttagaagccatccagacacacctgaatcctagggtgactgtggcccaggcccaactgggatccaccaccaataccttgtattatagatgatccacattctgaagcacaaagatggcacaagatgaaacaatagattgttatccccatggggtttatccttattatttgacctcgctacacttcttttgactgatcgacagccttttcagacaaacaacctgatattaaggtaaatattttattctttaaatagaaataacaaatgcatttttgttatagattactaaatattgaactgtatgactttacaatatttcactactgtttttagcttgcaaaaaaattaaaaattaaacaatgaggacataagccatttaatagtttattttatttgtcttaagataataatgattccttctactgagaagaaacttttacactatatttaatgatactactttttaagaagtaaatgacccccccttttttaatctctaatgtaaggtttcctgctctattgaaacaaaaagttttctcaagtttgaaagaaaacagaggagtgtgtttggtaagaatttaccttaccataacatgatgttccagaataagataaatcagtttatctcagtttaaactccagtgtcagcatttccctctggcatataaatgcaaaaatacattttcaggtaaaataaaaacgttggggaaaaatattctgtgctttttaaaattactttgtacttgatagtgacctcatgtggtaataacagaaaataaaaactgaacaattcatttccagaacatttttatttttaaagaattcccaataaagacaaatgtgtagttcagccaagtaatgttttttaggcttgcttcagcaatactgcaggttcagttacagacaaccacaataaagcaaataccacaaaacaagtcgcacaaatattttggcttcccaatgcacataaaagatatgcttggctgggcgcggtggctcacacctgtaatcccagcactttgggaggccgaggcaggcagatcacgaggtcaggagattgagaacatcctggctaacacggagaaaccccgtctctactaaaaatacaaaaaattagccgggcgtggtggcgggcgcctgtagtccccgctactcaggaggctgaggcaggacaatggcgtgaacccgggaggcggagcttgcagtgagccgagatcgcgccactgcactccagcctgggcgacagagcgagactaaaaaaaaaaaacaaaaaaaagatatactatactgtagtcatagtataaacaatacttggcaatagcatagcaacagcattatgtcttaaaaatgtggataccttaattttaaaataccttattgataaaaaccgctaacagtcatctgagcttttagaaagtcataatctttttgctggtggagagagggtcttgcttcgacattgatggctgctgactcatcaggctggtattgctgaaggttggggtggctgtggcaatttattcaaataagaaaacaatgaagtttgccacatcgattgacttcctttcataaaagatttctctatagcatgtaatgctgtttggtagcattttacccacagtagagcttctttcaaaataggagtcaatcctctcaaaccctgctgctgctttatcaactaagtttatgtaatctaaatcctttgttgtcatttcaacaatgttcacagcatcttcaccaggaatagattccatctcaagaaaccactttctttgctcatctataagaagcaagcccctattctttagagttttattatgaaatcggagcaatcagtcctatcctcaggctccacttctaattctagttctattaccatttccaccacatctgcagttagttcctccactgaagtcttgaactcctcaaaatcatccaggagggttggaatcaactttttctaaattcctgttaatgttgatattttgacctccttcgatgaatcacaaatgttcttaatgactagaatggtgaattctttccagaaggtttttcatttgctttgcctagatctatcagaggaatcactatggcggcgatagctttatgaaatgggtttcttttttttttttttttgagacggagtctcactctgtagcccagtctggagtgcagcaacgcgatcaagactcactgcaagctctgcctcccaggttcacgccattctcctgcctcagcctcccaagtagctgggactacaggcacccaccaccacacctggctaatttttcgtatttttagtagagacgggttttcaccgtgttagccaggatggtctcgatctcctaacctcgtgatccacccacttcagcctcccaaagtgctgggattacaggcgtgagccaccgcgcctggcctctgaaatgtatttcttaaataatacttgtgagttgaaattacttcttgatccatgggctgcagaatggatgctgtgttagcaggcatgaaaacaatactaatttcctcgtgcatcttcatcaaagctctcggatgaccaggagcattgtcaatgagcagtagaactttaaaaggaatcttttttttctttgagcagtagggctcgacagtgggcttaaaacacccagtaagacatgctataaacagatgtgctgtcatctaggctttgttgttccatttatagttcacaggcagagtagatttagcataattcttaagggctctaggatttacagaatggtaaataagcattcgtatctgtttaaagttaccagttagtattagcccttaacagcagagtcagcctgtccttgaatctttgaaatcaggcattgacttctctctggctctgaaagtcctagatagcatcttcttccaatataaggctgttttgtctatactgaaaacctgctgtttagtgtagccacctccatcaattatcttagctagatcttctgaataaattactgcagtttctacatcagccatttgctgcttcaccttgaacttttatgttatggagataacttctttccctacacctcatgaaccaacatctgtgagcttcaaacttttcttacacagcttccttacctctctcagtctccacagaattgaagagagttaggaccttgctctggattagggtttggcttaagggaatgttgtggcttgtttgatcttctatccagaccactcagactttttacatttcagcaacaggttgttttgctttcttattcacatgttcactggagtaacacttttaatttcctttgagaacatttcctttgcctacacaacttggctaactttcaaaagaggcccagcttttgaccagtctcagctttcgacatgccttcctcattaagtttaactaaccatttcttagctttttatttaatgtgacagatgtgtgaatcttcctttcacttaaacacttagaggccactggcgggttattaactggcctaatttcaatattgttttctctgtgggaaatagggaggcctgaggagagggacaaagatatgggaatagcaggtcagtggaacagtcagtatacacactatagtcatcaattaagaattaattaagtcttatatgggcatggttcatggcctcctaaaacaattgcaagagtaacatcgaaggtcactgatcacagatcaccttaaaatatataataatgatgaaaattgtgaaatattatgggaactaccaaaatgtgacacagagacacagagtgagcacacgctattggaaaaatggtgccagtcgacttccttgacacaggatcgccacaagccttcaatttgtaacaaacgcagtatctgcgaaaaactaaataaagggaagtgcagtaaaatgaggtgtccctgtatgagttggtctggctaagccacagaaatgtagtctggattgccatctcccaacaaatctagtagccatccctggggtgtagcaatcaacccaaatccacgtggtctgttgaggtcaggaacctggggacactggatggaataggagaggcttcaataagagactgtattagttcccagacttagtctgaacagtggtgggaaaagaagccagaactaaaaggcatttgcagaatgcttatgacaacatgtttaaatataaatatggaaggttttatgtgaatatgtcatgaaataactatggttcacaggtcctattccttgctaaacagtgaggatcgaggaaaacaatctggactttgagtggttgtttaccacttgtagggttgttctaacatggtgtttcagcgcagggctttagttctgttcctccaaccatgcccttattgccaagtatttttccccatttccctttccaacatgttttaccagttccaagaggatttgcatttagtgaggaagggggaagatcctaaatcattgcagaatttaatttttgtacacttttcaaataacactgtattgattatcttaatggtcattctgcattcctattcctatttctcctctcaaagatctcactccaagcaactgatctgcttcatcgttagtaagaggtctttggatatataaggatgtttgctagtccttgccaggtagatgtgagacctgaagcatacctgctcattgcatgccctgccacactcttggtttcctacttttgacacagtaggacttgttaggatacaaaactgtggggagttggcattttatatgcatgttaatttttgccagggaactcttttctgccagtagatttttatcttcttatcaatattgccaacctcccccagtcacagaatagcaggaggtgaattcacattctggctaggaaatttctggtatctcaaccatgattagaaattgtcaaaaactcctgaatgaatgcatagaaaccataaaaccaagtaagcaaagacatctgtaaactaaatttctggtttaaaagacttaattggatttttttatttagtgcaaattttgaaggagaaaagtacataaggttgtgtagtctcaaaagatgaacccaagacttttggtagttggatttgctctttaaagtttctctaaaatgtcacaaacctacagttacttaattgaggtcttttgaaaaaaatattatttaatgtatttgctcttgtttctttttaggtcagtcttgattctcgagttagagaggtgatcaatagaaatctgttggatcccaatcctcacatgtatgaagatgcccaacttcagatatatactttaatgcacagagattcttttccaaggtttttgaactctcaaatttataagtcatttgttgaaagtactgctggctcttcttctgaatcttaatgttcatttaaaaacaatcattttggagggctgagatgggaaataaaagtagttaaataacatcagaaactgagttcctggagaactacagtttagcattcctcaggctactgtgaaaacacaaccgttatggtctttgtctccatttttatcaaggttttccatggttaagtttggagaaaataccacacaaaacaatgaattgccaaattgtttgttttattcaagactcattctacttgcaagcaaagtgtatttgtagtcctatgaacagtctcctcgtgtatctccagagactgcatgtgcaaagtaaaatgcttcatttgccacatagttgttgtaatatttaatccagtagcataacttatatctgtatttaaggacttttgtgcaatatggtcttaagaaataattgccaaaaaaatcggccatggtttgcattttttaacataatctaagacagaaaaaaagcaatttttactatgtaacaatggtattcaacattctatatactgtgtttagtacactaattttgaagccaatatttctgtacatgaaaaagagctatttatctctgtttgttggaaaatcctaatggggattcctctggttgttcactgccaaaactgtggcattttcattacaggagagtttactatgctaaaagcaaaaaacaaaaaaaaaaaaaaagggaagaaggaaaaaagcacaaaacaatttgaagatatcctatctcaatgacaaatcaaaagagtgatattgcttttaactgtaatagaagaaaatgaatttatgtatatatcagatgtccaatactgtaattaatttattaaagactggctctccagtttt

SEQ ID NO: 38600 - DNA, 16477 bp, Homo sapiens
atggggaaagtgtcctgctgtggcatgaaataaatgaaacagaaaatgatggcaagactgctaagaacatcctttgctttgctcttccttggcctctttggggtgctgggggcagcaacaatttcatgcagaaatgaagaagggaaagctgtggactggtaggtaaatgaaatggaaggactgctgcatgcaaacagcctcggtacagagttggcctggctcactgcgaagttcctaaggggaatgtccattctctttcctccctttacaaataaaggaagttaaagtgtgcaaatcggccaaactcccaggcaggggtaggcttctgagtgacggagtttccccctgaaaaagagctgagcagcccctcttgggcctgattcactgttctcagcggggcaaggctggtagccacagaagtgggattgagctgacagcttctgtgagctggcaatttcttttaattacatcatggcttttcctaacagaacacttccaacatcctttgaaagactgacagagtaaagaaggcagattatttttttctgaaaatggagcatgtgctgctccttatgagaaagagaagggggacctggtcacacacagcactgtttgcctaacatcggtttgtttggaagcagaggcagctgttgccatgattggtacgtaggccactggcctgttgtacagtgtcaaagacattaaatgctgtgttgcattatagtcatgggttctcctaaagctttaactactttttcaccctttaattgggatatttaggtttgccataatggttggtgtcaagctttttgtgtaaacttcaggctacagaacacagatatactcaaggcagtagtcagtctttcctcagttactgagctcaacagaggtctgtgtggagttttgaaaatataaatatgaacgaaacatggttcctaccctcaaggacctcacagttatgtggtaagggcataggtggaacactggggaacagagagcccagaaaacttctctaaggatgtaatttttgagctaagttttaagaacaattaagaagtagctggaaaaagaagggatgtgcaagagcatctcaggccaatgaaggagcaatgaggaggtagagaggcaagaagcaacatggaaatttgggagttgcaaagtagtttggtattgctggaacttcaggagaatacaggaagatgaccggaggtgaggttagagaggtggggacagccaaggggtctgtgtgctgagctacaaggtttgaacttgacattgaaagggagctattggaggacttcacgcaggggtgtgaatggtcagatttgcactttaggaaacccattggcagtactatgagggctggatggatggggagcagcctagaatcactgagaccaggagcacttttgcagcattacaggtgagaagaggtgtagacctgagttaaagaagcggtcatggaaatagaaagaaggacatgctgagaagacttggtgatggatgggctgcagccagtaggagaaagggagatgttaagaaataattttaggttggccaggcgtggtggctcacgcctgtaagcccagcactttaggaggcctaggcagacagatcacctgaggtcaggagttcaagaccagcctgaccaacatggagaaaccccatctttactaaaaatacaaaattagccaggcatggtgacgcatgcctgtaatcccagctacatgggaggctgaggcaggagaattgcttgaacccaggaggcggaggttgtggtgaaccaagatcgtgccattgcactccagcctgaataacaagaatgagactccgtctcaaaaaaaaacaaaaaacaaaacaagaaagaaaaagaaagaaataattttaggcttctgcttctgagactgcatgaatatgttccctaatagtgtgggatgagcagatttggagcaaaatattataaatttggtttcaaaaatacggagttgggggttaatgggacatctttgagtttaggtttctctggacctcagcagaaaggtctgggctagaaacagactgaggactcttgagtacataattagagacagtcacccaggaaaaatgtttaaaagtactagctctcaactggtgtgccacggcacactgatagttcacaaacccttcactggtgggccaccaaattgtgattgatatggaaaatcatttttgccacaagtgaatggacatattacttagcaatgtctgttagagagaatataagcaacttgttgccaagctgctaacatttattgagaaaggtaaggaaagagaccatcaagtcagcaccaaagaataatttcatgtttcctgccacatgtgaggacctgaccctgtaagaaagcataagcagggcaggaaagagttcacttaaattaagtataagaccgaaggggaccaagtgaagagtgtgcagcttttacgggtttgtgacactgttgtatggtaatagtgtatatattataatgtttggtgcactgtgagtgtttaggggttaatggtggggttcatgctattagaaagtatttggctagatcagtggttctcaaccgagggtaattttgccctcagaggatttttgataatgtctggagataattttgattgtcacaacttggcagtgctactggcatctaataggtagagggcagggatcttacaatgcacaggacagctcccacaacaaagaatgatcggctgaaaatgtgaatagagcacactgagaaacgctgagctaggtaatccaataatgccttaatgctgtcttggctgagctacctctcctccctgtgagatatccaagggagatatacaaatggaaaacaacagtaaaggaaggaaagggcctacttaattacttggttttagccctgaatcttcaaggcagagtattcggataaactgagctgaggaatgcagcttatgacaggggctcaaagtaccttccacctctcctgaagcccaaacccaaatctcatatccagtcagccaactgcatggtctgggccttggccttctctccactgtagccacatggatcatggaagcaacagaaagagccactctcaatgtatatggacttccacttcagggactccacccaccagtataaccaaggtcttagaacatatccaatcagatttttattttcttctctggggaggagcaaagataagagtgaagaaagaggcaaagagcttgagcaaatccctttccttagaggccttccatgaaacagaaatgagagatatattaaagtgtgtaatacagttactgccacaggaaaacagtcaataaatgttagtaattcataatcattttgtctgttaggtttactttttataagttacctaaaagacaaaacaaggaaagtggagagactgggttagagtacctgtacctagactctacaactagaagctggaggaagagtgagcaactaatgaatgacaccaagagtgttttgggaaggacattacaacagctatatgaagcatatgcctctaaggtatgttatatagttaattgttcacttgaataatataaaatgcataaaactgaatccaaagccttcaccagagttttctgttcacccacccaacccccaatcctagcaccttgaagtgagctagctcaggaccagctcaagacaactatctgagtcaatctgactaagacctgaggaaacatgtcatcatactctacagcaatgccaaatttacttggcaccatgtccagtggtgtcactaggcaaggtgtgaattaattgtatattgaagtcttctggctgccaaaatgtctgtcagtttgcttattcatctaatagaaatagggagaggagcctctgctgttacagggcaatacagaactgtgattaacatgctatgagttatggattgtttatatcatggtgttgatcagtggtggtgagctcagtaaagggttctacttgatcttccttttcattaattgttttcaaaatgatatgttgaaaactaggactctagttcaaggccctagaactaacttgtctggatggagattatccctgctatatctggactttatcaggcaatgagctaatcagccaaagagacacaggtaagtaggcctgctggcttattatgggcatgctcccaatattctaggcatcatctgttgcttagtttcaagatactgctttccaaccaggagtggcaagtaaaatcaagccatgattaacatccaattatactcatgtatgcatttcctaacaataacttatagacaagtaaatatataacatgactctgctcctataatatgctggactgtatgctgggcctttacatatgtcaagtaatttaatgcccacaacaatcctgttttagcctctggcactgcacatgtgtatctgagtatttactcaaaatacacacggaactgtcatggtgtgtggtaatattcatgttatttacctgccattaagactagccttcagagccaagctacaaagttaaagcttatctgtaggctatttgagaacatgtgatgtgccaagcacttttctagatgcttttcaaaattatttgtctcaacaaacctgctttgaataaacagacgacagctgacccttgaaccatgctggggtaggggtgccggccctcatgccgtcaaaaatttatgtacaacttttgacttcctaaaaatttatctactaacagcctattggatgccttactgataacatcagtttgactggatgccttactgataacatcaatagtcgaataacatgtaatttttatgttatatatcttatatactatattcttacaataaagtaagctagagaaaggaaaatgttattaagagaatcattaaggaagagagaatatattcactcttcattaagtggaaatggatcatcataagtgtcttcatccttgtcatcttcctgttgagtcagctgagcagaaggaagaaggggaagggctggtcttgctatctcgggggtggcagagatgggagaggtggggaaggtggaaggggaagcaagagaggcaggcatactcagtgtaactttcacatgaaaatacataatgaattctatctatttgctttttcatttctccaaaaatgtttctatacagtagtaatcattttttcaccatttgctttagtttcagtgcccgtatcacagaagggttcatgttgtaaaagaagttaaaagcaatctttatatttttttcttttgagacaggatctcattcgacacccaggctgcagtgcagtggcaccataagagctatctgttgcctcgacctcccaggcccaggtgaccctcccacctcagcctctggagtagctgggactacaggcatgcaccaccatgcctggctaattttttttttttttttttttggcggagggggtgggtaaagatagggtttcatgatgttacccaggctagtctcaaactcctggactcaagcaatccacccatattggcctctgaagtgctgggattatacacatgagacactgcacccagcctaaaagcagccttgaatgatcagactgcgtctaatattgatctgtgttcttgcaccacctcttctatgtcttcttgctcatcatctggctctggttccattgagttatgttctgttaatttctctagtgtggtgtctattagcttttgaatttctccaggaatcatatcttgaaatccatcacccccaacctttcttgccatatccacaatctctttcatgactttcttgattgactctgtcataaatcctgtgaagtcatgctcaacatctgaacacagatttttccagcaggaatgtattgttttgggcttgatggctttcatggcttttcctataacagaaatggcatcttcaacgctgtaatcctttcatgtgttctatcatgtgttccatagcactgacaatcctttccagagagcatcatatgtaatgagtcttaaaggttcttatgaacctgatttagaggctgaatcagagacattatgtttgggggcaggtggacaactttgacacctttggtgttgaactcatgggacttttagtgcccggtggcactatccaataccaaaagaactttaaaaggcagttccttactggcaaggtaccttctaactttagagacaaagcatcactggaaccaatttagaaaaagggttttgttgcccaggccttcttattgtacaactggcagctggtatgtatcttttcccttcaaggctcaagagttagcagctttatagataggtgtagtcctgattatcaacccaactgcatttgcacaaaacagtacagttagtctgtcccttcctgccttaaatcctgatgcttgcttctctttcttaccaataagtgtcctttgtggcacttttttccagaataaggaattttcatctgcattaaaaacctgctcaggaagaaattatttcccctcaatgattttcttgatggcatctgggaattcatctgctgcctcttggtcagcaaaagctgcttctcctgttatcttaatttttttttttttaggccaaacctctttctaaaattgtcaaaccatcctttgctggtattaaattctccagctttagatgatctaccttccttctgctttgtcatatagtgacttcactttttctccaatcatattagagtctatagtattcctttcttatagcaatcttgcacccatataaaagctgcattttaattttaagtatgagctataaaagtattttgtaaaaagtgcaaggttttcatgcctactggcatagctgcagtgagggcttcacaaatttccttttcttttttcacaatggctcttatgctggattcacttaacttgaaatggcaggcaactgaagctgcagacctcaatccgcagtacatatcaagcaattcaacatcttcttataatgtcatgacttgtctttgcttgttagaagcatttccagcatcagcagtggcactcagtataggtcctacggttttattcaaggtttctgatattgccccaaacatgatgaaaaatatgcaagagctgtgagagatcacttttgactacagtatgcaatttactggagagaactgctcacgtggaggttgttagtgtcatgtggcattttcagcagatattcacaagacttgagctcacctcaatggtgacaaaaggtggctataaaattattacagtagtacagtattactacagttaatttaatgcagttatgacttagtactgcatatttatgtttgtttatatttcttgactgtgaatggcaccatgtttggtctatgtttgtatatgtaaattttgatgaattttaactttttataatagatttgtgcatagtttagggcagcaaatgaaaaaatagactagtatctacatatattgtatgcattcataatgtatctaactttttcttaatttttaaaaatatttctaggctatgtggttcatctgtgagttttttttttcaaattgtcaaaaatctccccctaaattttccaacatatgtttttaaaggcctgcatacatatagacccatgcagttcaaacccaagggccaaccgtattatataaaatgaaaacgcctgcagctgcttctgctttccaggttggggatggggaccagaagcatatctattagtgggaaaataatgcctacattgttcctttccacatcaacgagactgctaggggaggaagaaggaaagagcaacattgtaaagcctctatcatttgccttagttggagtagataggccttcacttgccggaatacaataatgatctttgaaggtgcaaaggtagccccacaccctagcagggagacacagttaaactgctctgctaaacaaaaaagggacagaaagaagccagggattaaaaagcataagaaacatggagaaagactggggtaaggccttatggtgatgtaaaaccattcaatatttcttacctttagtaaaacctgccacatgcaatgtcttgagtgattggttctggggggaaaatgacaggaaagggactgatttccatgcctgattggcatagagccaaaagaagagagcaacagcagttggtgatatccaggtatgactcagtgttctttggaagctggaattatgtgccagaagtgactgtgagaatattactcctccaccccctgacctggaattgaacctctgacagagagtgaaatgcaagattagaccaactggtttaaatctcaaatgtgaaggtgaccaaggccaatagctgggttacatttggaattgtttcccttctcttgcctttacaaataagaatcttccgtgtaccttcataaacatttatcaaactatattgcctgcacttgtgtgactatattttctgctagacagggggcagagactgtacccctcttgttcaacactcaatagtcaaaacaatactgaacatatgtgttaaaggaataaagctattcaaaggcacatgcctacatctacctactcttaagtccatgatcttttccctttatcaatagcctctcttccaactaaggctacaatccacttaacctcagctggcagttacactcagttagaacaataaacttcatttatcataaaaaataaattcctcactggatcatcccagaattcctccatgttgtaccccaaaggcacacaaatggcctccttaccacattcaatgcaggttcacagagtaactaactcttcagagttctccaaatgatgatatgaatgccattcagtagctatgatcaattatggaaaatgaaggtaagaaaacagcttacttttcggggcattcctaagcacagtagacaagaatgctccaacagactatgttgtgcattgaaaaaaaaattttatcacatcatataattaagcaactgtgagaggcttcttcattgaatttgttttctaagaaaaaagcaagggccttttttaaggacataggttatcctttcctgcttttaattatgtcactcagatttttttaatattgacattattggcttcaattaaagttgtatcatcacacaaattaaatggaaccacctagaacaaatattagcaagtttctaaaacatgaaaaatagatactatcgaaataatagctttattttggctctaagatttggctgtttgaaaattgactcatatttggccttaccagaggaaatccaatatcacacagtaaatttcaccactttttttaagcaggaaaatatcaagttggaaaggtgaagtgacactgaaaaatggattgcagaaaaatcctctcataatgggaggaagggagagcagataatgagggatcctgattaaacacaacgctactacccagcagtgaagtgaagcacaaagtgtgcagagaaaatcagatcctgacagccagttctgcactgtgcctataatatcaatggaaaaaacctcagatgtaatccttggttggttgttcctacttcatttcctgaacaaataattcagtactcctttattatacactggttgcttaatcagaaacttggttccaaaacaaccaagagaaataggaacattgccctcacacacagatcacaatgcacagggctcctgtcacatgagtaaaaatcatgcacagttaaaaatggactttctttcccctgtctttcatgtcacaggcttcatattgatggggaagctgcctattaggggaatagatgacttctcatgtgtattaatgaaagcaatgtattgcaggctgggtagctggtagaaatgttgtgggcgtttgtaagtggaagatttacgccattataaccctaatatattcctgcagagtaacaacacagcctatctaatatacaatgatggagtccctaaacctgtgaattacagcagaaagtatggacacaccaaaggtatgacaaagattcttggtttctctttcctactggaaatcaacaatttcttaaatatttcatcttgagtatccttatattccatactaaatagatagcctttcttcttaatagtttatttgagttattgaaatgtatgacttctatatcactggttataatataattatatgatttgacttggcaatctcatttttagaaatcccattttatttcttaacatattttaaaatatttgctttgcagcagcaggaatccaggtactgatactgaggacacacacacacaccagcaattttatatatatatatatatatatgcacatgaatatgtatatatgtatatgtgcatgtagtatatatgtacaaacacattttagtcagatttattgaagtatgatttatagagagtaaaacgagctcttcttaacatacagttcccttggaaatatacatttttgaaaaagtattttaaatagctttttatattaatttttatcatgttatttacattatcacatataatttttattatcctttcacaatttttttatttctaaactttgcatatgtgtttgtgaactacagaaaaattcaaaatacaggtaaacaaaaaaatctataatcctaatgcccattagataaaccatatttaatcctttctactttttctaaaatacatattttaaaacatttttacaaaactactgtaatgactatttttcaaccttttttcaatttcatatatcataaataactttccatggcaacaagtattcagaagattccaaattcaaatgccttcaagggagcaggcaaatgatgtcagcaagtgaaaggaggcagttactattcaacttgcctgatacggacacaattttccaggagatgttgaaaattaatatttgtggaaaaactccccagtttttaaatgttggcactaaattcaaagtttaaaaaatactctgcaagcgcaataaaatgtatccacaggctggatttggctcagaggatgtcagtttgcagcctctgatttagaatatagtttgtaatggctgacaaaggtcatgaactttgaaagctttttatttagcaaagttgctctcctgaataccctatttactgggaacccaacaattttcataacatgctacattcttcaacctctcctccaacaatctcccacactattcctgctctaccctgctaactgccacaaggctttggggaaatggctctaaagaagtagggcacaatatcaagtggaggggttctcttggccaacagatgccctaatatcctatggcatttgtaccaggaggataggattccagcaaattggcacactcatctgcacagaggataactcttgaaggttatccagttctgttacacacagaactttcaatattttccaccttgacacaggtattgattctatttccacccaaagaacaacagtatgctttcttaaaataggcactttgaaaaaaaaataactagaaggcatttggtttttaatctaacacttaggcaaacacgagtgaatcttatgtttgcatagtcatatgcaaactggaaagtctagctatcataccaaacctaccatgataaatttctaaacacaaaaatagtcagatgtctgttttacaaagttctttttggtatgtcacaaaatgataaaaatctttctattttcttccttattggctttcaagttgtttattttgctctagagatttttacaaacgtaattaactaggatgctttagcacagcttcctttttgtctctttgcttcttttattgggcttgtagaaatagtgactcttctgccaataaatgggcagcagttttttataacaaattattgtgagtacatttcttcatttgatattttctctttcaactctgttttttagtcagcttttgaaaagagcctagctgcttagcagtgaagacactatctaaatcttgctaggtgactgtatagtttaacaaggtccaattccaatttagcaaatttgcattctgccaaaacaaattttccttgtgatttcaaaatgaaattcctcttaactcttcacaggatggctaccttggttcccttttcgtggtggctttttatcagtaatcaggcaatgtgatatgtgccagaattgtatttgaaatctttgaaaaataagcatgatccttgtgattattagcctaataaaacactagtctgaagcataaatgggcttaaatgttgccactgtgaaccctattataaaagaagctttgtttttctgatttatctttgttaaatgtgtctttggtaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaataggtaaaactaaagtatgtgagaaaaaaaacgataactatgttgaagaaatgatttggaaatatattcataaatgtgtcacttcatttgttaatctattcatagaccctctgatacctagattctaatactggctttgccatggtgaggtcttgggcaggctcgcttactgggctttggctcttaatctaccagtgcagttgttgaacttgatcagggcagtagtttcaaatgtattcaggggcctggtagataacatatatgagtgaaacagacatgttacatgggaagtgaggatagtgatgaactggggtgttgactcacctagcttcccttaaagcctcagttccatcatactgtggctctacaggaatacaagcctaatgattacagatctccttatttctcatgaagtaccagaaacctagggtgtgtgtgtgtgtgtgtgtgtgtgtgtgtgtgtgtgtgtgtgtgtgtgtgtgtgtgtcagagagagagagagagagagagaaactgatttccaaatatgagttcaatcttaattttgtttttgaagttttccaggccacatgttccttgtaggccacaaacatgacacctctgagccagataatctccttttaagatttcaagctcagcgaaaaattcttagatttggcaaactgtggtgggaaaggagaagtagggacaggttggtagctaaatagtagtgaaaagcaacttgcctatagaaacaggagatttagaaaatgtttctcatcaaatttccatcttatggcaaggatcactgagctcctcacccaagtcaagctctagtctcactagttgaaatcatgtaatgatgccgaatatcacagagattaggcatgcacactgaggagatgatgattcttaaagctttttggtacatggagttctcaacttttgtatatgtatatgtacatttagaagaaaaaatatatggtctccaaggccaaattacctgggttcgaatatcaatttcatcaattacaaacttcataatcttgggtgtgtgatgtaaattctcagttaattcatctataaagtaaagataatgataacaacagaatttgcctgataacatgtttgctgtgaggattaaatgaataaacccatgtaaaacttgtaggaccatgtctggaaactaggaagtgcttaacaggtgttagttatttaaacaaaaagttatttgaaggctattggtttaaagaaagaaatgcctttgtttttgtgttgttttgtttttaaatccacaaaaagatctataataacagcaggtatttccatttgtgtcttaattctcaacttttctttactgtttcttgattcagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacggtatgaaagaccatcatcaaacaacatgctgtataattctgctgttgaactgactagggatagcttagagaaatattttgagtattcagagaaagagagatgaaaaaagggagcaaaagaaaaggaaaaaggaaagtcacggatcagttcaaacatcagccggctatatgagtcaaccacaaaagtatctcacaaccatccagccacgggccagtgaaaactcagtctccatcctctgcttggcaaggggccatagccatctccatttcttccattccctgagtggttattttaagccttctttactctcaagccctttacactactctgcaccctcactcatggcttccttttttccttcataaatagaacaatgttcactagggagaaaccacttctatatgctaccccccccccacccctccaacaatcttatctgttctccttcctttttgcagggtttctcccacccccaaagaagtgatgcaccccctatgctctgaaacctatctcagcctcagcataccttgatttgtccacctgatctgttctctgtgttccatttcagttctcccactccccaggctactttctcataacatacaaacatgcctaaaaaccctccctcaactctaaagcatctatagctctatttttccttttctttcagatttatttttttaaaactcatcagggccttcacttgctcaatgttccttcactgcagtcttgcttctgtctgtagacacttgaatctctccccagtcaccaatggctgtcttagatgacctcactgtcttccttgcttatttgcttccttcctttatacgttgaataaaatttactgaatgcctactactagccaagccctgtgttaggcactagagatcttaaacttgacaggacagagacagtctctgcagaatgtggcactgttgaaattctttcctttttgaaactctcaccttcactgattttggggaacacgcagtcccctggtctttctcccacttctaagtttcttctgccaggtccttttcctctgactactctttaggtgactgggttgccatgtggcccctacccttccttatctcattctacatacccatgctgggcaattccagcaagccctccaatgattctcaagtcttgatctctaccccagacctctatactgactgatgtatttaacagcaagtgagacatttctacttgaaggtggtacagccacatcaagttcaacatgccaaactcactgcgtcatcatcccctacaaatctactttttcttgtattctgcatagttacccagtcactccccatctcttctttttctgacccttctatcaaaccatcaaattcagtcagttccagatccttaataacactcacatgtattgtatcttctccaaactctttgccactgccatgggtcacacctgtgtttattgacacagttattatgacagccttatgtttttcctttcttctttctaacctgtccttcccaattcatcctgcccattgcctctcaactgatatttatgatcataaaccagtttctattaattctttactaacattcctttaaaaactctccactgatttcaggaaaatccaaacactttggcatgatttacaaagttccctagaaactggccctaattccttctctagactaattttttccaaaggtctttccaggacaaagacatatattgcttcattcgttttatagaacagaagatgtttgcaaacaccaacatcatcatagtaatgatgataataacttacatttgcacatcactttagcatttacaaaatgttttctcatccactatctcaattatgttgttattattgtgctcgtgacatccacatatcaggggtgaaagatgatttccattccagagtatattttcagggactaatctaagtgtaaataccaacctcactatctttctcctcctaaaccctagacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgtt

SEQ ID NO: 38601 - DNA, 150034 bp, Homo sapiens
aagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaaggtgaggcgagtccgccagccggcgggccccacttctccttccgacgggctgtcctctcccgctgcggccgggcgccccggcctcgccgccgccgccttcccgggcttcctccccggtcacccccggcccctgcccatcgcctcgggggcgtcgcgcccagagcccagctgcgtgtgggaagcagagtgtagtttgcgggcttcaatccacttccttctgccgattgttttcccgtagcagacggtgccaggtattgagagcgaccctcacattcctacagtgctctgtgtggcatcttaatgaaactttattctctccccttaaatgagaaagaatagctagttgtcatcctttctgaaccgattttgtctttcaaaggtagtagtgtaccaggcctgctattttgcaaaacggtctccaccaaaatcgaattacctgcctcgcggggcaggcgtgttgaccaggtggactctagaagtaggtggtttgcttggtttcttttccttttaaggtttccctttcttcttcttcttttctgtttttttttttttttttttttttttcaatatagaaactgtccctaagagaggaaacctttctggccatgttattccaggaatcttttgtcccctaagtttgaccttgttctttcgttcaccctttactcttgcatcagtcacacattcaaatggtcactcactaaagaaaacaattaaaaaactgtttgtgaaactttatatctttaaagtgaatagagatcattctgctattttagattttgctttcagaatcttaagtgcactatcatggcttgcaccatgttctgaagagtagttggccatgatttaacttctttttttaatttttaatttgcgtgaaaagcattttgggcaaaagagtaaaccgtgccttagttgtgttggtattacggggacagttagggtttactgtgatcaaccaccagagttatgtttggtttatctgggtgagtaatgaatgccccaccctgttgtagatttggtgtagattgcaatattctacctgtgcttgactttagaataagacctgttctaaaatgggctgtctacatacagcctgctaaatttttgctttgagattatttttagaattttatgatactgctttaaagtaatcgaagatactcaagtttggaaagcaaggatagtgcattgttattttaggcacgttgggaaagttgtttttgagacttgtatgttagttgatattattggtaaagttagaaggatattgcacactgcactttatttacagtgaaataattcaagatttaataatgagaatttaaaagagtttccttcctaatcctccctattctattttgaataccttcaagttcaatttttaaagacttaaggcttaggaaagagcacatggtcatgtgaacgctaagcaatatttaatatgtatggtaccatttgtttataattgtcttcagtgttgaatattaaagtctgtttcaaagtgagaaataccaatttttcacttcctaagtttgaacaatgggaagaactttgtaagtttaggatttttttattttcatttgattttgactaaactgtattaaataactatgcaggctctattgtatggttcagaggttatgcataaaattgtagaatcaagaatcaagttaacgaaagtgatcttggctgtcgagtccaatttcctactttaatgaatcccctccacacacaaagggagtagtagttaattcaaaatattatcattatgatgctacttttagtatggctgtgttttagatcatttcattgttattggggattttttttagagaaacttttatacttccataatatttagattgttttacagaagaaacacttaaatgtgtttgctttccgtattaatacacgattactttgttactcatattagaactatttaaaaatatttatatggatacaagtaaaccatctacctcgataagttgacagatttaaatccgtcaagctagtaaccaggaagcggacttaaagctggtaactaggaagtgaacttcacacttagaagaaacaaaagtgaaagtctgtttttactcagacactttatgggttatctaaaaggagaggtgtgtagtgtatattgcatagccaacattttagccagttttcttctcaccttaaaaaactgtgtgtacatatgtgtttttaaattttaagtatttactatttaaaatttaagtatttactatttagctatattattttcaagatttttaaaacttttattttgcagatggatgtaagtttttttgttgtttgcagcaccacactacacaaaactttcatgattttttggttcgcctatagaattcattagtctttgtcacaatgtagtatgatgaggcaagaggctgcctttcccttttgatgtgttctttgcttgattgctggagtttggccaacccagggacttatgagatgtagtaaaactgcagaaagctgcttttctgaggtttaggtatttcaggtgaggtgcagttggcagcagatgagttaaattctgtgataattttggttttggacatatatcttcagcctttgtgcttcatgtttaccaaagtgtaggagccttagatctcagaaatttgatacatagattcaagttccaaatgaggatactccacggcgcccccccccccccccccaatctatctaacccgatgaaccaagctaggattctttagggcagttattattgggaggagttttgctcccagggaccaaattaatttacagagtgaaatgaacaggatactatttaattaaatgtatccttctgagttgaataaaatatattgtttcactctagggcttagaacagttctttacacatagtaggactcagcaaatatgtgatgaatgaaataagtgactggtttccaaaaggagtgtagtactttgtttcctaactgaatcttggaatttaaaaattattgagaaacaatgaggctgggcatggtggctcatgctttaatcccagcactttgggaggctgaggtgggaggatcacttgaagccaggagttcaaaaccagcctgggcaacaaaatgacacctgccaggagtggtgtctcaagcctgtaatcccagtactttgggaaggtgaggcaggcggatcacgaggtcaggagttcgagaccagcctgaccaacatggtgaaacccagtctctactactaaaaatacaaaaattagccaggcgtggtggcacatgcctgtaatcccagctactcaggagactgaggcaggagaatcgcttgaactcgggaggcggaggttgcagtgagccgagatcgcgccattgcactccagcctgggcgacagagcaagactccatgtcaaaaaaacaaaaaaccaaaacaaaacaatgaaagcttgaaaaactgtgcgtgctcatgctaggagaataggcagtggtactgaaagacaggatgtgggatagatctcaaccacctttttgtcaccttgggcaagtcattaagtgcttctgaaggttctttcaaagcagtaatattagtatgttaacagtagtatgttaaggctttaaactttagcaacttctttagattagattgtttaatggtcctaagcaagtgttctgtatagggagaataaaaaagaaacagtatagaatggaagcagaggaatctaacagatctacagtcaactttcactgaattcctccaaagatgagggttaggtgggaaggttgtcatagattagccaagttcaagagttaaaacttgaaaaacaatgcagactggattcagggtaaatttcttacttaaaataacatgtattttccaatttaggattatctaaggttataaaactataccatgcagcatttgatagttaacattacttaaatcactttaaatgttacttaaaggaggcattctttattaggaatcagttgattatcttattattagtataagacttgatttgggcagagaggtttccagctgtttattccttttcttattctttccttttcacacctacttttgacttgtagactcacattgtatccagtcttttaaatgaattcacatcatttctaataaatattctgttgattttcttcaatattatatgtatacagtccatatcctttacaaatacttaatattctgacctctttcttgtcattatttttaccacttattactttaagatgacagaatgctactacaatttatgttagtttctattatatattgtttccttataatatggaaattttcttacattcctaagttttataaatgtttcaaaactagatttagatgttgactgtcatgtctttttctttgcagtgaatgatattttatgtcagtaacataagaaccatttgtacatacgatatatgaatatttactatataatccgtgtaaggcgctgtgctgagccttcttacaaacttttttcatttaatctttccaaccaccttatgaagtgagtgctatttttctcctttcttattgaagctgaagaaacagtattggagaactaaagcaacatttcatctctagtatgtattaagggttggataaactcaaaagtcatgtgatacacaagcccctgctcttaaccacaatgttgtatcgttttggctgtccttgaattcctgataaaaccccatttggtcatgttgctttactattttaaatatgtttctatatttaatataataaatttaaacctagaatttggtatacaattggccttctgtatccacaggttctgaatccatagattcaaccagctgtggattgaaaatattctggaaaaaaaaagcattgttgcatctgtactgaacatgtacagtctcattttggtcattattccctaacaatacagtataacaactatttatgtagcatttacattgtgttaggtattataagtaatctagaaatgatttaaagtatgctggaggatgtgtggatgtgtaagttacatgcaagtattataccattttatataagggactttgacattcgcagattttggcctctgggggtcctggaaccagttctccttggattctttaatgagattgcttacaaggtttggtgtgcccatgagggctattaagataaggttagctcataaaatgattagaaggctttctgtgttttcctgtgcttttggaattgtttagtgtaggattatgttgagtcattcaaaattggtggtgtatgatcttttttgatttgaaaaattagatagcgttcaactgaggtacttgttactttgaagatttggtgaacatgactgtatcagggctgagctgctcatttagagcaaattttaggtaaagtttccaaattttgcttattgtcttttaaattttctatcttttctagggtcaaattttaaatttttttagttctagaaaattctaaatttcatttaggtttctgtatttattggtctaaagttttgtcctaaatctgtgtgtgtgtgtgtgtatgtgtgtgtgtgtgtgtgtgtatgtatgtacatatatatatatgtatgtagacatgccattttttttatccctgcttgttttgtcgtcagtagtgtttgccagatgctgatcttatttcctgcttttttttttgagacggggttttgctctctcacccaagctggagtgcaatggtgcaatctcagctcactgcaacttctgcctcccaggttcaagcaattctcctgcctcagccttctgagtagctgggactacaggtgtacaccaccacgcccagctactttttgtaattttactagagagagggtttcatcgtgttggccaggctggtcttaaactcctgaccccgagtgatcagcctgccttgggctcccgaagtactgggcagtttctctttgtatttctaatggattcaatccaaacttgtgtttttgtcttttagaatttaaccatgcacatgtggtgataactgataaatttaatctttttattgtcatctgattatccatttattagtcttgttttctccattcagttttgatggatagaccaaattttcattgtatcaccacccccacccttgtctttaacgttttcttttcaattttggctcttttaattttaaacaaatatatttttataatataaaattttgataatataaaacattaatagcttttttcggtaacataaaaaattaacttttttctccacccatttgccccaaattaggtaagacattttagcatgttttttcttatggtattcctagttttgttgggataatatagaattgtaattctaggtgatgaattttcttagtgttgcagatgcattattagtagctagttttttttaattaactatttaattttaactgtgttttttggtctgttgtataatgctttttgatggtttgatgccactctgctttttttttttttccagataagttaactctctgtgttaccttgtaagattttactctttgtttttaagagttcagaaatttcacttgcgtgtgtttatgtatgtatctttttaatggtcctgcctaggatttttcgtctgaaatctgtgttctcaggaatttttcttccactcttttcctcatcttcatttaaaactacattatttggattttatacgtcacttatctttcttcctggcttcaaatgtttcttctctcccattttgtcctgtatgctgtggtaactttttagtttgattatctagattattatttttgtaatgccagttctgtatttactacccttatatgtggtcagatagtttacaaagagtttgtttttaataatatatatttttagtttggttctgaagtacacataattgaattaattttgccaattttctcatgatcagctcttcctgcaaatatattttcatttatttgttaaattgcttattttaaataataaacacacacgaaccccctatttaaaacaaaagctggaacttcgataataacctatatcccttatcctatccctttactttcatttgagtgtatcatcttgaatcctctgttcatcttcctgttgatttattgcatctatatcaatggctgaaggtattttttttaatgttagttgttttaacttaaaaattttaagaacttttccctgctacaatatctagaaggtagtcgtctgtatttttaaccaagagttttaaagttatatttgcaacattttatactctttttcatctgtgcttgagttttgtatatggtgcgaggtagggatacagttttattttcatcatatacagattgaatctctcatatccaaaatgcttgggaccagaagtgttttggattttggacttttttttttttcccttcagattttggaatatttgtattttgcttacctgggttgggtaaatatccgaaatttgaaaatctgaaatctgaaataagccagtgagcatttcctttcaacatcttgttggttctcagaaaatatggagttttcaaattgtggagcatttcttatttctggcttggagttttgggatgtgcaacctgtaaatgattttaaaaagttcttttgttatccttgctttattgaaaagttaatgctctcttctactgaattgataggccatctttgtcatatatgcaaaagtttaatgcaaaatttttttccctttccttgactttcatcattcattttgtgaatatcatcctgtgttcattgttgttgctttaaaataatctctcatactggaaaagaaagttctttgcctttgttcctttttttcagaagtaacacttgacttttccttagaaattttagaatgatcataccaagctctctcaaatcctctgtctttttgattaatttgattgaatctgtagatccatttgggattattaagatctttatgatacaggatgagcaggatatactatttttattaggtcgtgtttaatatctcttgtatggtttataatttaacacaaaactattgtacatcttttgtttcaggtagttgataatttctgataactgttatatggcagtgcttttaaaaatttgttattggtgtatgcaaatgcagtggtcttttgtatgttaattttatacctagccaccttgctaaatgtttctaataccttttccagagacaattttgtactttctgtgtaaaagatcatatcattaagggaggagaccacgcctcatattgtcttatgcccaatttctgccctcaaagaaagaaaaagtaaaaactaaaaggcagaaatgaaatccacaagcagacagcccagggccacaccctgggcctggtagttaaagatcgacccctgacctaatcagttatgttatctatagattacagacattgcacagacactgtgaaaatcccgatactgttttgttcagatctaattaccggtgcatgcagcccccagtcacataccccctgcttgctcatttgatcatgaccctctcacacgcaccctcttagagttgtgagcccttaaaagggacaggaattgctcaccccgggagctcggctcttgagacaggagtcttgctgatgcccccagccgaataaaccccttcctcctttaactcggttctgaggagttttgtctgcggctcgtcctgctacatcatgattaaaaagttttatgtataatttcagtttttgtgcctgtactttcattttttttcctgtactagcaaatacttccaataaatattgattagaagtgataacaatgagtatttttttgttcttgctgatctaaaaaggcagttacctacttttgtacctcatgcatttctgaaatatttacatgtgttagttgtgcagatttacaaagtaggttctgtttaactaaaagatattgtagtattttcagtcgtgatgcttgcaggtattttttctttgggtactggtgacctttgtttaagctttcaccctaggtatcctgggtgtggtggtggaggggtgctggtagtttgtcagtctcttctctgtcatcctaggaactgtgaagtcaggcagggcactttttttttgtattagtggccctcactaatttccttctccaggggccactccacaattgatttctgccctgatgtgcttagagtaaggtgtctacagggtctttcttcccctgacactggcataattttactctctaatgtcatagaattgctttaagcactgacctgcagcagtggcctgcctttttcctacaatataatcactgatttttgttatgtttgaaggaccaaatttggcttgtgaaagtgagtttaggaatgtcactatataatgtgagcaagtagatgatgtgaaagttgaatttataaaaggatgaggccttgcatttattttggcagactttaattaatttccaaggacatcatccttgtcatgacatcttgttttatgtatgtagtaagtaatttttcagtttttctcttttttgccccttgattaactctgcttcagtacagaccatctgctttatttttagtttttggttctctgaactgctggatattttaaatgcccagcaatattttccttagtcttgttactataggtttagatcagtttcgtataatatggtttttatggactgtcttaattatctgtagtgcttgctaaaagtgcagacttctgtgcctcaccctagacgtattgtttcaagatgttgagggttgggctaaagcctgcttaataagaatcgcagattattcttctgcacttaatgtttgaggatcactggttgaagttaattagtattcttaaaggtaaaagtgccttgagcactgtgtaaattgactgcaggggtcctttagggattgaattatcacaatacaccaaatttaatatggaagcagggtctttgaacggacattgtttttttttgtttcaggtgtttctctccatcagtgcagcaacatgtttccttgtagaggagctgtctcctccctcaggcttttctggccaacatctctatggaaacccaaagcttcaggtggctaggtgggatacttgcccctcttactcctggaggcacaaataagttgaatcgatggattaaggagttggaaagtgattgtacatgctaaagttgtaatcttcctgtttctttctggctgtttttttttttttttttttttttttttttttttggtatgtgcgtgtgtatttgtgtatgaataattcctataggatttttttgtgggggctaaccatagcatatgaaaacttatgtacaacttaaatatattaagattagtattctttgtacaattttagacatgaaatagaatatcttattgtcctggaaatttcctttgttcctcattcatactgtccctcttttctacaccaccccccacccccacactactgctatcttgacttttttcaagttaatgttatcgtggtatgatttacactgaaagtgtgtaatttgatgaatttggccatacagaacatttctgtcactccacaaaatttgtcctgtatcacctttctcattaattatcaacaccgtcattatttcaggcaactgttgatctgatttttattactgtagatcagttttggctgttctgggtcttcacatcgatttgtttataccaaattttttttttttctcgcatctgactgcttttgctcagcaaaaagcttttgagattcacccatgttttattgcatgtatcaatatgtttctttttactatggagtaatattatataaatattctcacatctgtgtattcatgtaccttttgatgtacttttttttttttttccagttttttgacccatatataatgttatgtgtacatttgtaagcaggtctttgagacgtatttctatttctcttgggcaaatacataggtgtagaattgttatagtactaaattgttatccaaattgattgtatcattgtacattctcattagcaatataggagaatttcaggtggtctacatttttgccaacacctggcatttttaatcttttatgttttagccatttggtgaatatgtggtgtacctcattgtggtagtaattgtatatttccctaatgactaatgattttggatgtctttcaagtgcttgttggccagtttgaggatgattttttttaacattgcttctcatacattatccagttttaacactcctacacgataggaatcacagtagctgcattcttccaagtcttaaaatggcaaaaatgtcagagatgtagctaaaggtagaacactccaggaccaagtgctaatatgttcacaaaacaaattgagattgcacaattttttttgtttgcttgtttaaactaacacctgataaaaaggtacattgctgaaaaatgggaactcatttcttcatcatgcctcaaagtaaatattaaatttatctctttaacaattaattgcacacatacatgagaaatctttatgatacatattttattacaccgtgtacaaaaataatttcacattttagttgggttggaagtttgaaaagaacatagtgcagttgcaggggtgggatgaactgtggtgaggtaagtaaattggacagaaattgggcagaaagatacttcctttttttttttttttaacagttttttatctgtctgaagacagggaagaagaggaatctgaattggaaaacccccactatatctgttgggtttttgttgttgctgttcagtctggaaatgggtggtgtgtggtgagaggtcattaggtcatcagggcagaattgtttgcagagctgggagctacatcctcacggaagtgggatagatgtgctggggaggggtgtgcagagaggagccaggaatgatgtaccattagtggccagggcttgttatggtaacaccaatgttgaaaccaactgtgcattcacatatacaaaagttttgtgtcttaattcatgccagaatacatgcataatcaaatgtctcagttaaggtggagctacagaaacactgggctgaatgaagttctggggttttctttgtcttcgtgtgaggcctctgggctgggtctgggtgtctgatcaagaatgccctgaagttttcccatggggctttggagaacggctttggagctgggcagagctgaggatgagcacagaagaaaggaaacgagaaatggtccactacctgaggtttaaaatcctcaatttttggagggaagaagtgacacaagattttatcggtgccacttcaccagcaagaaacctctaaggccagcagtgcctctgcccaggctttgcttacactcactgggctcgctctgcctgctcggcccagcagggtgctctcagctgatccccagcccagatcccacgaccactgccactccgtgctcagcccatggcgggactgggtataccgcatgtggcttccacagctggactccagcattcagatgaggggaacgtggtggaacccagaaactcggagacggcagcaaccgtggagccccaagggggtgtcatagcttctgcctggggagtcccgaggtctgagccaccagggaatgccacagccctctcttgttcctgccgctcacagctccctgaatgggggtgtgttagagcttgtttattcctgctgcgcatggctttgtgaatgggggtgtattatggttctagttcgaggggtcctgatgtttgggcccccagaggggtcgcggctcatcactcccatattccagcaattgggagtgtgtaacagctcttttcatgcccactgcccacagctccaggagccagccaggtgcgtgttacagccgttctttgttcccaccgtttggcgagttctgggtttttgtccagtgaccaagaataatgaggtacgtggacaccagagagtgaggaaggcagagaagaatgttattgagcaacagaaaagctcttgacaatgagaggggacgtgaagtggatagccctctgtgtgagggggccccaaaagctggtagccatctttgcagttgagtccagggtttttttaggtttggaatgaggagatgtgggctggaggtagccttggaaaaggcaacattcaattggtttaaaagcattattcggaaagaaccaattgggaaagagtaggcaaaaagaaaagttttcactccagctgtggactctatctatatctagaacaggcagcttggtaggctttaaactgtctttggtttgaaggtcaggtttcaccagggacctgtccctgcctgcctaggagttggtctactgtggcgcctgcctaggaattggtctactgtggcgcctgcctaggaatttgtctactgtccctgcctgcctgggaatttgtctactgtggctatcagaaacagctctgcgcaggcctcctggggtcagtggacactctctttaccaattttggtagcatcatgcagatttgcagaactggcttctaggcttcttcccaagtgaggcaggaattgaagtcacttagaacagtggaacttacagaactgacagtgtttccattcttgctgggtggcgccaggaggagagcaccagtgtacctgagcatgtcgaactgtagcagagtagctgaaagcagcatataagatgaccctggtcagctctgtggtttctatggtgtaaagtgggtaggggtttcaggcctttggggttacagagatcagagccactccctcaggtcatggggtcctgtgctaggaggtgtggtcctagggctgtgtgaacattggtggggtttgccattactttatttttgtccatcttggtgttggcttaggcaaaccttagggtctgcgtttttttgttgttgttgttatttttgagacaaaggtctcaccgtgtcacccaggctggagtgcagtggtgcaatctggctcactgcaacctctgcctcctgggttcaagtgattgtcatgcctcagcatcccacatagctgggactacaggtacacgccaccaggcctggctaatttttatgacggggttttgccatgttggccaggctggtcttgaactcctgacctcaagtgatcttcctgtctcggcctcctagggtctgcagttttgttgttgttgttgttttggggcagagcttcgttcttgttgcccaggctggagtgcagtggtgtgatctcagctcacggcagcccccacctcccaggttcaagcgattctcctgccccaacctcctgagtagctgggactacaggtgcctgccaccacacccgtctaatttttgtatttttactagagatggggttttccatgttgtccaggcgagtcttgaactcctgacctcaggtgatccacctgcctcagcctcccaaagtgctgggattacaggcgtgagccaccgcaccccgccgggtctgccgcttttgaatgaaagtaaatgctcttccaagcatttcttgcatgagcagaagagtgtgtagaattctctcggtttgctgtctaaagcaagagggctgactgaccactttagggccacggcctccatccccgccacttcccctcccttcccctcccttcccactccttcttttcctgagtgctgatgttgttctgccttaagcttctaagcaggggcatcttttatggtcggggggagggaggtgtgggaggcaggcaggggatgttgcaggagagctactgataacccagggcctctgtcttttccttattgaccatttttatgtcttctttttaacatgttaagattatttcccaatttcttagttgggttatcttcttgctgttgagttgtaggaattctttatattttggttgtcttttatcatgtatatgtaattacaaatactttctcccaatgtgtggcttgtatttgcattttcttaacagtttctttgaagttgaagtattttaatattgattgtttaatttacttttatggttagtactttaaccattttctttttctttttcttttctttttttttttttttttttgtgacggaatttcactcttattgcccaggctggagtgcaatggcatgatctcactcactgcagcctccgcctccctgggttcaagcgattcttctgcctcagcctcctgagtagctgggattacaggcatgcaccaccacgctcagctaatttttgtatttttagtagagacagggtttcaccatgttggccagcctggtctcgaactcgcgacctcaggtgatccgcccgcctcggtctcccaaagtgctgggattacaggcgtgagccaccacgcccggctgctttaaccattttcttgaaacttagtttgtaaattttttctccctgtgttttgttctagaagttttgccattttaggtttacgatccatttggaattcatttctgtgtgtgttctgaggtgtcactaagtcaaggttcatttattgcatgtggaatctagtcccagcacctacttttgaaaaagctgtcctttcatcattgaattatattggtacctttatggaaaattaattgatcatgtatgagtgggtttatttttgaactcagttcctttctatccttatgtggtgccgttctttcttgattactgtggctttgaaatgtgccttgaagtgggtgaatgtaaattcttcaactttgttcttgttagaaatttgttttggctattctagaattttttgtatttccatatacaattctgaggtactttgaacagttggacaaagagccttctggggtttctgagtaggattgtgttggatgtatggattctttctgactgtttggacatctttacagtattttagcctttcaatccaagaacacatatatttctccatttatttaggttttgttttttaacggtttaaaggtctttgcatatcttttgttacagttgacttttttgatgctattgtaagtggtattttttatttttatttttattttttttgagacgcagtctcactttcactgcaaccgccgcctcccaggttcaagcgattctcctgcctcagcctccctagtagctgggactacaggtgtgtgccaccacacccggctaattttttgtatttttagtagagatggagtttcactgtgttatagccaggatagtcttgatctctggacagcatgatccaccagcctcggcctcccaaagtgctgggattacagttgtgagccactgcaccctgccagtggtttttagtttttattccaattgttttttgctggtatatagaatgtggttgatttttctgtatgaagcttgtatctgcgactttgcgaaattcacttattctaataaatgtatttaccacttttattcattttaaaaattgtgctttttggggtattctctaaaatgtttaatagaagtggtaatgacagacatctttgtcttgttcccgattttgtatggaaagcagtcttttactactaagtatggttttagttgttgcacttcttattttgttaaaaatgtgttattgttaatttatacttctagatatactacagcttaaccattctacagttaaactatttgtttatatatctttttatatatttatggtccactgtgattcttttctgtgaaattgacatttgtttctcttgcctgttttttcttttgggctatttatctttttctttatgatttgaggtagttctttatggtttagatactacttttgtttttctatttacaatagtccacgtttactctcatggaatgtgttccaagacccccagtggatgcctgaaactgtggctagtattgaaccatttatagagtatattttgaaagagactacattcacataacatactgtatatgttttcaaaatatttgaaatagtataccatatatagtatggttcagtactatatagaatatagtatatatagttttttcttatctatatatacctgtgataaagtttaatttataaattaggcactatataactatatagtacatatagtttttttcctatatatagtatctacctgtgataaagtttaatttataaattaggtaatttataaattagtagagactaacaacaataactagtaatgaaatagaacaactatgataatataatgttgtgtgaatgtagtctttttcaaaatatccgataactgagatggctgctgactactaagtgggtagtatacacagtgtggatatgttggacaaagggaagattcatgttgtgggtggcatggagtgagatttcattatgcacagcactcagtcagaatagtgcacaatttaaaacatcgtttctggaacttttcatatttttggactacgcttgatcattggtaactgaaacttcaaaaagtgaaacgagataaggggaaactactgtatatgttttgcaaatattttctgttttcacgatgtctttttattctctttatgtactttcatgagtagacatttttatttttaatttagtttcatgtataattagcttcctttaatatttgaacttccatgtcctgtttcacaaagatagtctcatttattgccctctaagtgttttcttaatttgtcttcatgcagggtttaagtttcattccacttgggtttgatttttgcatgttgtttgagtagatgtcagaatttttcccctctggagaaccagcgactttattgaacagttcctccttcccattaatactctgcctgacaacagtatgtatactttttaaattcttcagttgggaccattgtaaagaaaaacaggtgtcaggaactttcgcccttgaattaaaaaatatatttttgagacagagtcttgctctcttgcccaggctggagtgcagtggcataatcatagcctgcttcagcctcaaactcctggacccacactatcctccctcctcagcctcccaagtagctgggactacaggtgtgtaccatccacccagctactttttagttttttttttttttttttttttttttgtagagatggggtctcgctctgtttcccaggctggtcttgaattcctggtgttaagcaaacctttcactttggccttccaaagcattggcattacaggcatgagccactgtgctcagccaaattaaaatatttttattatggttttactgaaacttgtttaaatataaactaggcatacatttattatgttctgttgggtagctcttatgtaataagatgaaaaaccaactactaacttaaaggtaaccaaaactacaaaactggagaaattcagaataaaaaggttagcttaatttgacagatggcagtgttttgcagaagctaatttggcatttgtggcttcaactaaggaaatcggtatatgtatttcaggatattgtaatatgttaagcttttggaagtaaattttatttctgttgtcaactatactgcatttctgacttgatacctaattaataaccattattgtagagtgagtggtatttttggtctttttattgtaaaactgtaacagatatgctctcaagtgtgtttttttttttaatttttttttcttaagctatagctcagtaaatgccgatatttccatgttgaactgaacaggttgtgtgatttaatgtagagcaggatacacttgctgtgaataagaggtaacaattatagcttacctataagttagcgccaaataaatattcatcagaacttgtgagtactttgccttgtgtacatatttgagtgcctgggcaatcaagagagtgacatactatgcagcgtgataactgcttttgtagacattgtgaaatagtattcttatactgaagtaataattgtattctaaatattgctttattgctagtatgtgtttctgcttatctgtgggaattttccaaggtttgtctttgattttctgatttctttgcaagctttacctttgagagattatatattttccgagtcatatatgttcattactatcaagtatgtgtattgaaaataagtgtaatgttacatcttcacataaattctagttttaggttttcaattgcatgtgtacatttctgcttagtcatcactcagtatcatgaccgttcatttatgtattctttgttttaagcagactgagaaatagataacatacaaaaagcttttaaattggtagtggctagagccagaggtgcacagataatattgaaagttaaataaagtatttgtaggtagaactaagaggatctaggaagactaggaaagatcttataaaggaggtaatagctgaaataaactgttgaagatttgtaggcaggtcgaagtgttattccaagtaaagagaagtctatgagcaagggacaaatcttcaatgatttagtgccttctgttatctacacatggttttatttggctgagtgtgatataataataaatatttggtctttttcccttgttcctggcatggagcccctaaagcctttggaatttactctctagtctgtgctaatcagatgagtggcgtgggtctgggtgtttggggaggagaggctgtgtagcttccacttcagggtgggtactctttaccactgtagttagagggtgagaactttcaaccccagtccagcatccggggagggaagaggggctgcagattgagcccaatcaccaatggccaatgatttaatcaattatactttaatgaaatctccagtgccgtgtgtgtgtgtgtgtgtgtgtgtgtgtgtatgtttttttttttttttttttttttccttgagacagagtctcactctgttgcccaggctggtgtgtaggagtgaagtggcacaatcttggttcactgcaacctccgtctccctggttcaagcaattcttctgtcagcctcctgagtaggctggactacaggtgcatgccaccgcgcctggctaatttttgtatttttagtagagatggagtttcaccatattggtcaggctggtcttgatctcctgacctcaggtgatccacccgcgaaaggctcccaaagtgctgggattacaggcatgaacaattgtgcccgaccccttatatccttttaataagtgttcagtaaatagtagttctatgataatgctcagcgtatatggttaactttttcccctaattctttttttttttgagatagagtctcgctctgtcgcctaggctggagtgccgtggcgtgatcacggctcactgcaagctccgcctcccaggttcacaccattctcctacctcagcctccccagtagctgggactacaggtgcccgccaccacgtccggctaattttttgtatttttagtagagatggggtttcaccgtgttagccaggatggtctcaatctcctgaccttgtgatccgtctgcctccgcctccgcctccgcctcccaaagtgcttggattacaggcatgagccaccgcgcctggccctttttttctcttaaaactgtagaattatattattaatacactgttagtatacagaaattgttttcaaggaatttgtttcagggtccagtgaggacaaagaaaggacaaaaagtagaacaaaggagatttggtgtaaagaagtattgactaggaacagatgattggctgctagagggtaaagagaactctaaagtaagaaatgaatttgggagaggcccttcagaagccccaagactctgagagattgggttcttgttggagaggttgtgaatggagcccactggatggcagagcagtttatagaagtgctgtagcttgggacattcctgccagtagctcttttgaagtggtgtagagtatgtgctttatcgtatctagatgaatggagtttccaagagaccataggacatattatataagtaattagcatgaccaaaaactgtatttgctttaaagaattgtgacaaatataactgctaggaattatatagtattccagtttcagagttctacttagagcacgtttattttgttttattagtataagggagtttatttttggattataagctaattaggcaaacaagtacagaaactagagatgcataaagatttaattggacaagagagctataataggaatctgattattagcatcaacaagttaaatacatattttatttaaactgcagacatagtgatttaaggatatgatttgattcataaaagttttgtttacctacttgttttccagaatataggcactctaatttaaaaacagactgtgttccaaaagattttgcaagttgggtttttggaactgaaaatacatgttcccatagaaaccatgtttcctggtggtgtgttcttatttagaaatgtaactctgtgtgaacttagcttatagtgctgagtaacagtattttttgggagaaatacatttagagtttctactcatgatgtatttattttatctactaattaatagggatggggaatactcttttacattgtaattaaaaaaattttttttaagacagagatttgctcttgttgcgcaggttggagtacaatggtgcaatctcagctcactgcaacctccgccttctgggttcaagctattctcctgcctcagcctcccgattacagggattacaggcatgcgccaccacgcctggctaattttgtatttttggtagagatggggtttcaccatgttggtcaggatggtctcgaactcctgacctcaggtgatctgcctgcctcggcctcgcaaagtgttgggattacaggcgtgagccactgcaccctttttttttgagatggagtcgctgttgcccaggctggagtgcagtggcgtgatctcgactcactgcaacctccacctcccgggttcaagcaattctcctgcctcagcctcctgagtagctgggactacaggcgcctgccaccatgcctggctaatttttgtatttttagtagagactgggtttcaccatattggccaggctggtctcgaactcctgaccttgtgatccacccatcttggcctcccaaagtgctgggattacaggcgtgagccactgcacctggcccagatggggaatactcttaagggtcataaacatgatgcagatatggttgaaaggttgggtgacaggtaggaaaaaggactctgtggcaagggaggatggaaaccatcatttatctaggactaactatatccattgttctttgctagctatttctcataaagtatctcatttcttttttctggattgcatgaatgcttaatgttttagctctggaattctataaaaagtaggaagagacttaaaatttagaattcttggcatttttaagctttaatggaaagggtataccttcagatttatgtgcccatagaggtatatgagtaatttattttaatgctaaagtgctgttaatccaaaaagattgagaaaaacttcaatctgtgacagtaggatatgcagcatacctgaaccatttgttacccgccaaaaacttgaaaaccaggattagttgcctggtgagtaataaacaactcttcaagagaatgcaggttttggtcagtaggagttttactacttgtcacaaataaggagaatacttggagtattctttagggcattgttgcctctagggaaagtgacagggaggttttatggggtgatggagaggggagagggtgtgacatcacatgtagaggaggggtcccagtggtgcaaatgcagtgagtcactatgtcagcaggtaggtcacgtgttatggtaatgaagctgtagttcccccccagggtgctgactttagcatgataatgaggaaagttcacttgggttcatctgcatgttgcgagggtctgtcaggagctggctccaactgactaggtgagagctcattcctcacagggtttgggaaaaaacaggtggcaaggtaggaggttgtaaacaggccagttacttaagttgattaaattcctatagtcccgggggaccctccttgtctgcttacacattcatgggactgtcatatagattatttgcaatagggaatttcagtaatattatattttatacaaaccttcaagtgagattgacaggaccagaactgggaaattctagatggaatgtaggagtgtagaaagtttgcttagtaagtgggcctgacttatgtcatttagaagaattcttcaatttagaagaattagaaaatgtgcttattagttggcctgatatatgtatgcttctcgttcctgtatgagagggaaaaaaaaaaaaaggcttctctttacctttctaagttctttggctggactagaaattaaattgacaagaggcagattaacaggagaaaacccattttaattacataggtacttacaggagtcccacaaaataagagacttgaagaagggtcacatgattgaagcttatgtagcatccagagctacaaaaagtgataggggtttggggcttctgggaggggtggcaacacaagttatgagagggtgggggaggaaatgtatggtgaataaagggtgtcttgtgtagataaaaagtcactcaagtaataaaagttgttgcaaccctcttgctgatacagatactttttctaatgtagatttcctttaaaaatggattttttttcacaaaaggacagtttttcaaggttactcttgtgtccgcagtttctcaaaataactacctcaaaatatgccaaagaagtatatttttgggtggcatattctagtcgcctgcagtcttatttggaggtggtgtgtcctgagccccagcattcccatctccaataattagttagtgcctcttttctgtgggataagcttgtcttgtgatatggcttgttccagctcacatctgcaggctctgctgtattcatttattcagtcaatgttgattgcttgccatgtgccaggcattatatgtatgtaccaggagtacagtgatgaacgaattatggtctcattgataactttgaaatgattaacatttggtgcctagcagtgctttagtgcacgtgcttctgaagtttaagagttcttgtcgtctttggatttaccttgtgattaaccatagtgtattattataatttgtggtgagtctcacagaaggcacctacatgtgcagagacctttgcattatgaaggagaatggtgttctgtagaccctgaatgaaagagagggaagaggaatgccagggggaaagcaaagcaagttagtgctggggacagaggtagggactctagcatgcagaggtcctttaagctgtgaggactatactataggaaaattcctcagacaagtcatagaatattacagttgagggaaatgaaagatccggcttacacattaacaagaaaaacatgactcaggagattttttcttcttctttgctttctggctatttagagactggtttggacttacaaacatgaaggatgtgttatgtacttgaaattcttggacagtgagtattagaggtttcttatggtaagagaacatgagctagagcagtgtagtgttagcaggtagatgcagaggtttttgcaaaatcaggtgtgtgtgtgattactcactttaaagacagtataatgaattaatcttgtcattgacaggtaactttgaaatgcctacatttggtgcttagcagtgcgtgtgattctgaagtttaagaatgtctttggagtttctatcagttttttttttttcctctgttcttagaaaatttggaaggtttttttagaggtcattctaagagttgcgccccccgccttacacctatccccaaggatggaaacctttgactttcttttcctgaaccaagtttcatttatatttggaaatttagctgaaggagccaaggactgacttaatgagtcacccaccgcttaacacaaactgtttttctcctttgttgtcagtggtgctttagttttcttttaccattttataagtattttacatcaacataatagtggatttttgcactgagttttcattttttattgaatctttaatctccaatgttagatatcctagagttgagaaaatatggcaaggacatggaatttgaacgaccaagtttcaaccctgtctctgcacttactaatgtcttgaagtctgtgttagctatgaaatgagagtaactttctagagggtgtgtgggtatgtctgtattaaatgagagtatatattggaaacattggaaacagtctggtatagggaagtttaaaccttcactctgaaagttcgattaattgagtgctgaaataaactgacagtaaacagattagcaagagaaagtgcatacaaatttattgacatggaagcatgggtgggagctacaaaaaaaatatgaggctctaaaaagggccagatgattgaagcctgaatcccctcttcataaagggagaagtggaggatgcaggcaattttagaggaagagtaaatgatttcaaggggagatgagtgtgcctgaagagcagacaatgacctggaacaaaattcttccgggctctgggagagatggtggcaattttttgggaaggtgaggggcagaactgtactgcaaacaaaagttgtctttgttatatagataaagtctctgaggtaagaaatagcccttagaagaatagtcaaaagaataggtgaaaagtctgtctgggtatggtatgcccaggtgcatggcaatttttagttttctttcctgctataggagttaatcttctctggtttatatagattccagggaattatccaagacaatttcgttccttctggatgaacgtccctcagtcagataagggaacttcagagaaaacctctccctgtgctttggaagggaaaacggggaggcaggagaatgttggagagagaccttgcttctgagtcctttcaattgcttttgttcagagcactcagcaagccagaatgccatactttggggcattgttttcgtaacctcaacattgatatacagcaagagtataataaattcatattttcttgccttgtcttgggccagtgatccctttttttgcatcctcaaaaagttatactgatgttaaatatgccctctttactgaaacagattttaaaaatacccagcattaagtggggtcacctgagaagggaaagaatttctatgaaactctcaggtttttaatttatattgaaattaccaatatttccttatatctgaagtgcatagtactgtattttgcacatagtagacacttaaggatgttattgtgcagtaaaaataacaggaaggaatctgaagacttgtaggtaatcttgacttctttgcttattaatttttgtggtgtttgcaagtaactgaatctctttggacgttgcatcttgcccctttggtttagcagtgggaagaggttgaacccacctccctgtacttaactagagaaaaaaaatccatacaaggagcatctcagagcccagaagaggagctctagatatggaagtggattggatgggaaccaccttggatttggaattgctggtcagggagaggaccatatttaggacatttccagttgaggatcagggcgtatcacaggtcagaagtttcataaatgggaaggtacaaaccttgaaaaacagactagggtcttaatcacaacagaaatggcaacaaaacccccacataattgcaggaaatgaaggttcagggtttcaaatacaggaaaaacacaactggaagatgccagtaacaaagggaaaaaaactttgcaaatgaggtggcttctctaacttaaacttaggatttttctcattgctcacctcttcccatttctctctacctaggtttagctaagaaaattctttcactttttttgttttcttttccacctggccttctccccgatcaccagttcttttcattgtttcattttcagtcaagatttatgaaaacatgaaccatactagagatacacctgatttttttctaggatatttgtctgaatttatagtaaaagataaaacagcaaaataacagtttcaaagaccttgctcttctccataatatactcagtattcttattgcactttatcaaaccaccataacaaaccacctcaaaacccagtggcataccaaaatattgtcactcacactcacagatttgctggttggctgggttgacttttttcacatgtgcctcattcttcttaggcaagtgggctaccaagtcatgttcttcttaagcaggttgcagaagttcaactgggctagcccagcgatgcaggtagtttcatgtctgcttgcatgctggctgctaacatgccattggtcaaatcccatcatccatgacaaaaggaaatacatcatgtgtgaggaagtaaaagtggcaaagagtatgaatacagggatgggagaattgggaggctagcataggcagtgtaatcttttctgggatttatattcgtgtttgtattttactttgtggttattaatttgtgtatatactattttgtattctgctttagcgtaatgtgattttgtaaggaaaacttctgtatagattatatatttttcacttaaatagttgtatgtgtaactgagactctgcttctaagttgatctgcatcaaaatcatttgaagtgcttattaaaatgccgatccctagaccttaacccagaccctctggaatcaatctctggggatgaggcctggacatcttcattattagcaaactcatggagtcatccttctgtacattaaagtttgagaactactttcttaatggaaggacatgcatttgtattagtctgttctcacgctgctataaggacatacctgagactgagtgatatggttagcctttgtgtccccaaccacatctcatcttgaattgtagttcccataatccccatgtgtcatgggagggaccaggtggaaataattgaatcatgggggcagtttcccccatcctgttctcatgatagtgaataagtgtcacaagatctgatgattttataaagagcagttcccctgaagatgctctcttgcctgccaccatgtaagatgtgcctttgcccctccttcaccttcagccgtgattgtgaggccttcccagccatgtggaaccatgattctgttaaatctctttcctttataaattacccagtgtattagtctgttctcatgctgctaataaagacatacctgggactgggtaatttataaagaaaaagatatttaatagactcacagttccacattgtcagaggcctgacaatcatggcagaagggaaaggagaagcaacggtgcatcttacatggtggcaggcaagagagcatgtgcaggggaactttccttcacaaaaccatcagatctcataacccttaactcactatcacaagaacagcatgggaaaaacccgcccccatgattcaattaccttctaccaggtccctcccatgacacatgaggattatgggagctacaactcaatgtgaaatttgggtggggacacagccatttttaaatttttataattaatggccatcaacatttgtacaaatgactgatttccttgggtactaagtaatttttctctgagccatgattgaataattttcagttgaggaaaataatactttatatatgaaatcagatttggagtgctggtagcagtgacattacagacttataaaaattataaaggattttatattaactaaatgaagacattgaattgaataaagataatttctgtaaaacttttatgcctttaattcgtaatgttgggtattgcatggcttattcatgattccattgctatttattagtaattttctaaatgaaagtagtataaaccaaaaagtatcttaagacaagtctcaatcaatttagaaagtttattttgccagggttaagtacgtgcctgtgacacagcctcaggatgtcctgacaacatgtgtctaaggtggttggggtacagcttgcttttatacattttaaggatacataatatatcagtcaattcatgtaagattcacattggttcaatctggaagggagggacaactcaaggtctggtcacagggtggcttccaggtcatcggtagatttgaatatattctgattggcaattggttgagttattatcaatagaaaggaatgtctgggttaagataaggagttgtggagacctaggttttatcatgcaaatgaagcctccaagttgcaggctttagagagagtagactgataatgtttcttaccagacttaaggtctgtgtttatgttaatgctggagaggtatactgaggcatgtctaccccccacttccagtcatggcctgaaccagtctttcaggttaaattttagagtgccttgaagcttcagattttgtttttggtttacggtataaaaactgataggtttaaagataattttatttttctcaattcggctctgtaaatttggcagtttattcatccattttgatacttcctggcattttatatgactttgtttgtgtactttattatgtattttatttttaggtagcttggttatctcagctctgtaaaaccatttttatggaagtgaaattctttggtggcatggcagacactgccaatgcctatccaatgaacattcttttctttttgatagcagaaccctgatttcattttcacagcagcctttgcccacccaaaaaattcatttcccaatctcctttgcagctatgagtggccatgcaactgtgttgtgctttgtgaggcttttgtaagtggaagtttgtaggtggggcttgttaaagaagtctcattcatttgggagacaccttttgtcctttgcccttctctttatcctacctagaacttggacaggatgatggaggaggagaccatgcagtgacaaacattctgatgcatgttccactttaaagacttgatgttgggtgtccctactaggtctggactgcccattgtgtcttctaagttagaaaagaaagacactccagagtattgaagctgctgtttagttgggaatctgttacatgtagctgaatatagtttctatctaatacatatgatttctgtaaaagatacttgggctgcaatatctcttaaacctttcatgtaatttgtttaggactttttagacttctgaaaatacatattttatacataaattgtcaagcatgttttgaaatgcacattttacaatttgatgtcaacaaagctgaatgcagaacattttaaaactttttattttgaaatttcaaatttaaagttgcaagacttagtacacagaacttccataactttttttctccccaaaccatttgatagtaagttgcaggcatcatgcccctttagcacttaaattcttcaggatatatttcctaataaaaaagatactctcttactatactggagttatcaaattcaagaatttaatattaatgaaatgtcattactaagctgtgcatatttatatttctccggttgtctcaatatcctgcataacatttggtatgggatgcagtcagttccccctttggctcacatgcttctttagtctcctttagggtggagacttcacctgcttttcatggcatagacatttttgaagatgatagaataattatttttcacagtgtccttcagtttgggtttgtgtgatgcttcctcaagattagatttcggttgtgcattttcggcagggctatctcacagattatagagtgtcaggaggcacgcactgccattttatcctattattggtaatactaactttgatctcttggttaaggcagtgactgtcagggtttacactgttgttacagtaggtagctagtcagacatgagcagggcagaagggggcctcccccccaggaatgtcaggcaaccattaggcggtggtcaggctgttattaaccatctctctgaaataataattggtcgcagccggtgccagggaaaggcagtctcccaatagatagaaacacctgaaactggtgattagcaacttcctgataagattccaggatttgagtgaatgggctcaagcatatatgcactaagaggcaaaacggtggagtttaactgacatatgacctttgtttaggaacacccaactggtaagggaaaaacgccttaagtgagcacatgcacaatttcagtaaacacactgtgcgtgcagcccctccccagtgctggcaggccactgcacctgtggacagccatcctgtaggaggaatcaggggagaagaaatgcaaaccctggaagcatgccagtgtataaaaccccaagtcaaaggtcagctgttcacttgatctttcaagttgcccgcttggcccccttccaagtgtactttacttcctttcattcctgctctaaagctttttaataaactttcactcctgctctaaaaacttgccttgatgtctctctctgccctatgcgccttggtcaaattccttctgaggaagcaggaagtgagcttgctgtagacctgtacgggttcgccactgttaacacaataaagttattctttctccctttataatttgtggaagagaatttaaaatgatgtaaatattctgttcctgatcaaactttcattcagtagttttatcatccattgaagattcctgactgaattattgctgagataaatgtgaaacatctttttaaaaaagatttcaatagatcctattctattgactaggtttgcttttcctatcatatccattgtgattttttatttcatggtactgttctatagtgttgggaacttcaagaaatacagagatgtaaggaggaagttggtttttatttaagggccatcaggggagagtttgatagtgaaatcctatctctctacctcttttcccttccagtacaatgcagtcaattttataggccaatagcatataaagaactgaagcaaatgggggcaaatgatctattcaatttagaatcttttatgacagattggacagtgaaatgatcttctttttaaagtagatctgaagatctccgtggtataattacccaccgagttatgtcttgccgaaagcatgtcttttccaaaggtgtttctctccttgtgcttaccatcatggataaggccccttttcttgttaggtggcataaatgaggggatgaagaaaaggacagaaactgctaattcagtaagacttattggggagtaatgtagagaagttaccttttcgaaacgtgagaatgaaataagggttctccacagcatgattcattctttctaaaagaatgaagttgtttggcctttctcaagttctttttccttttttactctagtttactttattctgttttttgtttgttttggaaaaccaaaggtgatttgttttcttttcctagtatattttcagagttgagaatataatgattttgggtttttcctccctctagcaccagcagacgtttttgaatcaactgagagaaattacggggattaatgacacccagatactacagcaagccttgaaggtatggcctctgttttatgatatacagtttgtggtatatgctcatctctagtgcgtattatatttgatagttgattttttttttggggtataccatgtggtagttttagagatacaggaatggactttgtaaagtaaaatcctcagttaacacactgcggttttgaggatgttagctttcagcagtctgatgtccatgataccttagagtgacagataacctctttctatatatgaaatgctttttgtgcaagatagtgggatgtgaatcctaattctaatggatggttttacttacgagctgtgattttagagtttaaatgagggttcaaggtggggtgtattagaggatgaggtgtaagagaagggaaaagtagaaaattaatagaagtctgaaaacttacatttttcttctcctgagaagcagagatataaatttgcacccattcagctaattacaccctaagttaaacattcaatttcaaactcttcagtataggcaacaactaaaatgtatcattttggtcatatcttagttggaccttcagtttcacatcgacatccaaatgagtcatatcatatggatactcacattgaaaaagagtgaatgaaagctatttaagaaccagaactgtacagtattttaagcttatttgcatattactactataggctaaaaacaatatagcatttttgccactgcagtcatatacacagctccaatcctttggaacttgatttcaagcctagagttctttatttgtttttagaaataatctattagatgattataataaaagtcattataacaataagtagtaccgattaaacatttagtactaccaggcagtattttaagtactgtatgtgggctagctcatcctaataataaataactctatgagataagtattagtttcatcccctttatgaaaagatgagcaacagagaggttaaagtaacttgcccaggatcacacagcctgtatgtggagaagcttggaatagaaaccaaggcagcctgatcccaggtgccacacttaatttatgcttcttttactagaagctttgcttcaccttattcccccatcaggaaaatcatgaaatagtagtgtttagagcattaatgcggggtgtatgaagccactgtaagtatttggagaggaagcagaagtgctatacctcaatttttatgattatgacgtttagataattgctagtccctttttattctgataaatatcattactaaattccatgtttgttttcagaaactgcctttttcattatgtattactgagtgtgagaccatagcctatcaccttgccagggtaaatttggggaatttgcttttttttttttttttaaacttagaaaatatgtagctcgaatgaagtcttatccacatttcctttgatagaggttgtgtgagcataggtatttttaattttccaaaatttttgtttcagttaccagtagctaggggaaaagagtgtatttaaaccttaattgttgcccattataaatactgacgagaagtctacttttgagcactgtaatgtcattgattaatttcagtacttttaatttgagaacatatttttagctctaaaaagtaaatgaacttcaatttgtgtaaattcctgctgtgttgttttaaattattatatgaggtaatatatgaaaaacacttagcacatttcttggcatatagtaagtgctcaataaatgttagccatcattattgcgctttattttattgttagattacttatttaacaatagtgtatcttacattttggatgagtcacttaggaatcgtctaatgatcatgacagatagcatttttgaaagtggtggtgcctttgaaactgcatccttactccttttgtcactgactgctacaactggaattggggtaggtcttggggactttattctgccagctgctcagtccttaaattttggaatcatcctgatcctacttctgtcatgtcccacatttaataagatagcaataatattggatgctgtcttctgccctttctctcctctagtctattcttaatacatggagtaaactttttaaaatgtaagtcatactatgtcattcctttccaaaacactccactggcttcttattacacccgtgtgcatgtctaagttcttagggaacctacagagccttccatgttttggttttctgttacaaagatagcttcgttgtgaatatctgggtttcctatgttgttttggttaactgttttagagctaacgttttacttgctgtcagttgtgcagagaatataaagatgtaactgggcaagtctcttctcattttgctgttttaaattaaaattcttattctggcatctgctttcttctaaataaactttagaataattttattcagctatacttttgatgagaactatgcaaaatgtatctatttaatttgagcaggattgtcatcttgacagtattgagtatttctgtctagagttctgtgtgtctttccataattccatattatcaagcccttcagtacattttgccattttcttcccatgagtccttgacattttgcttaagtttgcccctaagtatgtatccagcacccagattaaaaggaatatcttttattgtccttgtttgtagaagtactaattttaatacccattttgcactctttcgtatggcaagttccagaagaccttttttagtttatttgttcaaaagtataagtttgtgattcacttttattaagcagataggaaagtaatgaagactaagaaattagagatggatttttacattgtatcagtagttttaattagtaagaaaggtattactattgatatagtatactttatgtatgatgcatttacactataaaattagaatcacatatagattaattgcaaatttaaagcaattttgttctagagagttatggagaatattgtataactttttttgatggataaaattatttcaaaacacttgatactcctttcttgatatttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaagtaagttttctttcttttcttattattttaatagaaacatactgaaaaacttttcttggtgtaatatattaatgttgcttaaggagaggtaaagaaccaaaaaagaactctattaaccttggttctttttaatgtagttgaaaggaacatacattatctttttcagattataaggaaaagattttatgtaagttatatagtttttcatagagcatttcatatagaatttattgttttgaaatatggaatagctgcagatatattcataaaaggaagaactagaatttttagtgggcacagttattttgcagattttaagtgctggtagaggctttagtatttcttttgaggttaaagtattatttctaattactgataggtttaccatttaataaaatttcccttccctttccccctgcttccaaataaagctttggcaaagaagtttattattgtgtaatgaaattgcctttcatccaaaagaaaaaaagaaaagaaaacttggaaaaagtgttttggagatacaaatacgtacatgtggaagattctatgtgggacttaagtttttcttcataatatgaatactttatacttatgtagcgcacagtttttcaaactatgttcagttaccttcatatctcattatagtttaataattgtactacataaaaatagttacttttatgccttatggatttgcaaagtttgattattaacatatatttggagagaatttcttattttgtttatagacattctcaaagttaggaagcaaccagaaaagagttcgtttacatagatgtttattaatgtttattgataaaatattttaatttttagttttcaggataatcttagcatttttgctacatagatgatcttgtgtcagagaaaactagaatactcctgtctcacttagttaataggtgatgggagaatgtttgtagcatatataagatagacctgtttacttaacgtctaagttcaaggcaagctgtgactgggcccccatccacatttctagcctcattttccactgttttcctcctgtcattcaacactgtgataatacagaatggcttgaagttctcatgtactcagtggtatttaatttctctgtctttacatttgctgttccttctgtttgaatgcactctggccttttcctccctagcctaatttgttctggtcttgaaagatttagctaaagagctgcttgctggagaatgtttttcctggcctctagctaggaccaagtgtttctccagcatccagggcatgcttctgtcttaatgaatactctgttattttgaaattatttgcttgaacattattggtgctcaaaaaatgttcactgagttatgtttgataatatgtgcagtaaagctctttcaaaaccaatgaaagggaatgaagttgagaagcttgttgcaaaaagttgaaagagaagtggtataaaggtcagaaaaatgagtacttaataatattttggatatttcaaagttccaagactcgaggggaaaaagaaactagatgggtgataaaagggaaaaggataattttgactaaaatgctcctggtttaagtgaagcaagcaggaaattgactaaacagagatcattgttgttagttgtgaactcttaatatagatggtatacttggtgacatgacatggtatatttatagaaaaggggaaaattaggattatgtgtgtcctgcacaaaagaagatatttgctgtgcaaagtgagaaaatactgcataaggcaaatggttacacctgtttacgattttagatagggaatagtgaaaatattatggaggacaaaaaaaaattttgaataggttcccttagggagaaggcagcctaatttcaggaggcacgtgtctcatttgctgataattaaaactttttttgtgtgtttgtggatctcttgaaaaatattcacgaggtaattttattttccacttgaaataatgtagagaaatgaagtttctgatgtcatctcaaccgattgtcatattgagtaaattgcttgctgttgtggtttctttatccataaaacacataatacgtaatatgtatcaagtgctttccctctaatcagggtgccaattgagatagtgtgtccataaagttggttagaggttattgacagcaaacagttgtaggaatttaatgtggcaattgtactatgatagtatcaaaccagaaaaaaattaactgttggcgtaacagtaatacttttccattaaacattcctgccagtagtgtcataatgcagtgttactggtttaaaactgagaaagtggggagatgtcatgcatttcagcaggtattaaaaaaatactctttaagtgactgtgcagttactgttgagaagaaatgaagtcgtgtatttttaattcttggaagatgtggtaaaacatgagggaaggaaagacaaaataattacaaatggatatacattcaaatgcaggcctctatttaaaaaaatctacctaactgctgtaggaatgtagaagaatagatcagagtgtgagttttcaagggattgttgtagatataaaaaccctttttgagcactttctccattttgtgtgaaatacattgttatttaaaggttgaccacagtttcacttaattctttcaaatatggcagggatttttattttcagtttttttccattcttctttttgaggtataaaatctcttaaaaccagggctaaagcagaaacaaagtcatgctaactttaagtgatacacttggttgcagtgctgacaaaacgtctgtcttctgaaatcgaaatctctaataccaaatacatatacctctttgttgatattagctggaatatcactgtttacaatggactgtttcttttagaaggaataaattttttttttgctgactagaaaaatttagtttttaaactaatatcacatggaagttatatttggggcatatggagaaatttttgtttatgcatacctggtgtgtcagaggctaaactatattatgtcactggatttgaaaaacaatttgtgagccttcctttaatattgaagaagtaaatatattttcaatagttagtaggacaattatatgcctttttggtgtactttttacctttcacttttgagagaaaaaggagacatatcaaagaaatcttgtgctctgcataaaaaagaatttagaagtcgtacacctcatgtctttacttgattacattccatactgtaattctgttgaattctggaaaaaagcccaaatcatttgtactataattagcaaacgtactaggtaacattttttattatttggacctctgttcagatcagatcaaatattatagattgtcaaatgagtgcctgttgtccctggcttaaattgagaataaaattgttttggagttttgctgtcaaaaacacaaatgaaaatgagaccaggacacgatacccggtattgagcattataggtgtgattaatagtcagaggagagattctgccaagtttttgtgtcacggcaaactctgtcatagacatgaccatacagctcttttgcccaatttgaagtctaatagtaatactttttattttgtgaccattaaattctttcgaacatttttaaaacaggaaaaaaacagtatatgctctccagaacaagatgtgctacaattgagcgatcaaaagataagagggatttgggtaggtaattttaacacagaaagtaatgccacatattgactcaagttttagagaaattggtataagacttgaaatgagtgacaggtggtaagactcttcaaaaatttataagccgttttttttttctttttttctaaaacaccttgaatttgaaaagatggcatagaaagggagaaaaaccttgaggttctatcctagaattctagttatggctatcttgcttggccacagtaatagtgatttaaactgtgataaatagatccaattctagtgcttttattcttaggataattctcttatgctaaacagtttaggatattgttaattgaacactgatacttttcccattgcccaagtaacttcagtttttccctagaaatttctaatatgtaaaacgatttttgatgactcacagaaagtcaagatgaagcctaaaaactgagatgctaaatggtgtgaaaattagttccaactgatgggtgcaattaggagcttcagattgattagatgcattttattagatatgaactgtagaatgacttgtataacttgatgaattttctttagttttgggttagaatgatagccatggtctttgtacttttgttgactaacatgggagattaattttactttttttcacaataaaaattgaaaaacatagtagaattaatgacaaaactctggaatgactcccttactacttactcattttccttgcttaccactgctgccactgtgattttagcagctattattaaaaacagaactagaccatttaaagctgagctgttcaatatagttgccactagtcacacatggcaattaaaatgaaataatattgaaattcagtttctcagttgcactttaaatgtttaattctggtggctaccagatcagtgcacataatgctacatttccattatcacagaaagttctaatttacaacactcttttaagagaatctgagtttaacagtgagaatattgaaagaataggaacatctgaaggaagctgaaagcaagggaaaatgggagagtggagtgggaaacaatttatattgtttatgtcttctggcttttaagattcttgcaacatgataccttactatgctgtctgccctttcacttgaaaaaattttgaatatataaaagatatgttctcatcttctaattagtgccattatgaagatgactcaccagtttttatctctattctgtatttctttaacaaatatttattgtctaatatgtagcaagtacttttatagaccattaagaaagcatgcagagcctcagtttacatagaggaaagacagtacacagtaaacaaacagtatcagatagtaataagtcgttcatgaagaacagtagacctggatatagacaaagaagtgatgggggtgtgcttgtgggctgggcataggataatatgtgattttaggtagtgtggaagagctcatatttgaggaacagtagacctggacatagacaaacaagtgatgggggtgtgcttgtgggctgggcataggataatatgtgattttaggtagtgtggaagagctcgtatttgtacagatacctgagcgaagtgtgagcatgaacttttggctctctgaaggttgtgcgtcccagaccagggcctgatggggcagtgtgctggccctcgagatgaatagtgaggacacagccttgttgaagctgaatgagcgagggtaggaatggcagtattctcgtttctgatctcttgctgcacatcctgatgttcatatttgcctttctttcttaagggtatttccattcttctggtggtccagggtattttttttttctttttttttccttttaatagctcttctgtcaatctcccaaaacaaccatttggtttgcagatctgtcagtttttgtatgtagacttttcccttcagttactcctgccctgctacatattcttattgcaacgcttctcaaactcttcactacccagtttttttctgtcttgcactcccttgcttagaaatctttgctgacagtaaatataaacttggcttattttttttaaaaaaagtatttcctcttggtttagcctgtgtagataaggaaaaacaatggaagaactctttttttcttctgaattcaaaatatttacatatataatagttcagctagattatgggccaactaggcttttgtgaacttacttagaaacctgaggttcaagtaagattcacttacataattcacgttcctatttaatataatattttcatgggaaagtgaattatgagttataaacaatgcatatattttgtttgaagtctagttcattgataagttgatgactagcatatattttggagttagcagagaaatgtttggtagttggtgtataagttttactcatggtattcctttgtaagtgaaagatttagtaggatgagtatcacgttttgatatatatttctcactttacaggaaaaatgttttaatttggactctcataaaaatgtagattactgcttagatgcatttgtaacatgattttatacagtggcacccagctaactgttcccatgtgtgtgctgttgaattgtattcacgctaatactagagggagagttggttaaaaataatgtttttagtgttttaccaaggtcttgccttgacacagatatgagaatattaataatgctctggcattgagatggaagttttacaaaggctaattttctgtaactgacttttaccagttagaagttgtttatagccaaagttattctgtttcttttgtaagcatgtgagaatatctgagcgctagtttttattataaattgataattcgttacatgttttacacaaatcattattccactaagtccagaaaaagaataaattgggtttaaccagtctgttgaaataacattttattttcttttactggtcttaaaatcatgtgaatttggtatgtgaggtatctttcaggattgcatttgatatgtgaggcatctttcaggattgtatgtgtggaccgtatgtgagggatctttcaggattcagctatctttcaggattgtcatattgttctaaaataccctgtgaaaagaagcagttttatggattaataggaagatcatggaagaaaattgttacaattacaatgaaattaaaataataagtaaacctcctccattgcttaaaggaaaaagtcccagcttttcagttaaggattgttagtctctggtctcaaccaacttttccagcattaaggactactattcctctataccagggattggaggctcaaattcccagctggggtacaggtgtgcctatatgctgaaccctccgctattggagatgcctggagtggctggagccatttaatatggtcgttctagccacaagcagctttattcttttacacccatgtgaggtacaagatatgcgaggatgcaagggcaaggaaggtaatgtgaatgtgtgtggctggccaagttgggggcgggggcaaaatgaagagtgaatattctatctaaagagagctgctactactacttttattacactctggctttgtcacaatgattattgccatgcaggaatcgtgtaaccaggtcttctggtttttttttttcctcccagagcgtgagggaagtaatacctattattgtacacatacaatctcctaatctttatcttttgccagttatttcaaaaaattttgaatgacattgtaaaaaccaaagaaaaccattttcaattatgatttgtttcataaaaaacatgtctaagaacatggagtagatggtgattcttgttatttttgctctcaggacccctttacactcataaaaattattgagaacctcagagcttttgggtacataaaatttactattttagaaattaaaacggagaaaagcttaggctattagttcatattaaaatgtcagtctattatgtttgaataacatattttatgaaaaacacatttgctgaaacaaaatggttagaagattacgttgctttacattgttgcaagtcttgaatgtctgccatattagaggagaactagagtctccaatgtgcttctgaaggtttgcattctattgcaataagttgttttggttgaagtttgtgaagaaaatctggctttacccagataataatttagaaaagggaggagtattttaactgataatcagataataatggatattctttttaatgctatacccaaacttaacagatggtaatttcttaaagattagttgcaatgtggaattcgaaatcacatcagttattctatggtggtatcaacaaccttttcatgttatgttgcattaaaatccattagtgtttcttgctttttggatggatcttttacccatgcatgagtttgtaacactgtgcattggtaatttgaaaagatttctttttaaatgcttgaagaatgtctactataagaaaaagttgaatttgttaatatcaccactcatatacaagcctttaagtattgagaagatatcaagctcacagtggtagaaacaagtttttcaaagtttagatttttgcttgaaaattccatattaatcattgtcaacagatacatttgttttccttaaagcaacaggctcacttttttttttccagacaacatctgccaaatactgaagtctgaataattctagtttgtagtttgttagtttttcttttaaataaaaattgcattccatgggaaaaatcagtttagcttgtaactcattttacactagttgttagcaacagcatactctggatatatcgcagaagtactttatgtgtacttcttatgttagaattaaacataaatcaaggtttgaggtttaataaaattaggtttaatcttttcgccaagaacataattctaaaagaaactggcttggcttctgtttaaaacagtgagtgtgtatatttgtgactaatacaatgaattatgcaacttggtgctgctgccttgatttgtgctaagatgcagcagttttattcaatatcgttttgcatcattggtgcaaatgtggctacagtacaaaaggcaaataatatctgagtagtattatttttttatttaaggactttcctcccttttttcaaaggggccctggggaccccaaggatcaatggaccatatttgaagaactgctagtaaggcagaaagaccactggatttaagagttagaagacttaaattttgaagcctgtgcaccattctcgcgtcttatgatgtgcttcatttctcagaatttcagtgatttcatttataaaatatatttggggaaaaaacatcttgttttttgcttttttgttgcttgaattacaattgatgaattaggaaaagctgtaagtgtaagttgttgctatttttaaattagtttcggctatagcccatttgttttacttgtcagtcatgatacagtaaacattctagaaattttcaaataaggaatttaatacaggggattaggttctttaaaaaatcactggaaggactggaggaaagctctagctcagacttctgaaatgactcccacatcattgcaggactgaccagtcagggaagcgaccagtcagggaagcggctacttctgtcacaattaggaaagcggcctcttggactactgagttcaagaacatacttctatagctgcagcccaggaaacaggaagccaggattaggtactgcctctgagctatgcctggaaattggaatgcaaagtctagttgccgcttatattccatctcttgacattcttaaagctggaaattggagcctggaatactgtggaacaacttaaatcttttcaatcaagctagagaaaacagccaaaggcaacaggataatggttgccacccccccccccccccgcccccgctgcactctgccttccatgtctcgtgttagtgcattctaatggatgaggcctaagtttcatccaaaaccctaactgccagtgaataaggaagatagtttttctgtttttttttatgtttagtttctataattgaagaaagtaaacttaagagaacgagttaatggaatctgaccgctaattaatcacacacctaaaccctgtttttctgcttctctgtgattttcaaattttttccacttttcattatcctttctctacttagacctaagttctagccattttaataaccaagatagctttcatttttatgaggcattccatacctttttaatcctcactgcttcatcagtgtttatgaatgttcagttctgggttacactcatcttcagctgtggtctgggtggacttggattttgtaaccagacttgtaaaacctttggcctgctgttgcctgtaaagtgattcaccatttcaattactatgctatataaatctttcacattttacttgcctgtatttttggggggccctacttaatacacttttgtgaggttttattatactctctaaagacattaaaaaaaacaccaccacttccttccatgatcaggtattctttctcatattttaaatcttcttacaagctactatttggagaacgtgtggataaaaatagaagtagactctggaaaatatcaatatacattactttttttcattaaatatataatatgcttttctagtatttatgtaaaaccttatagccatatggtaaaataaagccaccttatcctccccatcctctatcctgtttgttttttttttcctcttctaaaattgtatgattacaaagaaaatatttttaacatgtctaaaatacaccaacctgggcaagacgcaaaaccttgtatctacaaaaaattaaaaagaaaattagccaagtggtgcatgcctgtagtcctagctactctggaggttggggcgggaggatcactggagctcaggagtttgagattgcagtgagctgtgatcatgccactgccctctagcctgggtgacacagtgagacactgtctctaaaaaataaaatttaaaataagcaaataactaaaatgaaggcaaaacgtgtccaaaatacaaataagcataatcccaaccatgcaaagataataacagatagtttctctttctgatcatattattttgtaacctgttaccacttccctacttagcaatataccatggtttctatcactgttgaaatgataatgggagtatttatcattggcatcatctgggttagggaaattgaccaatatatattgggaaattggattaaaagtcatttttattgaaggcggtattagttgtaaccttttttggaaaaagaattaatacttaatagcatcaaggctattttttattagaagagggcttgtttcattcacttgtatatttcatttttgtgaaatgagaatcttgttttaaattaaaaggactgcatatttattaagcaattcagattgtatagaagtatttaaatagaaagtgaaagattcttatacttcttcctcctataactcctttcctcagagttaaccactgttaatagtttggcacattctttcagaatttaaaaaatgtatgtgtaaatgtacatctctggttagtttctgaaacatcagtttttaagagttcactgttaattattgtaatttgataatgtctagatggtagtagtatggacagaatttaatacgtatgtaatcgggttaacttcagaaagcagaaatgtcaatgtttaattgtattgatttcaatttttgttgataaaccattctcagcagtctttctgcttattagcttttaataagagacctcatagtaaatacagagattcttctacagtgaaatatatttctgcttactgctttaggtatattttatcaaaaaaatcattgagttactgagtatgaccagttaaaaatatgtttgcatttatttttagataggcttttagaaatacaaaattagttggtactgactggtttaaagagtatattggatataaaatctccataataaaaatcctttcattttgttttacttttaattttgagaaagatagttttgcttttcagatgtgattgatctcactggagatgataaagatgatcttcagagagcaattgccttgagtttggccgaatcaaacagggcattcagggagactggaataactgatgaggaacaagccattagcaggtaaaaacataatttgtataaagcagatataagtacttttaaaaatagaaatcattaattgggttaaattaattttaagaggtaataagatatactttgttactctaaactagtaatatgcttgtgtatttttaaattttatgtaaccaaaatcttcatatttagttttgattgcaattgggtttagatttttaagattttgggatggtgttatgagggattacatttaggtgcatattttaatatttctttcattttttttcttcccctaatcttttttggatgcactgtccaatttgcaacaatttatagcaagggtcagcatcctttttctgtaaagggctaatagtaaatatttttggctttgttggctatagggtttctgttatagctattcagctctggtgtcataacgcaaaagcagctatagctgataaataatataatgagcttggctgtatcctaataaatcttgatttacaaaggcagccagttggttttgtcctctcggctgtggtttgctgacttctgatctatagcatgataatatgtttatatatattgttcaaataaatgggcagggctccaagatgtgtgctagaatgcagtttttcatttaataaccaaaactttgtagtttgaaacagtttgattcatctaaggactaaaaaatacatttggttttcataatacctctaaaaatggagatataataatttaataagccataaagttgtaactaactgtaatcctctaaacaactatttgaaggcagtggtaactctatgttactgaagaagaaatttacttgcaagaggttaaatgtgctttttccaaaggcacacagctcagatgcatcttaagacttaaatgttcttttcctttaacatagtcctttggtaacagaatgtaccaaatttctcaggtaatttttcttggcacaatatcaataggagatttctttccaaataatcagagattactatatggtaggaaatgtttcaaaatgctatgtttagcaaaggcatataattttttatcttagtgcgactttttaatgtctttaaatgttactttggaaactactttgtaagacattatattatgtaaagacttaattaaactctattgtccccctcattagttgtggctaatatttattgccaggaactttaaatgaaaaccaaaaaatacgtagttaggcttattttctgaagcatttgagaaattatatgaattgggctttttctttttaaaacgtgtattgcaatgcataattgtcttgaataattatgaaacaacaatacttaaactttgagaaatattttaaatacaaaacacatgagttggatttcatatgtaaggggcatggttttatgtgaaaagggttataaaaagaatgtatacttgatacaaatattatttttaaaattatatttttgtttatatgaatttatatgagtatatgaatataaaatatatgtgagcttatatacccaattagtatcagtcgttctattatgtgttttctaattaaaacaacaggtactaattatataataaaagtaaggtaatataaaaagggatgaaggctgttcctaatttgatattcagttcaatgtatatgttatattattgttttggatagttgtttttatccaaaatggcaaaagaaaatctcttcagataatgctgttttttcattctaggtcttttacattttaatataatttaaaaatagtaaatatttggtagatattattattgtagatgacatagagattcggcataatgtaacatgccataaagctatgctccctagaagtaaaagagtcatattaattatgtgtaaattcaataacccgcaatgagcaaatgggtgttcaatgcaaaatatgcatttaataaacttatatgtaaatcatattgtattaggaaaagaggatgtggagagttctagctaaacattatcagagatatatttgctcatatgggtttattaaggtatagaactctaaattcaaaagagaaaatgatgcattttaaaggaagacatttatatattatgcttaaaagtaaattaactccttcttcattactgaagttgatatagggaaaatctttgcaaataaaattccagaatcatttgcttattatattttagtagacataatttaatgtgaagttacacattaggatactacattgtgtgtaatttgatgagataaagcctgtctttttacgtcttagaatcctgtgtttaggcatttatacgtttcatgctaaaattttttaagtagaacgtttttaaagtatttctttatacactttttagtgtcagaattgggtgtatttattatctcttgattatcactgccaggacacaagtggagtatggacagttgaaatttgttaataaactacattgtgactggtttgtgtctatggcatatttcttgtgaaaatggcttgcctcatgaaataactttgaagtgcctcattagaagatagtgctaagttttctagctaaaattgttacaaagagcacgcaccttcaacaatttcaagaagtagtagactacagattctttttttcctcattacttctgtgtttcaactagttatttcttgttatcttcagcctggagttgccattggggaaagaaagaaggatcatgtccaggaatagtcagggtggaattctgaattattaaaataggtctgtataactcctacattttttatccttatcattactgaggaagcagctgtgaaggggaactgtctaaagatggtgtgtgaaacaggagtggatgagggaggcagagttagaaatcttttaaaattgatctttgaggaggatttcggtgctcaataattccagatacttgtggatgctaaggagcatggaagggccatcgaataaccatcaaaccatttaaggtgtgttatgtcagattatagatgatctggaaaagtaagaaatatgacacagattagtttcctgggctacaaggttgtggctgcaggtgactgatgaacagcagcagtgtaacttgaaaaagtatcagcaacagtgaggtaccactgatatccccaggaagagggatcaactggtcgatgtagtcaggctgtccgtgtggcaggagccacaccccatgcaatgtgggctctcctacggccagatacacaggtcaacttttggtaggaatcacatgtctgacaagtagtggtagcttctgtgttagaaacgtagagttccttaatttgtactctgtatacgattgtggatgtgattccattttgggtattgtgattgtggcagtggtggtgatctgggttgtgcaagtttgatcaaaagctttattctgttcatctcattgaagaacacattagagcactcatccatcacaatggctaaaattaaaaagactgatgggaagtgatgtcagcaagatcgccaactagagttgcttggctatcatttccctcacaaaaaaggaaccaaaacaacgaataagtttattttgtctggagtgactgaggaaatgccctggagagtaccaagagaacagcaaagtccctgtggagcatagagtcaagaatagctccacagggaggagaccaaagtatcctgcctctgccatactgtctcccctgcgaggattgaatcaaagccagggggttcctcttcttataggaagaaggtaagcggagaatcatcagtcctcatcaccaccacaggtgccagcagtcactgctacaagagagttccccagtcctcacaggtcccaagtccagcatgaacagttgctgaaagtgcatgtggctacattcccccacagcaggaacctctttgacaccctgcacccctgcaatccaagcagctaagggatgacacaactgtgaaaccaagcccacatctggagtgcttcctgacctggaggccagtagccaccctgtatcccagaggcattgccctcattccacaaagttcacacaagtgcctctagcactaataccttggctacttggagcctaggctcaaaggcacaactggggccctgatacctaaacccacaaggctccctattacccagggaagcaggtgggcctgcatggccgggcagccccatgcggccaccaggctagtgtacatctgtccctggctctagctggcctggaggtggccccaccccaagggagagagtagtatacagccagtgggcctgtgtgaacttgctcccagcttgaatagctggcccagaggttgtctgcctgtaccactggaggattgtgcacagctgccgggccacaatttcctgcctttagtccaatagctggtttggaggcactctttccgcagctcaaccctacatcaccagagtcatgcacagcctccagacctgtgtgcatccacccctggcctgatagccagcccagcagtaaccctgctgccattcaggagagacagtcgtacaacctttctggcctgctgcatcagcatgtgcctgaccagcaaccagcttggtgccaactccagaaaaaccatgccaccacagtcatgggcttctgcatactaagtcactgagataatcacggacatcgcaggtgaggattccagctgaataatctgtttggacaccacaatactgagtccaccctgaaccaaagccaccacacgccatttccaatcagcaccctaggacccatcaacaggaaaaaacctcttcctatgaaagctgctcgttaaaattggaaaaagcaattgtccattacatgcacaggtaccaacatagagacagaagaatcatgaaaaagcaaggaaacgtgtcacccccaaacctggcaccacaatgcatctttagtaatggaatccaaagaaaagaatatttatgaaatgcatgaaaaataattcaaaataatgacattaaagaaacttttgagttgtaagagaatacaacaatttaacgaaattaataaattcattagctgagtgagaaattgaacaaagatagatattatggaaaggaacaaaacaggaatcttggagcttgaggaattaagtgaatgaaattaaaaaaaatacaattgagagccacagtaacagactagaacatgcagaataatacatttctgaacttgaagacagatcgtttgaaataacccattcagaagaagaaaaaaaaaaaagaataacaaagtatgaagaaagcccataggacttatcagacaccattaagcaaacctatattcatattatgggagtgccagagaaagaataagtgaagagaggcatagaccacccatttggttaaatagattgcctgtgtccttctgcacttcttggaaggaagtcttggaagttatggacatctaggaatgaaaagatccccaataaaattcagcccctcaaaatcctctcaaaggtacacaattctaaaagctgtaagacaaaaacattacgtcacatatatgggaattcccattagactgtcagtacatttctcagcagagactgcacaagacaggagagagtgggatgacatattcacagtgctgggaaaaaataaaaataaaatataaaaataaaaactgtcagcagagaatatatccggcagtgctatccttaagaaatgaaaaagaagggccgggcgcagtggctgatgcctgtaatctcagcactttgggaggccaaagcaggcagatcacgaggtcaggagatcgagaccatcttggttaacatggtgaaaccccgtctgtactaaaaaaaaaaaaaaaaaatacaaaaaattagccaggcatggtggtgggtgccggtagtctcagctacttgggaggctgaggcaggagaatggcgtgaacccaggaggcggagcttgcagtgagccgagatcgcgccactgcactccagcctgggcgacagagcgagactccgtctcaaaaaaaataaagaaaagaaaaagaaatagagacgtttccagacaagcaaaggtgatggaattcatcaccactggactggtcctacaaaaacacttagaggaaataataggaaatgaaagaatgattaataccatgaaaatatgtgaaaatacaaaactcatcaatataggtaaatccataatcatattcagaataccccagtgctgtaatggtgctgtgtaattccttccgtcctctaatatgaaggtttaaagttaaaaatgtcagaaatatcaacagctacaattagtggctaaggaacacatgaaagataaagatgtggctgggcgtggtggctcacgcctgtaatgccagcactttcggaggctgaggctggcggatcatctgaggtcaggagtttgagaccagcctgatgaacgtggagaaaccccgtctccactaaaaatacaaaattagctgagcatggtggtgcatgcctgtaatccaagctactcgggtggctgagacaggagaattgcttgaacccgggaggtggaggttgtggtgagccgagatcacgccattggactccagcttgggcaacaagagcgaaactctgtttcaaaaaaaaaaagataaagatgtaaattacagcaatcaaaacactaatcatggtggggtaggggagtgaggggaaaaagtctagattatttttgtgtgaccaaagttaagttgttattagcttaaaatagtctgttgtaactgtaagactcttcatgttagctccatggtaaccacaagaaaaattatagtagatagacaaacaagaaaggaaacaaagcttagcattatagaaaaccaccaaaccacagaagtaaacaagagggaaagaatcaaacgaggaatcttcataatattgagaaaacaaactagcatgagtaaattattacttatcagtagtaaccttgaatgtaagtggattaaattccccaattaaaaaatatagagcagctggatggattgaaaaaaaaaaagacccaactgtatgttgcctacaagagacacacctcatcattaaatataaacatagactgaaagtgaaggaatggacaaagatatcccatgcaaattcaaaccaaaaatgagcagaagcagccatacttgtactagatacaatagactttaagtcaaaaactgtaaaaagagacaaagtcattatgtaataataaaataatcaattcaccaagaagcaaaactgtaaatatataagcaccgaacaccagaacatccaaatatataaagcaaatattattagatttaaagggggaaatagactccagtacaacaatagtagggacttcagcatcccacttttaacagtagacaaatgatttagaaacatgagacttaaactacaccatggacatttacagaacatgaacagccgcagaatacacattcttttcaactgtgcatggaatattctccagtaaagatcgtatgttagagatggtatcaagtattttaccagatcacaactatataaagctagaaatcaacaacaagaaaaacgttagaaaccaacaaatacatggaagttaatatgcaccttaataaccaatgggtcagtgaagaaattaaaagggtaattagaaagttccctgggacaaaggagcgtggaaacacatacaaaaacctgtgggacacagtgaaacctgttctagaagttcatggcaataaatgcctgcatcagaaatgaggaaagatttctaataaacagattaactgtgcaactcagagaaacctgaaaagcaagaacaaattaaacccaaaattggtaggatggaaataataaagcttagagcagaagtaaacaaatagagactaaaagagcaattcaaaagatcagtgaaatttttttgagaagataaacagaatcaacaaacctttagctagactaagaaaaaaggaaaaaaaaaaagactcgaataaataaaaccagacatgaaaaatgaaacattacaaatgtatcacagaattggaggatcacaagagactattatgaacaactgtataccaacaaattctagaatataggaaaaatggataaattcttgaacacacacaacctaccaagattaaattgagaagaaatggaaaaaataagcagaccacaacgagtgggagaattgaataactgctaaagcctgacataaagatccctagtttctgatggctacattgctgaagtgtgtcaaacatttaaggaacaactaatattaattctcaaactattccagaaaattaaagaggagggaatacttccaaactcattttatgaggccagcattaccctgattcaaaaactagacaaggacacaacaaaaagaaacaggccaatatccctgatcaacctagatgcagaaattctcaacaagattctagcacgtccgattcaacggcatattaaaaacatcatccactatgatcgagattcatcccagagatggagggatggttcaacatacacaaatcaataaatgcgatacatcacagtaacaaagagaacggaaaccatataatttcagtagatacagaaaaaagcacattacaaagtttaacatcccttcatgataaaaactctcaaaatagatatagaaagtatgtacctcaacacggtaaagaccatagttgagaaacccacagctagtagtatactgaatgcagaaaaaaatgaaagcttttccactaagatcaagaacctaacaaagatgcccacttccaccaatcctattcaacatagtactggaagtcttagagcagttaggcaggggaaagaaataaaagacatcaaaattggaaaggagaaagtaaaattgtctctgtttccagatgatatgatcttaaatatagaaagccctaaagagttcaccaaaaaactgctacaactcataagtgaattcagtaaaagtgtaggacacaaaattaacacacaaaaatcagcacttctatatgctaacggtgagttatttgaaaaaataagaaaacaatttcatttacaagagctacaaaaaatctagatacctaagaataaacttaaccaaagagataaaagatctctacactgaaagctataaaacattgaggaaagaaatataagacacaaacaaatggaagtagatcgtatgttcatggattagaagaattaatgttaaaatggccatactacctgaagtcatctccagacttactgcagtccatgtaaaaattccagtgacccttcagagaattagaaaagacaatcccaaaaattcatgtggaaccacaagagagcccaaatagccaaagcaagcctgaacaaaaggaacaaaaggtagaggcatcactacttgacttccaaatgtactgctagaatatagtaaccaaaacaatgatattggtgtaaaaaacagacacatagaccagtggaacaaaatagagagcccagaaatggacacacctacagccaactgatttttgacaaaaactgttaactggagtaaatctaagaaatgtacaagaacttccaggaagaaaatgattaaatatcattaagacacattaaagaatacataaatattttgaaacattcgctgtttcatgaattggaagaccattgttaaactggtcggttcttcttaaattgatttatgggtttagtttgatcccaattaaaaataccgttagttttgtttttgcttttttaggaaatcaaatgagatgtttcattacccgccgccccctttttttttctttgtagttgatctatacagcttaaagtgtatgcatgtttctcagtgagtgtaatacttcccaaaaaggggcttaggtgagctatgaagtgggatattttcagtattactgctataggcaatttaacaacacaaaaacaataaaataataacaccccctcaccccccccccaagtaaaaccaccgtgtaataaaatttaatggaaacatgatgatctaccatatgtaaatgctttaaacatttagcgtagtgtgtggaaggaaaagacgcagcaaaacattttgtcgtctttttatattgcttactaccaaggtcatgaccaattttgagaagataaagcaaggtgataggtcagactcgtttttggtatgtggcttgcgagtttacccttcaaacattttgttataggctatctctgaaatttgccttttttttttctcctctaccagctggtaatacctggattttagccactgcatgtcttatacttaagagcttgggtagtatcattggaaaggccaggggaggaacccttatgcaggattttgctttataaaaagtttggatttatggtgccagtactagattatagaaggggatcaggtggagcaatagagcagtattggagctagagattggcttttgcaatcagtcagtcaatcaataaccaagaagtagcagcatttaatatcttcatcatccatttactttaaaaacgtgtttatcactcatttataatgtttgctctagaggtaaagcaaattcttgtttctacttttcagacactgattggagacactggttgatatttttggcacagtgttaagtgtgtttattaagttctttaggaaccaagaggagatggtaggaggagacctactgaggcatgctgtaaaattctggtgataaaatatgtttaaattaagagggtcaggaaatcatggcattcccctttcacctacatgctttttttttgcaccacaattctaccatgtggtatggttaaggtgtattgtgataaacccatttctttaaaacccatacttttgttaacagtgaatgacaatatctaccatatgactgaattgagctacttgggaaatggctattatttttaaatcttaggtgactttgaggagcaatcatcaattacatgtatctcttgaactttaatcaaagttgttacactttgtgcctcatttgatctctgcaaagaaagttatataggagtgctgggaagatgttgtcttggttcgtatccctaactttcttgcccttccaacttcctttttggaatggtgtgacaaatggttcaggctttacttgctcctagaaagtacatttgaggccacacattcttgcaagtcctgtgtggggagagagaaggcaaaggaactaaaaagcttacattatctcagtatatcaatgtgatgtttacattaaatattttgtatgtaaacatgccaatcaagtggtgtatattttttggtagagcagaagacgggcgtaaaggaattgactatacttaaaacatttcaaaagaccttcctggggtttagtaatcttagcccagatctggaatgtgaaaaatgtacttagggtgtattgtgcagaaatcagatgtcctcaagttttctgtagctgatgtatgtatgaaccatttcctgcttattgtgatatgtgtgatctgctctgttgacattattaagaaggatttgtttcttgttataattagtagttaaatataacgacagatgttcatatgctatagattcaggattacgtctggttcttttagacttttgagcagtttatattttagaatatgctgtagaatcctctttttacatattgtctgtctgcactggtactagtcaattgctgggtacctcttctatctcttatataggatcactggtactatttgttttatggtatcgtttttatctgcctttcccagaacttattccatgttttagtctatttatttctgactaccaagatacaaataagtttgctgtatctcaacgtctaaatatacatatatattacaaaaggaacaaaattttcaaatgagaatactgccatttataaaagtcaataaaaagttaaatatcccctctatatagggcagtcttttgtattacagttactttttatatactgtgcattaacctttcttttttgagcataaaccagtcttgaacaaattcagtttgttcaggttattattattctgctgaactgcaaaatttaactgttagaaggtctttaggacctcctgggtctccaataggagagtcaagttgactgtctttctatctctcccttgtattcttgaaaacttgctttctggtaacagtagaatgttctagatattctttggttttcctctgccccagttcatctaactaaatgtctttcaaggagttctatgtcttttcgtgaaacaagcctagagtctggggttgcctgtgggagttggtttttgggcagagagtagtgctggccagtcgggtcactcttaagtgtgacagaagtagaaactgtttacttttcactatatgagtttacattttaacatatcatgttgttaccagtttttcaaaaatgtgtgttttattgattcccaaagactgacttctgtattcacatggatattttagatttccttgtatctaatgtcttgtggtaaatattgctgttaaggataaaataataatattttgacattaatctgataggataaaatctttaggataaaaatggtgtgaaatgaatgagattttcttgataaaccaaaaagttgaaaaaaactaatctttactcaggttctggtaattaacacaaagtggttaagatacctgaatgttatttatgctgatttagaataataagtaacaagtttctttttttttttttttttggctgaagccaagtagcaagtaacacatttcttgagcaggcaaaatgcttggttagatcctatgtgggaaccagggttttccagttatgattatacttatgttgttgcatgctcaggagcaagaaacatcattaaagtagcattacttttgccatgtttagatatacttaagatattcataggtgagtttattttggaaaggttaactatcttttgttattctaatatgtattctaatatttatttcattaaattttcccaaaggcaaacttttgggcaaggcagtgaacatacaggttttcttttcctttacttggctctcatagaggcatagatctcaagaattgaaaggaatcataaagtttaactcactgaactttttttttgtagaagaagaactaagtggtcggtgataaaagtgcaacttgttcagtttttaatgttttcttgattcagagtaattgttataaaaagtggtcatcatgttatattgtaaatatgtactttaattgttatttctcagaaaattcatctagatggtatattcctggtactaatatctaatttgttgaaatgtgatttattgtactttctattatataaaactgccattttatgtttgaaatttcatttttcttaggaaaaaagactatacttctctatgtattagcattgacactgctaaaacgtgtatttgagtaaagttagtattaaatattatttcttcaaatacattattgaaatcttatgtaatgaaaatgcttttagaatgtgtgatatgcctgggatatataccattatataatgctgcatttttttccaccattgattaagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcaggtaaggatttttctttattcagttcttatttgatgtgtgtgatagcaatggaaagtgagttggttgtgtttaagttgtgtactttaaagataagtacagataagtttttaatatactattttgtctaataaactagcttggggattgaagtatcctcccatccctctttgtttttcatttctagtatgtattttttaacagtagatcactacttatgcctttcacttatttggaatcaatttatcctttccttctgcttttaggaattgttggggtggaaagagttttgtatatatttccctgcaaatttatggaagcattgtaaccaagtttgaaactagaactggctttctgtgggtcagatcagatttatttgtatatactagacagtgttatttatagaattatagacacttagtatttttaataagcattttgtttgaggttggtatagatttgcaaatctgagtttgcatgtgaaatgatgtgatgaataaatattgataaatcaagaataacacattgtctttttttactaagaaatcccttaatgatacatttcttgatctgcttattctaaaataagagacatatgtatgtgtagatatccctcttttcaatttggaacagttttcttttacgtgtttaacaactgttatcaaaattctttatcattctcggttgacattgataatgttatccatcagattgcaaaactttaaaacaatttatgaataatatgtccttaatttttattactccttaggaaagttaactaatgttttgtgttcgtttttgtgtgacagttgaattatagcttattatttcatgttcgtgatgaatgctttttccttcattggacatgcatgctattttttgtattcaaaatatatcttcattttgtaactttccaaacctgtgtgtatgacagcttaaactttcatatgatattaaggcaactaacaggttatttggttcattttctacaagttaattgtttttgctaacttgtaattttaacttttttttatatacttcagtgctaaaattttcaccgttttctccctttttgcttctggtgcataatatcatataatttgattttctttgtttttctggatttacctcactttttaatatgctgtggtgcatcctaataagtaatatgctatgttattggctttcccaggacatgaagatgctaaggaatacctggattaacataaatctatagtagtatctttgcttctagccttgattatacgttgtttacttacatgccaaaaagcaatatctaaaatattgataccttagagattcttagatcatcttaataggctatctcactttacttgcgctatctattaagaaggtttgtgcatatgataatttagacataattttaaaatattaagtatagttttaaggctctgaactgagtgctcatgaacatgttttgctgcctgtgtttggtcaagtagatgctatctcagcactattatggcaaatacatgagggtcattgattagaagcttttcttagaaaggtataagaagaaagaaagtatttgtaaataatattgttagaatagttgctttttatttctctatcctgtatgtgtagggaagttctgtttgaaatgataaatgctgatatagggataatgaccttttgttttagtaggataaaacttctttcagcagctcagtttaatcttgatacagttacaatctgtttctaccctaagtttgctaatcttagcttttctagcttttctttttagcttagatttttttttttaagaaggagggaatgggctagaaaaaaattatcttttaaaaaaatgcctagcttatttaaaaactagtaattgtactagttttaaaattttatctaagtttagtggctgcttaactcctaacataggcaagtataagagggcttgagttatttattttttcttttggtgaaatctaaacatctaggagaagtaacctataagcttaaaaattcaggttataatggcctaataagataatggcttttgagggagtagaaaacactaagcatcagattgtggaaaatgatgagtgggcagaaaaatttggctagagatcacctgaagttttattttttatggtaattttaaaatctatcaaactattttaagtagcttttaacttttatctttggtagagtcttcttaaaaattttctaccattattgcttaactctaagctataaactgagatataatacttggccatcataaattgactttttacttgtgaatgaaaagttgggccaaaaatctaccatagtgttggaggttttgttgttttccacagtgagttggaacttactcaaattgtgatgtaaatgtactgtaaagttttgattacaaaattttctcggggatggaatttacttagtaggactaatttgaaacatctgggaattctttttcttgtaaatatattgaccagttatagaagtttgctagtaatatcaccctttaacttcaaagtatatagctggggtaggctacaacagttatagatagctttgcatacttattattttagatactgagaccaatattttggtagaaagggggaacagaatgtaagaaagggaatataaacaaagagaagattgtacagataatggcttaaataatcttttggctgctggcaacattagcctgtctttaggttagacatcaaccccacagctagtcaggattatttttgtcctattcacttggtacttttatgtagaaagtactgattgcagctgttccccactagggtgtcactgaatgagttagctatttggaggtgtatgttcttctctgtagctctgggacatgtcgttgaagtggtatgggtgctcatgatgatccttagccccttagcacctttccatttggatgccgagaagtaaggtgctcatacttctcagtttgcttgtcatagtcccttttactcctattgtagatctgttggcacctgtcacttagtcctaaagccctgctgtgtatgatggtaaagtatgtggttaccttactcataaatcatataactgcaggttgactaaaatacaggcaccctgagggcagagagcacatttagggtactctatattatatatataatacagggtctggcacattggaatagcccatcaagtaattattgcatgaatggatgaatgaaccaaaagggagcatgtatggagtatctaaagtagtacgtgaggatattttaaaaaatgatgcatattgtcagaacatttcaggatataatttaaaatgcttattcatactccttgctcttctctctttaattttcatcaaagaaaaaatcatgtggcactaaaatgcttaaacctgtctgcttcctagtcctgccccttgaaagagacctgtatctaatccatttcttctctatcttcatttttctaaatgacatgccttcccactgagatagatgaggaatttgctctttcagttcacctgcctagaattgccttttgtttcatctctcaacatggttataatacaaattaaaaatagtaggtagtcagtattttcattttttataactttgtaaatgttacagtgattcactaggtcctcccatctatagtactttgttatcctggagttgtcaattgctacctttttcccctattttctatatactttaatattttctaaatgcttcaacatgtttgttatggtcttaataatatattctgtatgcccacacatatttgcttcatttttttgtttgtttgtttttggagttctgtcccatagaccatttctctgtttcaaatttggggtgaattctgattctttgtggtttaagcatgatcactcgctttctaaaagtaagtctagagaaatgggattggtcgatgtgggtatcagtttacatgtttttacttaatcttgctgtttgtagctctcaatcatctctcctttgtactgtgacatacaatttgactgatttttctgaacctgagtcatttaagatctccaaagactaaatttcctatacacccacagaggggaggcaattgtctgaatgtgctgggtctggaaagcacatgggggtttaattgttctgtacatagacttgtggtttcaataatgccatctatttttcaatccctgcctcaccatgaaacttatgtgataccatgctaatttttttttaatcctccgaggagaatttatcacgcttctcagtcttctccactgtaggcagtttatgtttcatttcctctgcactcttgccatcacttctttctttttcacaaattatttgaactcttatcccccattatgtctttgttattagcaagaatctaaccaaacttcattttcgtaagtgcttttcaaaattcacatattagctttggactgaatgaaaggatggttattttcaggtgcattaatcaaaaacactcttcaggcagtaaaagttaccctttcttacctcttttgaaggaatacattggacagtcctcatatgactttggtgaaggatatagggtctttgggacttgaaaaacttaatttttatgatttgttgtgataatcaatggtgatgagtttcactgagtaatggtagatgaggttgttttagaccatctgccttgtgatgttttgctggattccaaaacagaaataaaaccaaccttttgagggcatcacagagtactaaagcagtgaggaattttgagtaaagaaggatagtcatagagtgagcttgttatttttgatggattttgtcctttaggcatctccagaactgactgctgcgtagttgaggaactaagaaaatttttgcacaaagtttgagccctagtaaaacatcttagactgtgagttggaattctaaatggttagaatgtagcattaactgagaactgaaagttaagacaggcttcctagtttctgaattatatagttttaagttatctcagaatttattggattaaggcgacctgagactgtgactctagtctccctgcctgccagagcaaatgtaaattctctcttagaagatagtattatctggaacctttcctcaatttttcatacacaatgtctagtactcaggtcagtcataccagaaaataagatgtgtgtgaaaactaacacaaaaaaatggacaatagaaaacagcacagggaaactggaatacttgtctgccataataataattaatatgttcaaggaattaaaagcaagattgcgagtctgaagaaaactaaaaactgtaaagaacaaaatgtaaatttcagaatggaaaaatataaatgaaactaagaagtcagtggataaatttagcagcattattagacacaactgaagagataattagccaactggtaaattaatctggagaatatttttcagactaaagctatgacataaagatgggagcatcaaagagatactttggatatggtgagtagtactaacagtgtatttgtagttccagagggagagtaaaaggaaatagggcaaaagcatgtttgaagagattactcacaatattccaaacttgagaaagatcaagccatagattcaggaagcaataggaatcaaatagtataaacataaagaatactgcaccaaagtacatcataataaaacaaataactatagacaaagagaaatcctaaaagttgcaaggtggaaaaagatacacgtataaaggagcaaaaacaagactaatagctgactttgatacctttaaacatcaagtcacacataagcagaaataatgtctttaaagtgctagaaataaataactggccatcttgaattttatacctagcagaagtctttaaaaatgaagaaaaactagctgaaataattcttcaccagcacacccacaccaaaggaagttctaagtatccaggaacaaggaaaattctctatctacaatgggagctcagagaatagaagtgggattgaaattcttctaacctgccaagattctctttcctctttaaattcctcaaaagaatagtccatggtttgtctcccctacttaacagtagtcccccttatctttggtttcactttctgctgtttcagttacctgctgttaattgtggctgaaaatattacagtactgagagagagaaggagagggagagagggagaacacattcatataacttttattacagtatgttttctttacaattgacctattttattattcgttattgttgctaatctcatactgtgcccaatttataaatttagccattataggcatgcaaggaaaaaaaacataatatatatggagttcagtaatatctgtggtttccggtattcagaggagattttggaatgtatcctttttggataagagggtgctactctgtaccccattttcccattatttaatgcctctgttcttcctctaccactccactgcaaacatgactttgcagttgccaaatccaaaggttatttctctgtccttaatttattggaagaatgtggcaacctttcatgatattgctaatcttgtcctccttgaaatgtgccagctattttttgatgtacagcagaatcttttgtggaactttgtatctttattgagagtcccctgacacagctattttttaaagctccgcagtttattagaatacacaagtatgtttgaaagcccttgttttctccactcgtttttcttctgtgatttcccttagtattcctttctctttttcaaaactctttttcttttttcctgtgatttttaaatggtgctttctccccaaggttctgatcttggccaactgttaatgtattcatatcccttctggtttattacttctactcttactgttttaaaaagcagtcacaagactgtaatccctacaagggcagagactaccttcttagtgtctggcatatagtagatgctccataaatatttgttaaatgaatgaatagatgatttattttatgtgcttatattgttgaataaatctttctagatcacaagataaaatttttttttacagtttctgttaccagctttatggttttacctttcatatttaggttgttaattgatctatgtaatctggctctatttctttatatgtagttttctcaatacccaactgttgatcaaaaccttgtttcctcattgatttgtggtgccacctttaccttctgtcaagttggctgactcaccttttctaagatttgaaacattatcacttcctgtatagtaattttcaaactttataaactgtgacccaagaaaggaatatactgtatattataaaacattttacacatacacaagtgtgtaaaatatctacaatgaaaattttgcaagaaaatactctgatgtatttactgagtatgatacattgtgatattttccattgtattttatctcattttaaagaaatgttcagtatgatgatagtaaatggttgcaaactacagtttaaaaaacatactccaggaagcctttccatgggcatcctgcatatgctccattagattcttgtgtaattattatcactgcatcttgaagtcacgacatttctattacatgtctgtctcctttctaaattgtgtacttccttgagcattgagataatatgtaatttctttgtgtctctattacctaggatctgatgagtaaatttatttgtactccatttttctagtattaatgatacatctagataattcatggtaaacatagcaggtctaaaaagttttggacttgacatttgcatactctttattttgaggaaactgcttaagtgcatataaaaagagctattaataatgagtagtatatttaaaaagttgtccaaatataatcttgtgcactatcaagtatcaagaatggtatgtcaaataaaagaaacttgactttttctcagaagtatgtcctccttgtgccagttgcaatgattctgagtataagtagtacacagttgtaaaaaataaacctccaagactagtcatttttacattctgctaatggaattttccctcaggttatgttaaattgttgttctttttcagtcattatttaatcttttggaatttagaagattagttctgaattacaagcctccatcaaatgctcaagatttaccccgaaaccaaaaggtaaaattcaaaagatttttttaagcagtatatatactctatatgttctcttatatgtgattgatttttgggcatttacttggctcatcaaatctgaaactgtcaatttgaatgtcaattcattaatcttagttaccatagcaagttcttatcctttgttaatatattataaatacgacttttttcctttacctgtcacagtaatatgccaatttttggtgtcgctttagtaatttttttgggggggactgtcaaatttcagtaaactttataggctatagtttacaatttaaggtctttcctcagttgtctcctaaaaaattttgtggaaatcgaaatttcttttcaattgatcgtcttgtgcagccctttaaaaaatgcgttttgcattcatgtctttgcagtacaaatctgtatctttcattttggaagtgactgtcatagatgggtaatataaagtgacaacacacacaccagggccagattgcgtgggttctagctagggacctagagctggttacttgatttctctctgttccatttactatctgtaaatcatatataataatagtaattatttcatagagttgctgtgagcattaaatgaggtaaaacatgtaaggggcttaaaagtgcttggtacatagtaagtactaggtgtcagctattgtcagttaaacaataaaaaaaattaaaaaaaaaaaaagacttattttaaaaagaaccagtttgcacacagaatttatacctaatggaaaaaattacttatggagatgatatagttgcgtgtagggctttagtggttgatcttgtcataaacaatctgtagtcctaaagtggacttattgccaaggcaagggagttagttttaggtttcagtaaactgctgaacttttttgacctatttttagtaggagtgatgaaatattaaattatgttttcgttttagcgtttaatttttaaaaccactttttctttttctgtaaacacgtgaaacatttataatgcatgctagtgggaagataacttgatttataaccagcttttcaggttataatctctgggctgtagagtgtcaggctgataaacaacccattttcaaaagggagtcaggatcgtctgacaaactcttatgtctccagaaaaattaaggaaaaccctttcaatcattatggtttttacatggaactttctgaactattgcctctgtcattgcaatttgttaatatcacagttcttctctcttctcatatctcaaagtatatgtataatttgtgtgaaatggttgagaattatcatttctagttaggtatgcatgtatgtatatgcatcttgaccatttatggtcctggattttaatgttttacagagctttaatttcttttgttcttcacagagttgaatgaggccatgttagtttgtattcttatttaaaaaacagttgctatatttatgcttatatatcagaacgagttgtgaatactagagaaatgtgtaattccagtcttcagcacctttctagagaagtttgtttcttgcaatgggttagcctctccaggtgtccctttagcttaaggaaataaaagaatttctcacttccattctgagacaattacttagaatactgtgcaattttatatgattattccacaaatgtgactctaatttagtatagtgacagcagtacacactataccttgacatctttgaagcaaatggatttatagatagttatcagccactgaatggtcctatattcacttgagatggtgacagcaggtttttaaaaaaggcgtgagtgtaacttgtcacttatttaataatgaatttaccgccaactcgtgacatgtctacagctacattcaatttgaacactttgtcttaagttgcagaatacatttgggattactttgatcacatcacagagatgccatttgtatgcacttttaaacaggatattttttgctagcaaaatttgccacaaatattacatacatattgagtgagatttgaaagaaatctagtatttgaaattagtatgtattttaagtagacttggcaattgcttgtagaaattgaaactaattttagacactcaggtttctttgaactgttggtaatttcagtgtctaggagaattgtgaggtccctggaaatataataatagatccttgatgtaatcatcccctctcccctcacacagatatacatttggtttaaaatgtttcagactgatggcaaagcatattaaatgttgagaaaacaaagatgcacatgtataatatttagtggaaatcatcatgtaaatagctaaagccttattaattggaaggttatattatttaaagtcttgatttaggacaaatatttcaaaataaagaaatttatcactttccactacttaaagtgaatgtcatcagaaggaaatgggtttagttgagtaccatactgtattcctggagcaaatacctgaaggaattttgaattttacaaataaaaggggcattctgagatttctgccattagtcatgaagaagtaacaggagctggatttataagtctcagtgcatcttagaggattcaaagcatacaaaataccttttctgatgaaaatggtagaaatcaaggtagaaatcaacaacagaaagatatacagaaaatccccagatagttggaaatgaagtaattcacctctaaatatcccaagggacaaaaaaacaaatcaaatgagtaatgtcagaatattgtaagctgaatgaaaattaaaacatgacatatcaaaatttgaggatgaagctaaaacagtgattagtggaagatatcttataagagacatcttaccagacatcttattagaaaagaagaatggttttcaattaatgatagcagcttgcatatcaagacattagagaataaagggcacgttaatctcaaagcagaagtaaggaaataataaaggtaatagcagaaatctgtgaaccaaatatcagaaaaacaatacagaaaattatggaaccaaaaactgcttcttgagaagattggtgaaattgatgaacttctaggtagactaagcaagaaagaagagggaagacatatattacaaatataaggagtgaaaaagggaaacatcactacatactctgtagacactaaagggagaatagtggaatattataaacagcagacaagtatcttgaaagtcacaagctatcaaagctcactagtgaagaaatagataacctgtggtagccctacattatattaaaggaactggaacctgtccaccaaaaaattcagcagctaaatagttttacttgtaaattatattaagcatttaaagaacaaatgataacaattccctataaatttgtacagatacttaaaaagtaaaacttcccaactcattttgtgagctaagcattaccctgaaatgaaaagtaggaaaatacatttcaagaaaagcaaaccacacaccaatatttctcatgaatttggaagcaaagaattgtagcaaatttttgaaaaattaaatcctgcaattatatataaaggataatacctcatagagaagtggggcttatccaggaatacaaaattggtttagctttcaaaaataaatcagtatacttcaccatatcaacagactaaagaaggaaaaccatattatcatctctgtggatgaagaaaaatgatttgaccaaagctaaaatctcatttatggtaaaaatcttctagaaactaggaagcaatttacttttcaaatatgcttctcagcagaattccactaatttccaaaaattattacttccaattttgttactgggaatgtctcaaaaaactgcattgacttaggtgcggtgataaagaaactgatctcaggaaattaagggtacttttgaaagtaattttgtggattaaagctcatagtctttatacttttaaaacctatgtctgagggcatatttggaaccagttttattccctcttacctatttctcaggactcttttttggaatctattctagaagcaattctttctatgtgggttatactattttgggcagcaactatgtaaagatacacccccatcccagacccctagaattttacagtgttgagaatgccaactgtgtaaatttggaagaaaattttcatgtttaatatctaaattttttccgttaaaattgttattataagaactaaatattataagaatggcttgcctggtttgttgtcatgaaacatttcactaagttatgtgaattatgttattttttaaaatttccttcttgttttaaaatacattgttagtgattggtaatgtgggttgttttaatttctttctggagattttgctttaatgagccagtaagaattgaatgctttgtgtagtaaaaagttggggaaaagatatagaaattcttgtctttgagaatcttatagtcttattgagaaacaaaagtaagatttcagaggaatattaggagggtgatatattagtctcctattaggatctggtctaattattaaattaataaaattaaataaatttaaatattgtgattgaattatattaaatataatgttcgataactttagatataaaataaatgagtataaaataattttataagtaatttttattaaatataaaaacaaatattaaatttctaataatcgggtgaggttctaatattagtctaataattaagattgtcacaccacagtgacagtcggtgattcattgctcagtgaaaggcatttatttcagtagatgtggaatttgaaggtatcgttgacttgaaggagtctggaaaggcttcatggaggagtggagatttttgctaaatgggtttattgagatcaagcacttagaacagtgcctggcatgtagtgaacactcattgaatgttggctgttattattgctctgagcagcagcagctgggccttgctgaatgggaagtattatgagaagcagtcttgaatgaggaagatattcttggctgagtaatgacatgatttgctgtgaatatgtggcattcatgctgaaattgtgagcctatcctaggtcttctgcctttttgtgctggacttctttgagtctcttagatggcaccaacactctactttcttcaattatgatagagtgctaattcatccctaaactatattggctagtttaatttttggttactgttaaaatgaatatttattagtaaaaattttcttaatcttcagttaaggtgtttttgtttttgtttttttccttcaataggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcaggtagttctgttgcactgacttgttcattaaccatttgtatttaatctgaacaatattaagcacctttcccaagaatatgagactatttgagatgcatgattctgctttattaaaaataacctggaaccatttaaaacatttgggagacttttaagagaaaagtgatcttgaaggtgttaaaataaagttttaatttatattatgattgaaatgaaaacgatggatacaattaagattatttacaaatacataattaaacatgttcacaaatgtgtgataacagaggatcattatagtacacatgcttttgatattcctgtgtttgctggcagggagtacttttccttaattacccagaaatggtttttgaaagatgttatctttgttattgttgcttttgtcttttattctttatatagtgtattgtggtagatttttatccattaccttaaaagaatattggtaattttcttataaaaaatacaaaatatctataaacaaaccagtattttcacatataattggaaaaatcagagaaattaaagaaggaaaacagaggaaaaaatacagtggcaaagaatagtaagtgttcaaaaagatagcggcaatgtgtaatggcagaagtttcaaaaagccactaagcttgcagcgttgttttttaaagtacatacttggatgtgtctctgttttgtgatgtatggagagggcgtttggaagaggaaggtctgagattctctcaccatcttccttgtgctttttgtttctgctttacatttaccttgtatggcaaatgtgaatgaacaaaaagggcactcacatcagagtttcttttatatgttgttgcatttttaaaaaaaattctaacaatgctccagtgccttttaggcttagtatctactcagctttgtttcttactcgctctgtcatggtaacactaacacaaatcaaaagaaagagaaataattttacagttgattccaaaccatcattttcgggcattcagcattccttctggttctaaatgtgttttacttttttttttcttctttagtatgcatagtatcttttccagtgattctgagtatacaattaaattttttaaaagattacttctgttctctgacttatctttccttctggatggctttttccttgtcttttttctggtttcttttttttttttctttcttttctagagattcatgttgattttggggtatcttttcacatttaaagatgaggcagcatagactttgtctggagccatgtatgtacataggtgggcttttcagtttgagttagagttgaaatggatacaactggcggttaaggccacaatataaatgcttttgcttcagattagcagtgtagactaacttttgaaattagtgattctttttctttagaggccttttaaagtagatgtgcatcaattaaggttgataagtttgattctcttctgttccctaaacacttgaatttgaagtctacaggagtaatttagtgaatctgtaaatgtaagcatcatgatttttttaaaagtgaatttatattttcattgtatcttcttcctaaatatttcaaatacatcatcttttgaagtacacaggagtcttttgagacaccctttggtatgtgatactgttagttttttctttttcttttccgtgtttgtttttttttgagacacagttttgttttgtcacctaggctagagtacagtggtatgacaatggctcactgcagcatcagcctcctgggctcaacccttccccagacctcagtctcccaagtagctgagaccacaggcacatgccaccgcgcctggcaaataattttattttatttttatagagacaggatctccctatgttgccaagcctggtctcgaactcctgggctcaagctatcctcctggtttggcctcccaaagtgctaggattatagacatgagccaccacacttggccccaattgatactgtcaattttaatcatacctttaattgttttattttataattgtcaattttagattgatttctaagaaagatagggattaacttctgaaaaatattgtgttagctaggaaaccttattttttgttggatgtaatgtttaagtgaattaaagttatacaaaagtatgaaaagttgttttaaggtgttacaatagttcctaaggacagtcgtaacaaattacaacaaatggagtggttaaaaacaaaaggttattctctaatagttctagagggcagaggtccagagtaaaggtgttggcagggccacacttcctccattggctctgagggagaatcctttgcttccaccgtactctggtggctgttggtgttccttgccttgaggcagcatagctccaatctctgtcttcctcttcatgtggctttccctcatgtgtctgtctgtcttctggttttctgtttcttacaagaacactcaccattggatttagccccagccctaatccaggctgatctcatctcaagatccttaccttaattatattgacaaagaccattattctaaatagtgtcacattttgaggatctaggtggacatatatttttgcaggctactattcaacccgccacagatgttatgaatgtttacagctggatttttgcgttgcgtttagtcctatttaactctacagctttggagcagtttacttaagcttcccagactttagtttcaacatttttttgaggttaatataaagttggcctacatgctctttaagaaactgctggctgaaaaaatatatgatagtaagtttgttttgtatttggggctattttggtaagtaaggacaaattgcttactactgattcatctgcctgtaagcagcctcagtagagttgatttattgtttttcccttatgttctatttattattttctgtgttccaactcacgttattgaaagaattatggtagttgataacacaactgccacaacctattcctgtttttccgtgttgggagagcaaagaccaaaggcatggtgaaaggtgataaatgggctggttctgaatgatagtaaaggtagatatggcttaaaaagttgtgtgtgtaagttgaattaagaaaagtgaattgtggaaagagactagtcttccttctaagagagaagccagtcataattctttataaaacgaagaactgtttgctaagatgatttcttcattttataaagattcattacagagctctttgggtggggagtaatgattattttttaaaaatctcatttgtaagtttggtttttgattgtgtgtgtgtgtgtgtgtgtgtgtgtattttaaagtgaaacccaataattgattatcatataatgcttgttttttcaaatatcttatatcctggttaaattataaaagtttcttgcatttcgtgtgaaacatttcacttgttatctttgtaaggagttggtaattatatatttcaacaactggctctaggtttgatgttacaacatctagtattttttttttagtaggctcaaatatcaacaggcttttttcttttcacagcaagatgtgagtgagtttacacacaaattattagattggttagaagatgccttccaaatgaaagctgaagaggagacgtaagttaccgtgaagtttagcaatggggttttaggaattcattagatagcatgtattaaatgtcaacagagaaataagaaatcaagacagacttatgggaatcccagtattttctgtattattgacaagctgtttagaatttgcaggcacaaataatagtgtaaccaaaaaaatctaaaaagtgatccctggaagagctagtcttacatgcccagttccttttcttagattcaataatcacttttcatgacgaggaatgaatttgcggtggagaaagatgtcaggaatgtgaattgtgacaaaatccttttacgtagaagcatgaagacagggatatgaagtagcagtgcatgtgagcaagtggctctgttttatctgttcactcagggccccgaggtcacctaggtttctgggatcttgctggcagtgaaaattatactgtgtctctaagtttctgcccagaggtgacacacatcacttctgcaaacattttgttgggcagagctatgtggcctaacttcaaagtgagtaggaatatctcacactaattaggatggcggctacgaaaaaaaacgaaacaccccccccaacccctactgacccaagaaaataacgagggttggcaaggatgtggagaaattgaaacccttgtgcagtgttggtgaggatatgaaatggtacagccactgtggaaaacagtatggggatttcttaaaagattaaaaatataatcaccatatgatccagcaattctgcttcttggtgtatatccaaaagaattgaaagcagggtttcaaagagatatttgtacacctgtgttcatagcaacgttattcacaatagccgaaaggtggaagcaaaccaaatgtccattgataggtgaatggataaacaaaatgtgctgtatatacatacagtggaatattatttatcctgaaaagcacagaagttctgacatatggtgtaacatgaccccttgaagatattatgccacgtgaaagaagccagtcacaaaaggacaggtactataaatcacttatgtgaggtatcaagagttatcaaactcttagcaacagaaagtagaatggtggttgccagaggctggggggagggggagatgaggagttgtttaatgcatatagagtttcagttttgcaagaggaaaagaattctgacattggttgcacaacagtgtgaatatacttaacattaccgaactgtacagttaaagggttatgtacattttatcacagttttaagaagtgagtaggacagtgtatcttaccatgcacctgaacgtgaagggccagaattttttttcagtagcattaaagactgctatactacctactggggttcttgtaagaattaagagaagtacttatcaacattattctaaggattaaatgatgacccatttatcaagagagatggtatcccctctctccctttttaaacaatacttcacaaatcaattaatataaacacaaattaatacagaaaaatctgtacacaattgtggatacaacgcatttctatacagtaaggcaaggataaactttgtctttttaggtcacacaaaccataaaaagacaatttaaaattttcaacttttgtttgctccaagcagaaaagaaaaaaatgaattttggtattaaatgacttggaaaatttgtagatgactaattctaccagcagtgtgaaacttcacaaaagaatgaagtagctgttcagctactttgggtgaaaaactggtacctcgttccctccctggtgagggttgttgtttttggatttttttggactcttccatgtaaatacaggaaataacctatcaaaattttgtagaaatgtattctgattaaaagtggcttttcttccttcccatgtccaaataaacgtgcactacacagagtatgagattgaaatgtgtaatgatgataggaagagcaggcactttgtgcacaaactgtgtcaatttctcttccaagttcatacacgtagtagctcattttaactcctatgagagtcctgtgggtgcagctatcatagttatccgcagttgacaggtaaagaaatggaagaataagtaccttgtgcaacgtggcactgtaaataacagagctaaatgcaagtgcgtgatagccacataagtgtttttgtcttgtcatatgttatagttctttaatattttctctatttataggtccgaaaattgtaatcacatttatattttttaacatactttagggatgaagagaagccaaagaaccccatggtagagttgttctatggcagattcctggctgtgggagtacttgaaggtagagttatacatttactttttattgcaagtgaagagagattattattcattcattcgtctcgatagttactatttttttagtggactttatttttaatttgatatattctgtctagtaatttttgttggattgctactgttattcacataaagcacagaattgaatgaaggaaaaggaatgtacagagtgcattatcacatactaattaatactttattttatcctcatgttttttccagtgagagggcttccatgatacaattatgttggaatacagggattaatgggatggttgatagatcctttgaagataatattggagttaaatactgggcttgatatgatgctcactttctttttcatgttgaaagctgaatttagcaacttagcatagtcagggtattatagagttctcactttttcagtgattttaaatgtagatattagttttcaggaaaagattgtactctatcttttgaaaaatcagtgaagagtgatactactccatttaagctaaatacctgtttcttaaaatttggcctaagtagtttctgtttgggttccctaacaagggaggagactctttaaatgtaacttcatgtaataatattaggtcccaaagcataaacttttgaaaaattgtttttctcacatcacccaatgcatcaacttttgaaagttatctttttccagatcagctaaagtgtaaaatttgaaaaaatgctttttcttcacgatcttaagtagtggattccctgaagttctgtttgaacgtaggtggtttgggattcagaaaaagacaatactaactcagatgttggccctttaaaaagtcttagtgacatgttcgtacgtttttgtttgtttcaagtggtaacaacttatatataagttgttttatatatatatgcacatatatatgagttaatatatataagtttatatatatatgtagaatattttacatagtacatttacgttgggtcattcatcttaatcattctgattttatttgaagtagaacactatctgatgcagcgagtaggtctcatcaggtcatgactaggcactgtttataataccctgcatgagcatttctacctgtattatattgattcctaaaattgattgttattaaaatatttaatttgttggctgggtgcggtggctcatgcctgtaatcccagcacttcgggagcccgaggctggtggatcatgaggtcaggagatcaagaccatcctggctaacacggtgaaaccctgtctctactaaaaatacaaaaaaaaattagccaggcgtggtggcaggcgcctgtagtcccagctactcaggaggctgaggcaggagaatgacgtgaacccaggaggcggagcttgcagtgagctgagatcgggccactgcactccagcctgggagacagagcgagactccgtctcaaaaaaaaaaaaaaaattaatttgtcaatccagtgttgaagtctttgtacttggtattagtaagttgctttagtgattgtgttatataaaggtggccttaatacgttttcacttgaactatgtgtttgcttcagtaaaagtaatttatttcagagtactttcttatcactttttacatagatcttcctaatactttctttcaaaccaatggttcttcattagggatgatttttagtttgtttgccaaagtacccccactgcaaaagtccctcaactttttgagaacttctagttcattgtcccctctcagcccttctctgtacttcactccttcctttttcatctaaaacctaaaactctctttccccccttcccttctggcaccccctccctgttctctaaccttcattaagctgttcatcttttctgtgtctgtactgagtacctgaagattgctggcaaaaagtcacagaaatgggctaactgtagtggatcatgaatttgagtgatactgagcttccgtgctcccaatcctataacccaacttgttctgtgtaatcaccattctttctctcatttactgcaataaatattttcgttttttccactcatttcagatctaacttatctcttcattctctgagaaaatctttacctcagatttcatagatttactgtcacattaatgaaacttaatcacaggttttgcccagtccccgaatctaattttacatttgtagttttgtatcatattctaaaaacacaacattcccaaatatatgagcctcaggctccataacctagatctatcactacctctactatatttttacctgctcctacatataataaaggaattacccagttttatatcaaaagactgttctttatacgtgctcagaattccctcccttcatgcttttactcagaccttacttcattcgttttttcttggcttttgagcttctcccactctttctttctcatcaatatttacacattgtctggtatctcaaaccttaaaaattaaaaacgttatcccctcccatactctttttcagttaataccctctcttgattcttattcaaaattaagcccctttaaagagaggagttagtttcaactgattactccccatttattaaacctagccccagtttagtttctggcttcagaacttgtctaaaagggatcttgctaaggttattgattttctacatgtggttaaatccattagatccctttcagtttctgatatagtttggtcatgtcccaaaccgaatctcaacttgattgtatctcgcagaattccgtgtgttgtgggagggacccagggggaggtaattgaattatgggggctggtctttctcgtgctattcttatgataatgaataagtctcctgagacttatcatttattaaaggcacttcttccatggcggcgacaagagaaaatgaggtagaagtaaaagtggaaacccaggataaacccttgagatttatctggggtttccacttttacttctacctcatttcctcttgctgctgccatgtaagaagtgccttttgcctcctgccatgattctgaggcctccccagccatgtggaactgtaagtccaattaaacctctttttcttcccagccttgcctatgtctttattagcagcttgagaatggactaatacagtaaattgggtccggtagagtaggacgttggtgaaaagatacctgaaaatgtggaagcaactttggagataggtaacaggcagaggttggaacagtttgaagggctcagaagaagataggaaaatgtgggaaagtttggaacctcctagagatttgttgaatggctttgacaaaaatgctgatagtgatatgaacaataaggtccaggctgaggtggtctcagatggagatgaggaacttgttgggaactgaagcaaaggtgactcttgttatgttttagcaaagagactggtggcattttgcctctgccctagagatttgtggaactttgaacttgagagagatgatttaagatatcggtggaagaaatttctaagcagcaaagcattcaagagatgacttgggagctattaaaagcattccattttgaaagggaaacagagcataaaagttcagaaaatttgcagcctgatgatccagtagagcagaaaaccccattttttgaggagaaattcaagtcgtggctgcagaaatttgtgttaagtaacaaggagccaaatgttaatccccaagacaatagggaaaatgtctccaggatatgttataggtcttcctggcagcccctcccatcatagacccagagaagcctaggaggaaaaaatagtttcgtgggctgcccgtggtactcatgctgtgtgcagcctaggaacttggtgccctgtgtctcagctgctccagcttttgctagaaggggccaaggtgtagctcggcccattgtttcagagggtgcaagccccaaaccttggcaccttccacgtggtgttgagcctgcgggtgcacagaagtcaagaagtgaggtttgggcacctccacctagatttcagaagatgtatagaaatgcctggatgtccaggcagaagtttgctacagagttggggtcctcatggacaacctctgctagggcagtacggaagagaaatgtggggttggagcccacacagagagtccctactggggcaccacctagtggaactgtgagaagaaggccactgtcctccagaccccagaatgttagatccactgatagcttgcattgtgtacctggaaaagctgcagacactcaacaccaacccgtgaaagcagccaggagggaggctgtaccttgcaaagccacaggggcggagctgcccaggaccatgggaacctacctcttgcatcagtgtgacctggatgtgagagctggcatccaaggagagcatttcagagccttaaaatttgactgccctgttggatttcagactgtaacccctttgttttggcctgtttctcccatgtggaatggctgtatttacccagtacctgtactccaattgtaactcttctcaggaaaaaaatcagtcagtgttacagtttttaggttcaggtgagaatccttacataatcttaattttagtagccaaaaggccatgttgaggatcattaattttctcccttcttatagggagtaactagcttgcttttgatattacaggcttgtaggcggaagggacttaaccttgtcttagatgtggtttggactgtggacttttgggttaatgctaaaatgagctaagactttgggggattgttgggaagacatgattggttttgaaatgtgaggacatgagatttggaggggctagggctggaatgatgtggttcagctgtgtcctgatgtaaatctcaacttgaattatatctcccagagttcccacatgttgtgggagggacccaggcggaggtaactgaatcatggtggggcagtctttcctgtgctattctcatgatattgaatacatctcatgagatctaatgagtttatcatgggtttccacttttgcttcttcctcatcttctcttgcctctgccatgtaagaagtgccttttgcctcccgccacgattctgagggcttcccagccatgtggaactgtagttccaattaatcctctttttcttcccagtttgggatgtgtctttatcagcagcgtgataatggactaatacactttccatattgaattcttaccagttgttaatgctgatgactcttaacctcttcttcctcctttttcctattctttccttaaaaacacatttctctggcttttgtaacaccatattcttgtggcttttttcctgcctcagtgggtacttctaagaaaagttgtatttatagtctctttttgcatataaaggtagcagaaccttaggactttgtttaggcccatttcttcttcctgtcccatcccctaggcatctcattcagtgccttaatttcctgctgtcaataagccagcaattctatctttattccagaatgttaatcttagttacagattcatattcaactgtcttctcaaattgaaatctcatggatcataatgaaccagtgatttccactgctacctcaaaactaaagaaaaaaaaaatcctgtgttcttacttaagtggtgccattttcagtccataatctgccaggcatgatggttcatgcctgtaatcccagcactttgggaggctgaggcaggtggatcacttgaggtcaggagttcgagaccagcctggccaacatggtgaaaccccacctctactgaaaatacaaaaattagtcgggtgtggtggtgggcgcctgtaatcccagctactagagacgctgaggcaagagaattgctggaactcaggaggcggagtttgcagtgagccgagatcacaccactgagctccagactgggtgacagagcgagactctgtctcaataaaaaataaaatgtcatcatcatcatcatctagttgttcaaaaaaaaaaaaatagtaatcattatcatcatctagttgttcatgccagaattctgttattcttgatattttccttcttacctatctcttatcctgctcagtcaagtcctgttggtgcccttccttgcatatatgtataaatgtatatgtatgtaattttatctcttttctgtatttttacttttaacaaccttcatccatgctacctttatttctggatagattctgcaatagtcttttaacagatgaccacccacttcacacagggactttaaaggtgtttcagagacataaacctgagcctgttattcttagatttaaccattcagtgactgtattagtccatttacatgctgctgataaagacatacccgagaccgggcaatttgcaaaagaaagaggtttaatggactcacagttttacatggctggggaggcctaacaatcatgggctggggaggcctaacatggcagaaggtgaagggcatgtctcacttggtggcagacaagagaagagaacaagagccaagccaaaggggaaaccccttataaaaccatcacatctcatgaggcatattcactaccacgagaacggtatgggggaaaccgcccccatgattgaattatctcctgctgaatccctcccacaatacaggagaattatgggagctacaatttaagatgagatttgagtggggacacagccaaaccgtatcagtgactttgcattatacccagaatgtggtggggaaaaaaattcttaataggaccacaagaccttgtagattttaactcactgcctgacttttcattgtaatctctcccttggttccccaagctacactaacctcctgttagttcctaaacatatcaacttctttactgccttaaagtcttcatcatgctgttccatggccaagaatactctatagtcccccagcactctggcatggctaactcccactcattattcaagtctgagcttaaatgtcctttgccatggaggtcttccctgctctccccaccacctccaagactaagctcccatttttatacctctcacataattctgtctcatcacaactttctttttataacaattgtaatataattatttgtaattatttgtttataaatatatgtgaagttaatgggtataatgttttttaaatgaggctgagaattttctcagctcagggaccatatctctcttgttcactgctgtatatattcccagtgttcagtacagtatcttgcccttagaaaatgcttcttgcgagaaaaaatatacatacatatgtgtgtatataattacatatatgtggatgtgtaatatctatggctgggtataaatgtacatttgcacatgtgtataaaccaacaggaaaattaacactaacacttctcaggaatgaaatcagtcagtgttacaattttcaggttcaggtgagaatccttacgtactcttaattttagtagccagaaggccatattgagtattattaattttctcccttcttataggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagaggtgagtttaacattttcattgtcccctttcttccctaggtctttcttacaatgctatagcacaatgtaaggttctaattatagagctacctaataattgagagagaatactcagagagtatgtttggatttaattggtaatttagacattcaggagacctgtccagtcaatatggcctataatctatgtcaaattctcacttaaataatttatctcagaattttaaaatcttaggacattgttcagtctttttagacctttcaatcaaggtaccagccattagcagcatgctagttcctcgatataaagaagaaaaatcctgatattacagtggattttaaaacagatatatgctacttatatcaactgttattggaatttgtccacgatgcccagattccttttcttgtaaaattgctatgtgattgcataaggtcagatggaagaacttcccttctcaaggaagaaatcatttttataaaatattgttaacttatatgtctacctcaactagtttctttctttccagccatctctgtttctttatccatctctgtagctgcatctgtgtagccattcatccatgcattcatctgtcagggagttttggcactgtaatagtaagcaaaggacatacgtgcttccccaatcagttactgttaagaaattgctgatagttgtctagctgttaaactccatgaatgtggctagaggtctttatctgtgtcattcactattatatccctagtggtaatatggtaactgcatacataatacttattgagtgaatgaatgaaatgtcttggtgcttatcaaacaagtttctgaggtctttatactgaataggtgcttaataaatattaagtgatacgatgtctctgtgtttatctaaaaggagactttgttcttgtgtttttgagaacaaattgcttttgtctaaattttaatttttttttcttaaagatgcagttaaccctttcctgtttcaagtgcatactcatttttttcctcttcccccccacatacataaacaaacaaaaatatgcttttcctgttaagaggaagagatgtatttgaaatagtctttctctctacatcgtagatcatctatttcagtgattctcaatagagaatagccagacttcaaagttatccaggcagggtctacgatagggatgtggtatatggacacaagagctgcacaagtaattctgataaaaacctctaaataagaatgtttaaattcagcttattttattgattgggaaacagatctcttaagagtgggactttaccagtatcccacaatggaataagaaagcagactcttaaaatccgatctgtttgctgttaaatgaaaggatgattggggtagtaaggcagggatggtacttgtttttatattatcagagtagctgaaatacactatggtttattggtaatctttctcacatattcccagcttttaaaaatttttattgtacacagaattgaaattttattgtttatttaaaatatcttagatttgtcctccatctttttattggttttatactctgaatgcccctatgttgcaatataaatgttctgcctaggttttttcatctagcctagggaatataatgatttatgatggttctctattttagcagtttctaatctccactactgtggcaaatttgattgcctgtgattcctgctaccatttttctagatttgctggaggctatagtttcaataataattcagcttgatttaagagactgtcactgactaaagtatagtatcagtttttaaaaaataacatatttaaattatagtcttattatatcctttagaaaaagtattcttgaatctctaaaagccagtaagtaacattacagactatttctaaattggcataatccctgataacaatagctttttcctcaatctattaaaaattgttgattttattttggcccagagaacatcttatttgctgaaatagctgtggccaactaatatataggaagacctccagtcttccaagctaaaacatccaattggctataagagtttaaattttgtggatgatatactaagagacaactgaataagttaaacatgattatatccaaaataactgcttaaatattttttaaatgatacattttaacttttaaatggtatgcaatttgtagatgagtcagactctccaggaaacatggagatattttttgattgtctgttggaggaaaaaaatttcagatagtaaatacttcacttgtagtgtgagtattcactactaccagtgtgtgctgtgtgttcttttagactattgctatgcacatataagtatttgcatctgtccacactgccccgaaagttgcatttttcactcagcagtatatcatgagcatgcttctaagttagtgtagagctttacgtcagtgtttttaaaatctacatagtgtcacatagtctgtatttataaaattaaattgatttaattatcctgtaaggcagtaactcgaaaaagaactattctgaagaatgtctttgtataaatacccttgcgcacttaggaatgaagtatagttagaagtagaatctttgggtcacagggcatactcatttagatgtgttggcactgccaaatttcccttcacaaagttgtaccaagttataataaagtgctagaaggagtttttacaaagctttaaaaacaaaattagagaaacaatatcgacatgtaccatattagacatctgtagaggttatatggggaacttaacttttgaaatcaaagggcaaatgagtcaaggcaattaaatgactggagctaattttttaactggaataaaaagtttttgcttcttgtgcatagtttacatcctggcttggtttgatattccgtggggaatttgaagtgataggtgtgttttttctgttgtttttttctctccacatttgtgtaatcctctcataaaagcaaggtatcttatacactttaatagaaaaccagctattaaaactcataaaaatgacatactctttaggaactacttttgttaacaggtgagatttctagaattgtgatgaatttagaagcacttgtgctgccaatactgattatgtaagttctttattcactaactgcagaaatctattcctcctgtagtttcattatctagtaaaataataatatgtttagagatatggagaatgacctctgtctcacaagcatggcatactagttagattgtagacaagtagatatagttttttgttgaatggaaatatttttttgaaagaaaaatttctcatgtttcgtattatttaaaattcaaattatgtactgctatactacaatccaaatattgcagagctagacataccattaatattttaaaacatgaatttacagaatgtctggttatctcatcttgtccccatcagctttagaatgagaaagtgaaatccttccactcttgtagtaggaaaaacctgccatcgctgatagaggaaaatgcattcataacagagacatattacataacatttttgaacatccttttgtaaggtatggaagctatttatatttcctggacttttcatggtctacagaaaagtgtaccccagtttgggtcatttcatttcttgtggccattgtagatttccatgaattaaaatatgtaactatttaattttaatggtgacatttaaagtattgcaataaaatatgaaagtgatagttcttgaaatctactttcttgtttgagtatcataaaatggagcagagaatattatcctaaagaatcaaaagtgttctttctgatgtgtctggggtaatgttttaattcttaataataattttatatgtggattagaactaactcaaaaattcttgccagttccatgtgagatcaaaatgagtaagcaaactttgctaatcaaattttaaaacttgagatgtttcttatatttttcataattttatttaatccgtttcaggtattatccatataaaacaaattccttaaactttagctttcagtaaaagataaccatccagctcaggaaatctcagttcaagtaattatagcattttgaaagagaaatagtattgaataccatttgcttttatttgctgtagagaaaagtagcaactttccagatcctcctcagattcagtttgccagatgtgtgccattcatgctttttttggatgttcaaatttaaatttggtatattcttaacttattgacagatgtgtggtggcattttgtgacacttgaaattatcacacacaatagattatgcagcagtttcgcatattgcagtttataataagcacttcagaactattttatacttctgttctttgttgatttacatacaatctttctttctctttaaatacatatgcttatgtataatttgaggttgtatatgaaaataattttcttttaaaaatgttgaatttcatgcttaattgaacagttaccaaagcatgtatggggattaggggctgggggtaggggaaggaaattacggctatactcattatcagaatttggctcatagcaatgagacattcaattctttaaacactagttattttaaaagattttaagtaaattactctaagtattaactttttgttagtgatatgtctttttcataaattagtatgaaatccagcagaggagctaaagctaaaacaggaaaacaccattttttcatttttagtatgagagttgtgacgatttatgatataaatttttttttgagtactccctctcataagttattttatcacaggattttgatgctttggttaagtataagtgccattcaacatcacgttgaagaagacagagaagacttgagctactaagtcatggttttaaccagtgtctttttctttgggctagaaattctaatgtaaagaattattttcgaaggatagttgtgagatttctttttttcctgatcatatattatacccactcttggaattttcaagaggtgtggaaaacttttagaaagaggttgagttttaactaaactgtgtacccagttacttgtcaggtccgcattgtggtgatacatataacaatgtcagtgcccacatcctgtgcctaagattgcagtgaagaaaacaaaggtggtattaaagtttttgttattgttttatttcctttcagcattggtttactgaattaccacctgtgttaacatttgaattgtcaagatttgaatttaatcaggcattgggaagaccagaaaaaattcacaacaaattagaatttccccaagttttatatttggacaggtatggtttgatatactgcatgacttagtttgaaacagtttagtaagggagaaaatattgtttagaggaaaattctgcataattttcttagaattaatttctacttttgcataatatacctaataccatttgtcaaggtagatgaaatttactttgtattagaaaagtatagtttttgggaataatgttataaggaaatttaaaaaagatgaattttgtaatcttaaaattcagaattttaaaaaataccattttgtattatctaccttacatcttatacaattttgaatgaattgatgctttgtggtgatgtctgtacttaatattgtatctatctatctttctgtctttctttctgtctctctgtcttcctgtctttctgtcttcctgttttcctgtctttctttcttttgtttttttctgtctgtctttctgtctatctttctgtctttccttcttttttgttttgagacagagtcttgctctgtcgcccaggctggagtgcagtggtgcgatcttggctcactgcaaacaccatctcctgggttcaaatgattctcctgtctcagcttcccgagtagctgggattacagacacccaccatcgtggctggctaatttttgtattttagtagagacgagatttcaccatgttggccaggctggtcttgaactcctgacctcaggtgatcctcccgccttggcgtcccagagtggtaggccgggtacgctggcatctggccatattgcatctactttcatgatattcggaaatgctaatgattacctttttctgatagatacatgcacagaaacagagaaataacaagaattaagagggaagagatcaagagactgaaagattacctcacggtattacaacaaaggctagaaaggtattttaacttttatgaaattaggagataattatcagaaaccatgtatttggtgactagatttttaatttcaaatttgctttgagtgatttataattttaggagtagttaatattgtgtgaatagttttgagttttgcttgaaactaaaaatctatagtagactttaaaaaattattctagtgtttaaaattaaatatctcattgtcaacaggtaatgttcctactgctgaaaatagatacaaagttaaatgaatatagttttgaccttcctttttgcatgaaactaaagattactcttgagattttcattaaaatgaatggtatctgagtttttctccttaaaacaggatacaaactcagctgcctaccaagtcttctcagcagcttcgtaaaggaggaaattgtgtcaggtgtaagatggtatgtgccgggagcctagagagcaatctgtgtgtacagggaatgaatgccattccataccagtggatggtaccatgtatgagtatggcctcactgttgtctattgatttggatcatttctaaaagacgtcagaatctggactgagaaatgttctacaggccagacagaaatctaaaggctgaaatgtcacaagtcatttcagtttgcaaaccccaatctgctctgcattcccctattttaggaattttcaaattagtagtctaaaacttcttacatcaaatagtatattgtattttaatgatttttattcttaaaaagtatgaataatcatattgaaacatgattagtggtaaaagataggaggatagtacacatcactgtcttgatcatgagaccagatgccagatctaaaaataaaaacagtctcaggagatgtcagttttcatcttcctattgagttacaatttagaacagcatttacagattataacagtatatactcacattcagtcccaatcggccttggtttcctgtctttggggaacttttaatgtttttcttaagtgtatattcagttttaccatcttcgttttaaagcaaatgaattttattgctgaggaagttttattgaagtatcgtatcacgttttataataataataaaggcccaaatatgctgtatatagaaataaaagcatttgtacattttatgattaacagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaaggtaaaaagtaatcctgatgcaagagacagttgttacctttattacacaataatgtaactgctgcctttaaagacagtttctataaaatgtatgctttgatttacttcagtgaactcctaagagtagattcacttagaagactgtatgtcctctgggagtttttttattatttcagtagattttatggttatggattaaaattttaatcacattttttttcagttcagaattatactttagcatgttttggtatgtacatatataagattcagcattttatgatccataaaaatagtactatcaaattagaatttgtttctgtaatgtaagctgataagccagggaaaataatatcaccatgcgtaagattttcttgttttttagaaataaatatgattaagctgttttaactctaaagctacaacttcatcttataataatttagttcttatgtattaaaaatctcatttggatgttagatcaatccacatatttctttaagattttttcttttgaattacaagccaatttaatactgtgggtttggcacgatctttgtcaagagtttcagcttgaaaggttaataagaaatactctatgctttgatacagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagaggtaagaagtgtctcatagcatggttactgtcacctcagatggatatgtgtaatgttaatattgagaagggaaatcacgtctggattttatatttaaatattatagtcatttttcttttccagaaagggttttaagataaactagtttggctccccatttttataatctcaatatcaggttcacagggaccaaaagattttccctggattgcttagctgattaatgacatagcagatggcctgattttctagtttgctgctctaaatttatatcaaactggtattcacagttactccattggagaaatgtcatacaatatcaatgtttgtacatatcaattaggtactaaatctaagtttgcacagggagttccggtgattaaaaaattttctttgggcttaagaattagaaatgtgaattttaatttttaatagctctaacagatttatgagtatctatgatcccattactagtctgtaacagagtttttactggcatgcagcaaaataagaaaaataaggacagtgctctgggtggggtgtgtgcacttgtgtgcgtgtgcgtgtgtgtgtgtgtgtgtgtgtgtgtgtgtgtgtgtgtgtcaagttgccatctgtcctttcttggaaggaactctcttttattcttttctattctattttttcttttttttcagaataagttattctgaacttttctctttcctactttgctgctgttaaagtgtacttaaaaaaatggattatggtagattttattacatttttttccttaaatgtgaaaatataattccctattatcattccccaattttatgctgatttattgatttttgaaaaaaatgaactatgtgacatggttggaattatattgaacaatattgattgttggatattatatgaccaacttaactctttatagacaatatttgaaaaagaatggccctaatttagtaagaagtacataaggtatgatggtgactaacagcattagtagctgtcaagattttctttagtatttttcaaataagagggaatttttaaaaatatttgaactcattaacaaacattaatcaagcaaatagtgttgatgaagcactatattaggcgttgggtaattttctactcctcatggcaggttgtttttaaaagattacattcagaggagtggaagctaggaagcttttgacacctaagtagtggcattgagggagggaagaagtgaatgtacttaaaatactctttggagacaactgacagatgtgggtcattggctagaggtaagagagagggacgaatcgaatgattctctcagttcataatggtatgaataaccaaatagaatgtattttggaaaaaaggtaaagcagtgggcaaagaggttcccactcaggggaggaaagagaaatatgatgagttctcttttggccattttaagtttgaagagcttttttgagacggagtctcgctctgtcaccaggctggagtgcagtggcatgaactcgggctcactccagcctctgcctcccaggttcaagcgattctcctgcctcagcctcccaagtagctgggattacagttgtgtgccaccacacccaactaatttttgtatttttagtagagatggggtttcaccatgttggccagggtggtctcaatctcttgaccttgttatccgcccacctcagcctcccaaagtgctgggattacaggcgtgagccaccatgcctggctgttaagatttttatatgtaatactatggatcaggaaagaaggttttcctcaggatattttttttctttctttcatccatattgatgttagcagttagcattattttgtaaactattgtgtaatattccaacacacgggtatgatgtaattcatttaattcccatattgatatttcctaaatagtgctggtcttcgatatacatatttatacacttctgtaagtaggatatgttcttttttatgttcaggggtacatgtgcaggtttgctataaaggtaaattacatgtcttgggggtttggtgtaagattatttcatcatgcaggtaataagcacagtacctgataggtggtttttccatcctcaccctgctcccaccctccaccctaatgtaggccccaatatctgttgtttccttatgtccaccatttctggttcagagtgtgtatattttaaattttgacgactgttttaaaattgtcactccaaaacattaaaccagtttgcattcccactgtgtgagagagcctgtctcccagtatcctccctagccctggacactttttagtagtttttcacaattgaaaaactggtattttagtgttttgatttgcattcccttagcttcgagtgaagttggatatttatattgttctgtaaatttcttgtttgtgacatttgcccattttttaagtattgagctatttgtatttttcttattacttaatagaaagtttaatgtattgtggatattaacactttacctataatatcacatatgctgcagatattattttcccagtttttcatttgattttatgttggttttgttttctttttataatgtagattttttaaagtgttgggcagggaggatcttatcttttcctataaggttactagttttctgacaggcttaagacaggtctttccccactctaaagttagccagtttcttttatagtttttcaaggtttcttcctgattggttcagcagcttcacaatatgatgtggttacaatctaaccgtttccttattgacagatatttaggttatctcttttttaaaaattattgtggacaatatgactgtgaacatccctatctgaacaattttgtaggattattttctactagaagtagaaataattgtcatgggagtgccataattttattttcactggtgattatagtcgatttttattcagttatgtgtgtgtacaagatatgtggtgaacatgttttactttgttcttaagtttacttgtgttatagcaatatgtaaggaagcttagctttcattttcattgaaactctcctttatagatttgaacaaaattcacttttattggctctgcacattttctagataaatcatatttgtgttgtttttaaagtatgcatttgtactgtgtcttttattaagaataactataattcattttctacagatttcaaatggtaatgttttttaagaaaagttttaggaaaattttcctattcctctaacatgtttgtaggaaaaacattagtccttatcttataagtagaaacacatttgctgttaatcattaaatgacaccttatatccttagatttgcaggaaagcatatccagaatccatcgaacaattgaattaatgtactctgacaaatctatgatacaagtaagtgaaattttgagctagtaatcattgtcaaaattatttacatatattttaatttacctttacattatcttaatctaatttttctttacatgttttgttttaaaattttggcaaatcttattgtaaaataataagggcttgcaatatgtacaatgtgacagttcatctgaatggggaaacttttataacaaatttataacaaaattcatgacaagttttccccattcagttgtattttcacaccgtatgtgttgtgtacccttactattttacagtaaaatctaccaaagtttttcaaaaggctatagcatctttaaaaagtcttatgggagaaaatctatggttgttaaaggatattaagatttgggaagaaacttaaggactccattacattttaacttctggtgtatatcatataatctattttgttaaccgtcaatttagaattctgaagatgtagacacatttgctatatgtaaaactgcccactataagctttttattcaaataaacaattaggccaatgagtatgtacacaataaatacatttttagtttttcaaaaatcatctttttaatctatcaactttgcatatctttagcttattcagattccgtctttttaaagttttatagtttagtttttttcaaacttttaagcccagccagttctctctcatttaaaaaaaaaaatgctcttatggttttctccaaacaggttgtttgtgggtttcatggaatgtggtatatagtaaactacataattgcagtttaactcttctttttttcacatttaggttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaaggtaagaatatatagggtggtgtgtatttttaaatagtcataaaagtggctctggtatgtggtgtgattagttaagtgtaattcactcagacgatgaaggatgtggttaggaaatgctactgggttttgacaagactgaattgaaaagtaatgtcgtcagggctaagaattcgtatatattttgtattccaagtcaactattaaaggtaaatatgacctttttcgtccttgctaaaaatgctttagtgactgttccacagattgactcacatttaatatttaattccttagcctaacatatatggcctctgttcttggcctctgattatctccccaccttcattgatcaccagtgttccttttgaatttatatccttactgaacttcttgctgtatctgctcatatcaaaccatttcacacatttatgtttgcatgttcgtatatgttttattttttgctagtaattcttttgcctaattcttgtttatctgtcaagattcaattcaggtgtcatttcccctgcaaactatttcttgatctgccaaaaagtatctctccttatgctgtcctggcatctgtctactgggcatttactgttgtgtattggaactgtgtgatgacttgtcttgcacatttctctcttatctgctcagagccagagatcatgtcatactatgtctgaatctttttaatgctgatattctgatatatgctttgcatatagaaaataataaaggtttattgaaactgataaaaataatctttttatatttagtcattcagaatcagctaggcagtccacttctgactaaaaaaatgaagttatttttctgtgtgtgtagtagaagttcagtaattcttctgaatactctattgtttttaagatcttgctatattaattttcataattgcatatttaagtctacttaatttcttcatatgacaaacaattttcattttattttgagctaataaggttaacatgattatgagttgtttacattttgtgaaaagttttactttttaagtgatcaaacatctggtattttccaatagtggcagaagtagtattacatcactgttagagtagcaaagaaaaaaaaaaatggccgggcgcggtggcttatgcctgtaatcccagcactttgggaggccaaggtgggcagatcatgaggtcaggagatcgagaccatcctggctaacacagtgaaaccccattctactaaaaatacaaaaaaattagccgggcttggtggtgggcacctgtagtctcagctacccgggaggctgaggcgggagaatcgtctgaacccggaaggcggaggttgcagtgagccgagattgtgtcactgcactccagcctgagtgacagcatgacactctgtctcaaaaaaacaaacaacaacagcaacaaaaaacttggctttggctttgtattttctgtcacttctactcttaagataaaaaaaaatctgagaccattacctatgatggattatcaaatattttcatcattgtttttctgagcatttgtttgagttttaaaaagttttgtagataataattatttgctaagcaatagtaattcttaagtaatatgattggctgagtggtaataattcatagtttaaattctatttgaaatgcagtctattttgagctttgcattttccctttaattcttaattttatactagtttttgaaatatgatttgcagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacaggtttgtccatttttattaagttgtgtttgattatcaatattatttttataataagatatgctcattattaaaaagttttagctatcttaaagtgtgaggaaatcagtagaaatcatttcaaattccatcactcagattatcacagttaacaatttagtttacctttttgccagacaccactgtatatatttatatgtttttcaagataaatgagataattctgttgactttccctctacctactctgcctgtgttgggtgggcttgaattttcttggcaagtagcagagaaagctgtgaaatcagcaagaaacccaaaccaattcactaaagctatcaagagtatcaattcaataaagctatcaagagtatcaattcaataaagctatcaagagtagtaattttaaatttggccaaaataatactaccggtatattcatatatactttgtgcaatagtaaaatactaccattaataactatttgatgtttttcggaattcttaagattaagagaaaattgaccaaaactatttagtatatcacaggtaaaaagtaagtgtatagacctgtaaaccaaagatataaatgcataaacatataaatatttaaaaacattattctgaaatgaactattagctgatgaaatcaataagtcaaagtaaacactgtataggaattaagaaaatagtttctagtaaaattgaaaatatattgtctttttattttcttaaaagattactcttcactgagttgcaaatatgttttagggcaacatgttttctggtatagaaaatgctatttctcagagaagctataaattaagcgcatatattttcctcaaactcatttgtctctttttataactgctagtggatattattgaataactttttttttttgcaagatctgcatgttttgtgttttaaggaagtagttccagcttttgtttgtttaatttcatctttcgcagacagaggtttccttgcagcattacctggttgggcttcagcattatcatttgaactttagaaggaattattacttcaatagaagattgttttacagtgctacaatgtagtattgtgactgtcgcaggcatgcacaaatctgtccagatacttaacttattttcatgtagatcaaataattgtcgttgattttgatcctgagaggcagataattcagcattttttaaaaagataatggtatcacagcaacatttggatactacagtgctatggagaataccaccattatagtggctggtgaactctaccattatgtagggctgcacttttcccccacgtgtacaaggctaccgcgtagagcaggtgaagctatgtgggtccacaacaatgtagtttttagtagatgtcaagaggtatctaagctcaaatcacagtgtagtaactatattatagttcctttcatttttaaaacatttctgtccctttgtgatttcatgctttgcattctgtacatattctttccaaatcactcctcagaacctgccccaagatggagctactgtgttattgttcccttaacatttacttattccattcacatgtgactattcttgttattagtgggaggaaggggctgcatagtgtactataagcagttgtggtacctaagctcccagacacaggtgaatcctccattcattggttaagctccagttttattcttggctcacctatattttgtgataccaaaatattaagttctatatatcctcctcctcttcatcctgtctgtttctcatctctccaaattttcagagttaacatattttatttctgcttagtcaaacgaatacatatttccaactaatattcctatctattaaggactagccttgccccatcctcattttacatttgtcatcttttttctttctctgtgaaaagaccatgtgtgcataactgcatccattttcatgatcaatacatctgaccatacactttacatggtgttttgtaatttttaaaaaatgcagtactaggtattggacatatattttcatgtctgtttttaccatgcaaaataatcttagaatgttgatatatttctgggaggaaccagaataaaagatgaagagatggaaatggtcaattcctattcctagataacttttatagttacctttcagcgtgggttatttagaaagcagtggtaatactacttctgtaggaaacattgtatcctccatagacttgacggaaatatgcacttggtttgaattagtagaagtagaacatgccaagtccataaatttacagagtgagattgttgtttaaaagattggtttctattactgttatctttgagattatattaagaaatttgttctctgttgcaggatagtttcacatatcataattgaataagactaatgtttcattagaaccatttattccctattattaatagggaaattttattttaatgtccatgccatcctcttctgattcttctcatggttttcaaagtaagtaatttaatttggtataatacttccaggatctcaaagcaaatctgtattttaatctctcaggtgttcactagtattaccagtgactagtggaaataataaaaggaaatcttgttcataaaatccaacagaatgatttttttcctccctgcaaaatcttctcgttaaagctgaaacataagacctcataaaattcaatttctactgagtgatattccaattaagagtactaattcatattatattaatcaaattagtatttgttcctcttctgctaaaatgtgatcgagaaattcatgcgtatcagttcaccagcaccattcgttccctactgagataataaatgatgggaaagtattttttggttcatttcatgctgcttccctagatctgcttactgcaaaggcaaacttacctgaatacttttgttgagattttcagccagccattctttgctgtcagtgtggggatcagaatgagtaggggagcaaacttacctgaatactgttgttgagattttcagccagccattctttgctgtcagtgtggggatcagaatgagtaggggagcaaacttacctgaatactgttgttgagattttcagccagccattctttgctgtcagtgtggggatcagaatgagtaggggagcaaacttacctgaatactgttgttgagattttcagccagccattctttgctgtcagtgtgtggatcagagtgagtaggggagcaaacttacctgaatactgttgttgagattttcagccagccatcctttgctgtcagtgtgtggatcagaatgagtaggggagcaaacttacctgaatactgttgttgagattttcagccagccatcctttgctgtcagtgtagggaacagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgcatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtggggatcagagtgagtagggtttttttttctgagtgtgaacagcacaccctacctaaggccacttaagagacactggagtcagaatctctggagaaaggatctgatacagtgctatcttaaagagatcttcagataattctgaggttaagcagcatggctctaggctgtatttataaaacagaaattatgctggagagaagagcgttgtccgagttactattttacttatattactcttgtcttatccaagaagtatctgaagtccttacaatatagcacacccagatttctttaaaaaataaggaaacactagtgaagattggaatgaagtgtattgcgtaaggttttataaatttctctagaggaagcaggcagagttggctctggaacttctctacactgtctacaagttaaaaataagctgatgttccaggagagtacggttggatcctgagagtaagacctggtagaataaacagtatcgtcagtgttctcagattccttgaaagcaggaactaggtgatattcttttttttttttctgagacagtttcactttgttgcccaggctgaagtgcagtggcatgatcttagctcactgcctgccgggttcaagcaattcttgtgcctcagcctcctgagtagctgagactacaggcatataccaccacactgggctgatttttttgtattttagtagagacaaggcttcaccatgttgatcagtcttgaactcaaattcctgagctcaggcagtcctcccacctcagcctcccaaagtgctaggattacaggcatgaagccaccatgccaggcctggtggtgttcttatttatatctccagcatctagtataataaacgacatatgatagatgttccttgaaagttttctgttaataagttcattccctatggagatttccaataatgaatttcttaggggtgatcctcagtgtaggagaacataaaattttaaagtagaaacaaaatagtcacacaataaggaggcaggccaaatacatggggtgaggatgtagctctttgtcccggataaatttatggtttgactctggtttctaaacctctctcccccacacccctcagactttcttcggaatggggcccaggaatctgaagtttcaaaaattccaccagcgattctatgcaaccacctaagcgtggctctttgtaggctcttacagggtattgtggacttttaaatacatttctagaaatggatgcactgtgtatctctcaagcagtccgctttaaatcttcttcagtgtgaacgtaataagtattgacttactagtaagtcaaaaaaataaagacttctgaaagatatcagagatgttggtcttatttttatagttaagagcaacccttactctttaatagaaagccaattggtggtaaagttgaccttcttaaaagattgaagaccataaccaggaaatatgcataagtaaagcacccccaaacctcctcaatagcctgtttcaacatgaagatggacaaaaggagcagactcagagttccctcagaatgttgagttgtcttctataacagctagagaagcatggccggaaaatcactctgtggaggccagtcatttgaaaatcctagagaaatacccatagaacagatgagtgattggagagagactttaggaataaggatattatttacctccatagagaactggtcattcatggtgaaatgagtgcatttaaattttttgtttgtttgtttccagtctcccagggtttcaaaccattgtgggtttacctaccgtgactacaacaccactcatctaagttccctgggaggtatatacacagggaaaaccctagagaaaattgttctgtatggcatttagggaatttatagctgtgggccactagtgatggggtttttaatagggttagaggatgaacaacaattgtattatatggtaaaagccgaacttgttctgctgttgttcctaacacagaaatagaaattactaaagtgtatggtagggtattagttgcgtgagccttccatacagaacaacacaatataaccagtacatgttacattgaatagagagtaattctttttgtttaaaaatatgagtaggtaggtacagtctggaaataatgtatcagaaatattaatagtgcttatctctgagtaatgcaaagagttttaaattttccacatttttcttgtttgttctagtaaacatttttattctttggtttgataaattgaagacaaaacctctttttttgtcttctttgacagtttttttatacggactttattttataatctgattcccttgtaattcttctaagaccacttccctgtgagtagcctgtgtttcatctacaccagattactcatcgtttctattgcatataggaaattttcctgtcattatggcatgttcatgaagtatccttcatcttaaaaatgttcttttatctttagtgttcatgaattttttcatattctttaagatcttcctcatatcccagagtctttgtgagtttctctgagagcacttctctagtagctattgtcttttccctcttaattccaaccttttcttactaccaaatgtattatgttcttctctattgtacttatattttggcttgccttccagtgtagagtctcatatatagcagggattttatgaatctttgatcagaccttacaatgtgctattccttctgcctggaatcttttctattcttttctccaagataatcctctacaaatccttcaagactcatctaagttagcacctcttctagaaagtgtttcttaacaggcagcattatctcaagtatgtgtattgggtccacagtgcttttataaaaccttgtgcgtaacttttattgaatttagcacattgtattataatagaatgtatatttatcagattttactcagagttccttaaaattagtgaagtatgtaatcttttttgttttttatatttttaatacctaatatagtactgaaaatggcacaggttcaataaacatgttgggaatgcaatttgaattttttgtttccaatctcccagggtgtcaaatattgtaggttcaactcccgtgacaacgaaaccactcacttaagttccctaggaggtatatacatagggcaaaccccagagaaaattgttctgtatgacatttagccagaagcattcagtgttactcataacgtttttgtactcaaactcctttatggaaggaaaccttggccctggtgacctaaggtggatttgacatgtgttgatcagataacattactcttggtcctaagaaccaattttacaaagattctaggtttcagtgggtcattagaccaatgtcagaccagatggatttattgctttaagttcacatccaattattaaccgttgacattatctgctatggtgaagagaggaagagtgccaaacacaaggaaaagttttatcaacaaggagtttctctcccagccctaaagcagctggcatgagccacctatcatgaagtcttccagaagcagaagtattgctaagctgatggtagccaaagattttctttatctattactcatgggcattgaaaggctattgcagtccaaaatcaggaaatgatttaatgaggacattaaacttcttttaacttctctccttcctttttgtacacattgtaagcatcctcacctctggttttccttatcacatagttttacctccatgatcttagttaactctgtcaaaaacttggtgtgttcatgtgcagtctccacacctttgtgtccaaaatatgtcttgattctagccaattttgtgtccccctgttgctctctctcttaatcagaaagcacatttatttctttttcatgttgctctactgccttctattaccttcaccgatctctagttttactttcctctctaattcgttcttcacaatatccccagaataattttttaaaaactgctatgttgccattatattatgtactatattatatacctgcatcatctcttgccatttctccactctcatactgtagtccagtcatattattcttttttttgaatgtagtccatgcttactgcatggactctccattcttccacctggaaaaacagctcattcattattcagcttaataggtcactttaggtcacatccaaattgctcacatcacttcactgccattgttcccatataaagtgttataatattgtcaaaatttatatatatgattatttggttagtggtgttctccacagatgactgtgagcttcatggagacagagactggctgctttgtcagagactcactgagataaaccctttaggtcatgtaaggattttgggcttgtctcatctagggaacacccagtggatgttcattgtacattgttggatatataagtctggaactcaaaagatggataggagatatcgtgaatttttattggtaccagtttgcctttcctctgacaacactcagctactggggcaagtacagaaaagatggaaggttaggttcattcagggttaagattttgtcaggaagtgtgaaggaagatgctgtggccagagaaaaatagctcctgtgcactctatggaaagtcagcccaagattgctgttcaaaccaaattcttttggtaaaatgctggcaattttccaaaatgagcttttgttatttctcatggcagaaaaatttactgtgaattccttaccataaactataatgagagctttctttcataattattggagtactcttagttctgggtttttgttttttaataaattctgggaagaagtgctatacgtggaaagatatattttactttgaatggaagactaaaattggttcttacataacttcagacatagaaatgaataaaagatttatcttagtatagactctgtggtttatattagatatataattgattcttttctcatgaagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggtaagaacttttcttttggctctctgaacatagccatggtcacgacatttcctccagtatagtggagagggacctgtcagggagtcaggagagacggggcccagtgatggctctgccatgggcatgatcagtgaccatgggcaagtcatctcatgcccaggctgtgatttcctcagctgtgattttaaagacacttttctcttaagtttctgtctttctgctagagaattctaatgaatcataatcatagattaaattgaccatttgatctggaacttaaaaagagaagtgtaaaatttagcagtatttctcctgtctctcacccattcctccatctgtaatctgattacatgggaatagttgagaatttaagacctaattgtcataatttcatgaaatgtgtttaacaataaaactactagatactgtagattagagtattatttaaaactactagatactgtagattagagtattattagaaggataagtaggatgttgcaaaactgtttgtgaatattttaagaacgtcctgtgcaaaaacgtcattaggctactctattgtagttttcaactacatctttttatagcggtaaattgagcatgtttggtgttatactgtgttatcagtgaatatggcattctgagagaagctatttcaagaatttgttactactaaaccttttagttcctgtagtcatttatcttttattagtgagcataagcagctctaatgcagattttgtggtagttccttttaatatttgaagattccccttgacaactaaaaagagtacgacatatcataattttacaacacgtaattttctgcttagtaagtgaattcagtgccagcaataacctgctaattgcaatgaggccttaaatatataataagacttcctttagccaaaatgttcaagagatatggtactctgttaattttgttttgatgaactaaataacaatacaaattattttttgtttgaacaattttgaaaatgtattaatatatcatcttattaaaatgtattaatttaaatagatatttgatgattccaaattttgcaaatgccttagaagctttaaatgaatttgatgtgaacatcactaactctaaagcttttcctggaaaatgctttgtttagtggatctgggatgtctgcttcttgggtgatggtaagaggaaaacctagggaaggagaaagaacagaggagtaggtacaaggggaaatagttttgtctgacaaaaactgcatttgcaaggcctctgctaattagaacttttatttgttaaaggcctaaattatgattaatgagtgtcactttttaagctggtattagaaaaccaaaagcattacttagcttaatgtagaatcctgattttaagtttggaaaatcatatggaatttaaatttgcagaagtcagctaaattttgattgctcagcttcataatatggatatcgtcttataaggtagcaacctactacctcatctttacttcagaaaggaggatgacagggagactatatgatatagacaaatacactatttgtctattcatttaattgttttctggagtggcatccacagttagccccattgcatatgtaaatcctgaagcaagtctgagaattcattaaccgtggcttgatcttacagtcagttgcttagcgtcatggtaactacttcatagcggtttttttcatttaaacttagcgtacactagaagctaaattgcacaggtgaaaagtatcttcagactttgggattaaacatttctggattttggaatattagttttatttattatgaatgcaaccttgaataaattgccaaatttctccagatagacctcagtcttcttttccataaaatgaaggtaattgtaggattagtcaagagcattatttgtaagtgcctggcatggcatgtagtaggcactgagtaactgttggtttccttctgttacatcagtcctagccgcttttcaaatatgcaatatattaaaatcaactttaatataagaaaaatttcctggaaagcgtagaatcatggaaattagagaaagtcttcaagtgtttaggcaccctgctttttagaaaaatgtctttaattttaaatggaatacttaggatattttcaatatagaagagtagaccctgagaaaaagtcatgcatagtcccactcactactcatagttaattattgtaaatatgttggtatttatttcacttttattttaatatgtagatttgggatttatttttatagttgagttgcatacaaaattttgtgttgccttcttttaatcacttaccttttataaccatttccccatgttgtaaactcagtgaaaacatttagtggctgagtattattccattgaataattaacttcttgtttatgtatctgctactcaatcgtatatttgtgtctacttttacattataaataggctgctagaaatgaaaacttttttcatatttcaggttatttccttagaatagatttcccatgctagaaatgaaaacttttttcatatttcaggttatttccttagaatagatttcccatggttgaattactagcttaaaaggtaaaggcacattaatgtggccgtggacttagatagcttttttgtcacccttcttatgagaccactttttaagaagtcatataattaatggatttcaggcaagtcataaaaatcttcgtattttaattatttttgcagcatattaactgagaaacttatttttaactcttttcaagtttagcctttgttaatgtattcatataagacctgaaaacaatagaaaaagataaataaacatgtattttactctagtgagcccttaaattctttacatggaaaatttttatggtactttgggatatctaaatttggcaaatgatactacagaattattatatgtggcaaagtttcttccccctttcagcttttacccatgtatttaatcagcattatgctgttgaaattcttcaatagtaactgaaaaggtttataaaacatttatgttccctaagtgcaatttttttcccccaaagggaatctgttttgtaaggattaatattctaagtgataaccatttgcttcaaatttatattttcttttcctaagatagaattgttttggattggtttgctagtgagaaatcatcaccacaaactccgaacagatttctgaatttacctgtttatatttcactcttgtgtacagagacctagcacagttcgtctcttatatgctagaaagattaaaaatccttaattaaatgtcatggaccaagcacatctctgtagaatgtgtgtgatagtagtattaggttaaaattattcaaatataaacaatttaaagtagcacaacaaagtagtacaatgactcatagctgtcattttatagaacagccgttacatacctggtgttggcttagctgcatattatctctcatgatcatgatacctgttcatgctgatcatttcctgttgaaaagttgtggattttgataaattaaggataagttgtggattttgatatatgtgtgtgtgtgtgtgtatatatatatatatatatatatatatatatatatattttttttttttttttttttttgagacagagtcttactctgtaacccaggctggagtgcagtggtgcagtctcagctctctgcaacctccgcctcccaggttcaagcaattctcatgcctcagcttcccaagtagctgggattacaggcatgtgccaccatgcctggctaatctttgtatatttagtagggacggatttcgccatgttggctaggctgatctccagctactgacctcaagtgatacgcccatcttgacctcccaaactgctgggattataggtctaagctaccacgccatgccaaaaatagtgtttattttaaaaggggcagtaccagttgcagctattggttttgttttgttttattgttcagttaaactctttttctatatatgcttccaggaagccaggaaatgttcacattgctaaaatttacccatatttctaatggaaatgaaacctctttaattgctgttataaaaatgttttttgtaatatcaaaacaaaagtttatctttgtgtatgaaaacttatgcaattcagttacttaagttgttttcaagcaccttcagtacttttggcttttttaataggtaaatagtggatatgctagttataaatatgttgaataagataaataagtatgtaaacatctgtatggtattttgaatgaatcatattagtgtcatgaagttttgaatgaaattttctgaattttacactgacttctgtattagtgtagattactgaaatacatagaatttgttaacaataaaaagaaaaaaaggaataaatctgattgagttgttaaaaatgggtatcagcttccaacagctttttcttattttcagcaggtgtttgttgaacacttaagatataaatatactggagcctcataggctgtatataataagttaaacaaaatagaatatggatattaactggatacacaattgattaccaaaaacaatagaaggataaaattataaggaaaaaaaccctacaaattctgatgagtttagaggaggtcatatcttattttggttgagatatcaagaaaggtttttgggagctattggactttttaaaaaattgtcagctatacagacaataatagaaaatacaactccactattttttatcttaagtacttaaagttctaaatactttcagggaaaaatgtaatgatattggtaatacccagtttgaggatgtaaagggaaaactgcagattttgtattactacttgatgaatgcatttgcttctgatgttcagttttaagtggtttcatttgataccaagtcaatgcaggtatttttaaaagatttaagagtatgtgcttaaacagtttaatagtgcatgtgcgttggaacttttaaaaataagtcatatggatacagggctgctgcttagggatgtgcaggttatacagttgtgcaaggatgccattgttctccactgttctcttttctaatgtttatattaatgatttccttctgcagaaacctgaaaatactacaagccaaccactttctaatcagcgagttgtagaggtggcgatccctcatgtagggaaatttatgattgaatcaaaggagggggggtatgatgacgaggtaccttttacagccctctgcaccattgctacttaacttttgctatttaatacaaatactttgggcatgcctgcaccctcatacttaatgtctattgccacataacatacagctttgccccctcatagtccaaaattactttaccaattattaacagaactttgaatttcaaatgaaaatttaagtagaaaacttatggaatttgtcaaaagaattttctgtttgtggagttaattcttttatgcagaaatagtaccagtttacttccaggttggcagattacaataagatttgtttaattagtacaaaaattttttgcatttaaaaataattttttatattccattcttgttttactggaattacttataatccttttcccactatctcctgccagaaaatcccacagcatgattgcaggatggataattgatatttttgcttctacagcctctccatgtgactgtgagtggagtaagtcatcaccgttactgagtgcctaccgttaataggacctccatgtttattcttatctcttcactgttaattctcatttacttagttttccaacagtatggaggcatttttgtttttcatgatttagttctttggaatccagatgaaaatgatctattgtcttattctatcagatgattttctccccttttccacttttctcttgagacacttaatattactctttttgaggaacggccagtaaagctgtttttgaacaggaacacagaggaggccgtaactattgggtagtgggggaggggggtgatttggaaaaatgcttgttggattctagtttttgtgggtttgtataagaattgcatttatgttaagttttttttcacgtaactttttttctgacttactccaatgttactatcatgctagagttaatcaccaaagtcagaagtgtcataaagacatatcactgtaccagtgtaagaaatcacacgccataaagagaataagcagatttgtgagataaactggtcagagagttttctcaagcaggtgttagatatattgcaattctcagtatataatccaaagtaaatacaatgagtaataggttcagtgaatcagaggtgacggaggcaatctcttgatttctgtaagatagcttcatagggctttgagtaatttcactttgcagatattttaaaatgtaaacagctaaaaataataagctattatgaaaacaaaaaaaatgcttaagtatttgtacttaatggctctacattgttctagttaactattttataaacatgctggctcttgaaaattatgggaactggcatgtttttaataaacctatcaatttattgattaagcagttaagtacttgttttaggatgtgccctctctcatttaaaaaagttgaattgtgattaatcatttaacactatcttttttgcaagtgcttatgtgacagagttgtgtgttttgtcgttttttaaaatttattgcagtgacagtttaacagtgcatgtgcattggaacttttaaaaatgagttgttatggatacagggctgctgttcagggatgtgcaggttgtacagttctgcaaggatgactagacaaggggcagaagtgggaagcaaattgagttcatgatgagctctctgaggcttgaggaagaggtaccttttttaattggtaaaaagggatgttgctttttctaaatagttcactcagaggatagcacatttttctaatttgtttgtctagaagcagggtgcctttttcaaattctccaattcagagaggatgcctttttgcagtttgcacaaaggctccgtatgagccagctgtgccctgtatggatgatcttaaaaggtgcttacatgcatattggattaaatttggtattaaaagtgcaacatttgatttataaatatggaaaacaaaagagtttcagcttgcatgtgaataaattattttagtttaaaaacctttttttaatgttaactatcttctgtggcagatcatgatgacaccgaacatgcaaggtattatcatggcgataggtaaatccaggagtgtatatgacaggtgtggccctgaagcagggttctttaaggtacaatgaacattttcattttcgtgtcttttctttttcaaaattaaacttcttaaaatattttatttctttgaattcagtttggttttctgtataatttctcttttcctatcttagttatggccaccggatatcctagggttttattttatgtattaattaacctaatactgattgtttttctcttaatccaggtaattcaagaaaaaaatctttttatttgagtcactctaatagtgtgcttttgatttgtcagcagaaatttgaattgtattttttatttgaagggaatgaggacattaatgaacaataataagaactgagtaaattgccctggtaatagtttattttatcttcattgttcatattattggtcaatatcataatattctttaattttattatcattaggtactaaattgctttttcgtttataaaatgatttatttattatattatttttgttatgtttccccataattaatttttgataacctagtcagttcaagacatgtgagaacatcaagctgaacacgattccatgatttacccacatctttttccctctaatatcagagctttacaatgttttgattacaattttttccttttacagatttgaaagatgaaaataccatgtatgttttgtcattttatttacattaactgaaaatcttcaagtttttttttttttcactcttttcaaacccttcttagtggttttaaaaagcagcttttttgaggtccagtttgctacagtgaactatgcatttctttctttttgacattaaaaatctaacatttttcattttctgtattttgccattatccaacttggtctttcaaaaactggttcttttttcactgtttctttcagtatacagtacaaaacaaaagccttgtacatagtagtagacctatcaataagcatttttgagtttgctaagattagggtgactaactctcctgatatgcccgggactgagggatttcctggactacaggatttaaagtgctaaactgggaaagttctaagcaaactggtcccaggacaagttgatcaccctattatgatcccataagaaaggttgaaaatctacttctaaaaaaagaagaaaaatgtattttttatagttttctgttttaatacatttctttatagtttctaggtttctaactggcttcctaatttttaccattagaaattccttcttatgcccagatagtctacattttcttttcttaaaaaaaaaacactgaatatatgtcctctaaagtatttatttcttgtggaaaagttatttatgatttacagtgccattgtcatttctgaccagattgggtcttcttatgttgaattgcaaatctcatttttattaagttaatatctgcatataaataatcacctaattgtatatattacaacagttagtaagcccccagtggataatgactttcagttatttaatctgtttggcattaattcatatctttaaatagaatatttgggttttttattcacagtttacacattacctgttgaatttgcttctgtggaatatgaatgatgagctctctttcttttcctgcgtcgcatacatacactgagagacacagctcctatcccccatacacacacacacacacacacacacgtaaaatcttgtaattttgattatatcagaattctgcatttgtaatattattatgtatgctatatgtgattgagttatattataaatattactactttctgtttttcccttaacttttgttttccttaaacttagttgttttgttttttggtttgcttagtttatgtgtattactgatttagttcaaagctgtccactgcttgtttaaatctcctctcattctgcctttaccagttttatcttcttgggacatctattctggagctttatgacctgccccaatctgtattggtttttcttttctcctgatccataactagtaacttgagatctcctttcaccatcattctggggattccctttgcatcctttcctttgtgtattttccatatttcatatatttttctttattggtttgctctatgattttgatagtacagcaagaaagcatgggcaagaatcaagtttgtggaagagggacagagcattttcttaaataagttatgttatattgcaactctcagcacataatctaaataaatactgtggttaataaacttcagtgaatctgaggtaaaagttttcaagttgctttggagattgagtcgaatttgacgttttactcatagcataaggaaactgtgctctttgtcagatgttaaaaataattactacagaatttctatttcactaaccattctccttactatcatcatactccctttcttgcttttttttttctgctggaaaaacacttacaagaatagtgggaatgtacattaggaaggaagtagtttatatgttgatattagcagccagactgcctgggccgactgctttctagctttgattttgggcaaattattcaatctttgtatctcagtttcccgaggtgttaaataactatttattttattgagtcattgtgagctttaaataaattgtatcaatgttacgcttttaaagtagtatctggttgatagtaaatgctcagaatttagctgttattgttgttagtattatcacgaagcttatcttatgtgtccagttctggtccacatatagtcggagatgaaaaatgagaaaaatgaatgtgccatatctgtgtcaaggacctttatttgctaatagaatttttttaactcatttgttagaaattgtcagtaccattttggagtaacaaaattagcagttttgtttggcttaacctaataattactatcataaaaccctctttctacctttttatgtctttagtgtgtgtatatgtttataaaatttctgaagtttgtgtacatttgcacctatctgtgattgagtaatacatgagtgtaacccctttatgtaaacatacatcaagttgtttctaattaatgcatgtttttggtaaaggtagaagcatttggacacaactctagctgataatatgtcaccttaaaaattttttcgtataaaaaatgaaagtaatgtatacaaaatgcagttgtattcagtaatatagaggtgtctaaaataaaactaacaatgacagtctctgccactgccatggccctattgtaaccattcttagcactgtgtatcttgtttttttctttttgtttataacaatgcacatatacagagacttaaaatttttttaatgtagattttactgttcataatattttgtaacttatatcactcagaaatctattgtgggcttaaagtttagacagtatcacattatctttactagctgtctgtatacacacatacacatgtgtacacatgtgtacacacaggtacacacatgtacacgcacacgtgtacacatacatgtacacacacatgcacacatgtacacccacacagtattccatgctatagatatattctcatttcttgtatcttaccctctttatggacatgtgtcctatattttctcccagtctaccatttctatttgaattagtttagagtactttttcttaaacaggttttaaaatagtatgttcgttttcctactttatggattttttttgccatattaaaagatctactcttacccaaagttatataaattttcccactacttacttaaaatacttttcttagtaaatttttattttttaaattcaaatgcttactgtttaactcattagcattttatttgggctttctgcgttctgtattaaatgaatttggtgtttttctattttgtgctgtcttcatcaagtttgcaattagggttatgttagctttggtaaatgaatttgagagctttcctgttttttttaatacttaaccgtgttagcgttggaatgatctgttctgttagttagaactcactcgtaagatcatacgagcctagcgccttcttgcggggtagatcttttaacacatttttttggttcattccatagttattggcatgtttaaatattcttcctttttttgattgattctaatcatcatcatcattcagtattaattcataaaatatgtacacaccatagaatctaacatatggttgctgcttctgtcttcctgtttcccctcaattagatatagtatttttaaatttttgttcttttttgtgcttagtgtattataaattgagggaaaagttgtttgttttgttttgttttgttttgtttgaggcaaagtctcactctgtcgcccaggctggagtgcagtggtgcgatcttggctcactgcaacctctgcctcccaggttcgagcagttctcctgcctcagcctcctgagtagctgagactacaggggcccgccaccacacccaggtaatttttgtatttttagtagagacggggtttcaccatattggccaggctggcctcaaactcctgaccttgtgatctgccctcttcggcctcccaaagtgctgggattacagatgtgagccaccacgcccggccgtgtttttgtttttttttaatatctcttctgtcctgccacgtcctgaaaaaatcttggtcgggtctattttacattagctttttggctatgaaagaaagctttttaactctgtgcctgtttaggtacttctgaatatggatttccttatgtattatgattagaccaactttttaatactctgaatgtttgctagtgataagaatagtgatgccactgtcagccttgttataagaaacttaggtctgagtaagtggacttgctaaagtttaacctccgaattaggaagttaccaacccagtcataggaactctttcaaccacaggccatcatcccacgtgaacgtctacccaataagaatgcagtatgaaaaagttaataggcaaagttgatctggaaaaaaaaatgcaatgggctacactacactaacttgagtccttcttcaaattgactttaatggttaaaactagtttctactatagaaaatccccaaataatagtggcttacggagagaagattctgttgtgtaaaaatgaaattcagaggaaagcaatacaaagttactatgataagcaaaaataaaagccagaagataaaaacaaaatattttcaaagtactcgttgcttgtatatatgtgtagaggtgggagggtcatattataattacaattatgggattagtgtaagttttttcatttattttaaaagacattaaaatttctttttttgtaaaaattttgtcggtatcaaagtacccttagggttttattgaagtaatacttttgtattataaaaattttttcttaatagttgtttcattgcttcataataatggtgtccctacttgccgtaactttatcacccttttttgcttttgaaatgtctcttaatcaccttgtttattcaatagatataaaaatgtttattagaatataaaacatgttgaaaagtacaactcggtgaatttttttttgagtgatactttccttatttacatggcctttaaggaatgtgaagaggaagaattatttatcaacatggtattaatgaaatcttgttccctaaaggtatacgcaggcctaaatcgttaatgcaaaaaatatacttctccatgcatcttgttaaattcaagacagcggtccaacatttccatgcttagccaaagaagactcttttcctcttggttgtgtacatttgtagcctgagttttaagtgccacatctttcaagtcagttacacatcctgcctttaggctctcagacttgtacttccaactctgggttatcacagtgtgtgtttacccatgtgaccaccaactaggccaagaggtagaacaggagtactccagaagtaccttttttccgccttcccatcactacagtctgtccgtacccaaaagtagccattatctggacttctaacaacatacgttagttttcttgttggcctttatacacttggcatcttttactctaggtccttttttgtctgactgcttttactcaacagtgtgtttggagcttcatccatgttatacagttgtcatttcttccctctcatggtattttgttgtatgactataatttttttctatccttctgttgatggacatgctaaaaaggtattgcctgtttatatgcagggcattgtcctaaatccagggatgtagctgggataatgatggactgagttcctaccttaatgaacctcattttctgctagggaaagaaacattaattagagttattagtatgataaagaaccagtgtaatgtggaaaaagaacataaaataagaaaacagagctagtacctagagggcttcttagaaaaagtgacttgtaaactagtaatacataatccaaaatgtagaatgtaaatgtttttctctcacttcctaattctcactccacagtgagcatctattcattgtttcttgtatatcctagagagatagatgagactggcttacattcaggcattcatcctgtatttataatttaaataaaagtaggagtatactctttctttttttttctttttttttttgagacggagtctcgctctgtcgcccaggctggagtgcagtggcgcagtctcggctcactgcaagctccgcctcccgggttcacgccattctcctgcctcagcctcccaagtagctgggactacaggtgcccgctaccacgcccggctaattttttgtatttttagtagagacagggtttcaccgtgttagccaggatggtctcgatctcctgacctcgtgatccgcctgcctcggcctcccaaagtgctgggagtacaggcgtgagccaccgcacccggccagaagtatactctatttgcttctttttcttgagtttatttttcatgtatatgtaattattcatatcaggatttgtagatttatctcagtatttttcctttgtttcctagggtttatcaaaatttatttaaatattctcctagaatagggtattcatgttacaacaaatttgaagaaagttaatacatttccacccaccatagaggctgatgggagcagtatgtcagcacactgataacttactcatactctaatttaggaaactgtctcctactagctgttaccagcaaggtctccatagtcctaggtttaaatcctaacattatcatttaataattgtgacctcaggcaatttattaaattatcagaaccagtttattcacttatatgagaagttatcttgagaattaaatgagataattcacgtggaactcttcaggcagtgtctgtcacataaagaacacctaagttgttacctattcttattaaatttatcagcattgttgttgctgaatatttgagttattttcaatatcgtgaacatttttgtgcatatattattgaacacttgcgtgaacatagcagagttgacaagtcaaagtgcttgcaaattttaaatactagtattatcaaattgcctacatgtagttatattgatttattctactattgatatttgcctaaaaaaagacattaaaaatgtaatctcatatttcaaaatgtatttctttgatctttgtgagggtcagtttttttcataaatattttggcaattggtatttatgttgactgtcattcatctttatacgtttattacactgagtttcttttagttaagtgaacattgatcttctaagacaattgattcatctgtaatttgcaaattatattttgtggtttataatttgtcttttaaatttattttttgtgtcttactatacataattttttagatcttataaaatacagcaactctttttatagatttggtcctgtgatcacttataaaattatgcaaaattttaattctgctgctttcatggttttataatactttttgttttgattacaggatagaagattttagttttctctgaatagtaaaatatccagatagtctaaacataaaatactgactaatgcctccttttcacgctgacttgacacatatactaaatcatacctatactaaatcccttatcagggatttatacttaatgatatactaaatccctacttataagtagctctaactgggtctctgtattccactgatctagttttctgtttttggacaatacactgaataccagtgatcttattgtagatcgtttgtaatacactttcacattttgttagaagaacacttagtaatttttgttcttttataaacaggaagtttggcaagcctcatttttcttctgatgatttttaaaatcaattgccacttcctttccaaatccttttagaattgtatttatgtattaatttaacatgaagcagataattttttttttagtattttgagtcttgcccaaaaggaacatgatacgccttttcacttttattgtcttctgttgtgttctttagtgaggttttataattttatttcataatagtcttatgtccttttgtttaatttattcctacataattttttttgcctttatgaatagggtcatttacttccattttttttttaaccaggttattgaaagggtaggtaacgggataattaattttacatgtttatgttgtatttagttaactttattgaactctttgttttctaatggtttttcattttattttcttgattatttcagtaaactgtctcccaaaaattattttctatatctttatttcttatttcatttctggttttattgcggtgatcagaaatttttattacatattctcaatattgaaataatggtagtaggtgcctttgtctagtttctgattttaatgtctccagtgttttagtattatgtataatgtgtagttttggttccgctttatgaattttaaaatactctcaaattagtagataagggtttccagctaaactgattggtattgaaatttagaaattttataatatacctattaagatgctgaatagatttctccttcttaatacttgtaaacccttaattcttaataattgtaaaggtgttaactttgatctatgtttaaaaaaattattgtaaacactttttgttatctcatatattttttgtacaccacactgtttgtttaccaaaagtgggtgtgggtgttggcatctgggtacatagacaaaattgatctatagtttctttctttatatttgtcaattttggatatacaaattatatatatataatatatctatattatatagccttttataaccattaaggaggctttctcttgttttgttttgtgtttttttttttgagacggggtctcgctctgtcgcccaggctggagtgcagtggtgccatcttggctcactgcaggctccgcctcccgggttcacgccattctcctgcctcagcctcctgagtagctgggactacaggctcccgccaccacgcctggctaagttttttttgtatttttagtagaaatggggtttcaccgtgttagccagggtggtctcaatcttctgacctcgtgatctgcccatctcggcctcccaaagtgctgggattacaggcgtgagccactgcgcccggccgctttctcttgtttttctggctctgtggcagtttagatatcacagaaattatctgatccttgaagatttgacataacagcccagctcgaaaacatcgtgggcttgatatctttcgtgttaccagatttctagggcaaacttttaagttttacagagtctgttcagtttttctgcctctgaaagcagttctggtagtttatatttttctagattattatctgttgggatactgtagtctattaacaaagttatatgtgttattcttcaagaaattttaaaacattttttctgtattatcacctttcttatttctaccgatgagttttcttcccctttttggtcttccatccaactttttggaaagaaaaagcctttgactatcaaattgttacattatattttatttctcctactttatattttatttttctaaattcttgaaatcttttctatatttaaattggatatatatatgtatatatatatatatatctatattttttttttttttttggatggcgtctcgctctgtcgcctaggctagaatgcaatggcacagtatcggctcactgcaacctttgcctcccgggttcaagtgattctcctgcctcagctcccaagcagctgggattacaggctcccgccaccatacccagctaattttgtttgtttgtttgagacggagtctcacactgtttcccaggctggagtgcaatggcatgatctcagctcaccacaacctctgcctcctgggttcaagcaattgtcctgcctcagcctcccgagtagctgggattacaggcgcccatcaccatgcctggctaatttttcctattttttagtagagacagggtttcactgtgttggccaggctggtcttgaactcctgacttcaggtgatctgcccaccttggcctcccaaagtgctgggattacaggtgtgagccactgtgcctggcctggaaatttttttgactaacagcccaataggttttgatatctgatattcccatattagtatagttttttatttctttggctcaagaataatttagagccatattttaaattttctaagtatttaggttggaagatatctctatttataattcctatttgtattacagtgtggtcaaagaatatggccaatattatttcagtcctctggaatttgaagtaagttttcttcatttcttggcactgtcagtttttaaaaaatagcccataagcattttaaaatacacataaactctcttaaccaactttattttagagataagagcaatcagacttagaagattatgtgccttattctatgtcacaattaattataaatgatgtatctagctttttgaattttaatctcatcagtttcccattagatttaactgcctccagaatataaatgtttatatttttggtatccacatactcacatatatatatatttggtatcttcatatatatatatatatatatatagagagagagagagagagagtttacataaaaaattaagtccataagaagttataaatttagaatatggttttacagtattacttagaaaagtagaaaaaagtctaggtagaaattatttgcatctttagaactgaacaaggtctcaaaagcatgacttaaactaattttgctgatgggtcatctgtaggtagatggggaatgaacaagaaaggatatcacacatatggagaacttaagaaacaaaggcatgtgtgcatttgtgaggagacaagcctaacctagataggagggagatccttgttgcaggatgataggaaataagattgaataaatggcattaagcctgattaaaggtctagtgaaaaagttaaaaaagttaaaaaaattaaatagcagttctgtcatctaatgactagtatcacatttcattttgcacatgcgtggtgatttcattgcagtgtctgtgataattaacttaaaataattagcatagaccgccaaaaaatatgggcaaatataattctagaacaggattctgaggaggtagtatgagacaaatataatgttaatttactcataatggcagattgtgtagaactctgctaaatatactagcatggaacatctgttgagaatttgaataaatatgattccagtatattttaaaagccaaaaatttcttaaggaagtgtgtaaaaaatagttaaggaatgcatttatgctagtgaaaatgtttttttgtatgtttgaaaaacagcttctagaaatttagaaggtaatttcttaagaaggaagtgtataaaaaatagttaagaattgcatttatggtggtaaaaatgttttcttgtgtgattgaaaaacagctcctagaaatttagaagtgtctttctacctctgctggtttaaacacctatatactgaaaaatactgtgactttggcaatttgcttgtgaaaattaggagagtcttaaattcagcaaaatcaagaggtgaacatataatcttagagtataagaggttatatatttcagttctataatagaaatctgctatttattaaaacagcttctattttgaaagtaggtaggggaatgatgaccatttagtggaatcactccgtgcatgtaaacctgcaatattaatttaagagactcagtacaaatttgttttattttggtcatgctattttgtactaaagtatgatatacgaaatatttgaatattctaaaagtctattacaggttgagtatcccaaatccagaattcaaaatctgaaatattgcaaaatccaaaacattttgagtgccaacatgatactcaaaggaaatgttcattggagtatcatggattttggatttttggattcggaatgctcaaccagcataatgcaaacattccaaaatctgaaaaaaatctaaaattggaaacacttctggtcccaggtatttcagattagggatactcaacctgtagcctgtgacaatcattatcgaaggttcatatcaacaagaacagtaattgaattgttaatgttttagatttattctcaaattcttcctactttgattattatgtttggtctccccccttccccgtttttttttttttttccgaatttggataataggaagatttttaaagagctctaagagaagcttatgtgtgctacctaggcacacagtaagcgttgataatcttaaatattaaaatacagttgatatttatggctgttatttattcacataagactttggaatgacatgtatatcctcaaaaaaaaaaaagtcagttttttcaagggaaaagtattttaaaataatttgttctcttattctatttataatcttatgctgcatagaaagaacatattagccttcctttttaatgagtatgatattacataactagaatatttcatttaatgtttatcagttattttttctcccatctgtacaatacaaccatatagatcataacatctagacgtcaaagaattacttaagaaaggcatgcattttttaaattaaaaaaactttttaattgaatggattttttgtaatcttgcctgaagcccaaaatgtttatgcttattagagctagaatttacatataagtataatataaatgaatataaaaagctttatcttaatcatatggtcctcttgtacatagcaatatgtacaatatgtgtaaatctatacatatttctatatggtcagatattttctagattttgcttgtatattaaaacatgcattagtatttgttatttcccattattatttgtatattatgaggtatttttgtttataaagaaaaactaagtttaaaccttaaggtaataatagtgataatatattatcattattattcttacattaataaaatgtacgtactgttggagcaataaatacttctttttgtgataattataaccccggggcttgatgttgcattccttatttgtgggctattcagctaaaagttaattgcaataatacgactatgcatttaagaacaattttctttcagatttgagtattgttgggagctatatatcaactctagaattttagtgttcaaactgatgcttagaaaggtaaaacagaacgggaaaacttaccatctccatcttatgatgtctgtgaatagactttgactaggctctgataaattttacagaattactcacattgtaagtttagacatattttaccgctttcatgtgtggaagcaaaaagaacgtttatatagtgaagggataaagaagggcctttgtggccaggcacgtggctcacgcctgtaatcccagcactttgggaggccaaggcgggcggattatgaggtcaggagtttgagaccagcctggccaacatagtgaaaccccatctctactaaaaatacaaaaaatttagctgggcgtggtggtgggcgcctgtaatcccagctacttgggaggctgaggcaggagattcacttgaacctgagaggtggaggttgcagtgagccgagatcacgccactgcaatccatcctgggggagagtgggagacttcttttttttttttttttttttttaaaagaagggcctttgtggtcagttattcagaaaattccttgagtctatggaacatgggactgtgttcttagttgtactgccttgtttgtgatactttaaaagccaaaaaaaaaaaaaagatttaaatgcaagaagaattaaactcataatattgaaggattttttggtgttcaaataattaaccaaaattatcattttcattgcattttccaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtaatttgaaagtataaaattcatatgctcaaatcgttctttttttttttcctgcagattcccaggataattttttgagtatttattttatatatgcatgggcacatattttaataaatacgtaacaaaatttgaactcaatgtgactagttgctggagtctgtggccttttgaagtttgaactgaaaataacttagatcattttaataaattttaattgtgaatcaagtaatcactgcacttattacactcaatattttagaaacaaaaatgggcttctcaacctctgtactatatagacagtttaaattagataaatctttgttgttggggctgtcctatgattgtaggatatttaataatatccctcatctcttcgttagatgacagtagcagctcccaagttgtggcataccaaaatatctccaggtattgccaaataactcctaggggagcaaagtcacccttattagagaatcactggagaaaagttttcagtcttgcagataaaataattaaacattctttgacataaagaggaggcttagaagggttaaattagattcacgcagacatattttctctggaaagagaaaatattctatagaaatttctgtagaatttctgtagaatatagaaaatattctatagaatatttccagagaatgttttctctagattatattagtagttttataaagaattattcagaaagtcctattaaactactaatgttaaaaatcacaatttaattagaatgagtgacactagaaaataatttcagggcccatgtgaaattttagagtattgaaagttattttcatatataaaaacatttatgctgttgcagttcattgtaattttaattctgaaatgatcatccttttatgagtgtctcaaaaatactgagttaaaagtgtatagcaaagaatatgaggggaggcaaagcatctggattgatcctaccttattagatatgtgccgtgaaatgtaggattctgtgcataatacaaataaatagttgtgaacaatatctgataggtggttgaatgctcagtgaatgttggccactactgtttatattagtagcagtgtggacatcatttattttgatacatgcgactgcagagagttcagaaacagggttgttgtgaccctcgttatctgtgctatcagtgtactgagttccattggatctatgctgtttaatttggagaagatattaatggagtaatcacattgacttttcagtcttttgcagttctctgactataactagttaatctgttttgataacctgacttgtgcttgaaagacagagttatgcacatgtgaataaatacatttcgtgaggatttctttatcactgattctgatcataaaatccagtgggatgtttccatttttacctgagatgataggcacgttttagactctttagtatttaagaataaataataccatgtggggggaaaagaagatgcagtgtctcttgagcttgcttaatagatgcacattattttttaaaagtttcatttttttcctatgcaaactgtgttaattagaatgtaatttaaaagccatatatcaatacaacacagtaaatttgaattagaattattgctcctgtcttctttgtaattccccaacattggtcccaaaaatgtttttcacttaaggttatttaggagttgtttctatacaaaagtactgctgtttttgctcagtgtttatggattttgcttttgatttacaaatatatatatatatatatacacacacatacacacacgctcatatgtatgtgtttttttttaaggtgtcacaacataatgaaagttgctcaagccaaactggaaatgataaaacctgaagaagtaaacttggaggaatatgaggtaatgtgctttcttagaggttaaactacagatttagggattctgtaattcactgatattcctttcgtttcagcccaactgaagttgaatttgttatgaatgatgagtaaaaaaattaagtttccaagtcaatgctcaagtaattaataattttatatgtgattttaggattaacatgatatgatagcatgtagaccaaaaagtttaaaatcaaaaaaggaagatttttggttttttatttcaatactaattctcaagtactttttaaatgaacttttctagcttaaaaacagaataacaaatgcattgttaattttgaaatcaacttagaaattgctgttacataataccaacaagtaatatttatcaagaccctactatatgccaggcatttgtctaagccctttacatatattaactgatttaattcagacagtaacactgtaagataggtagtgttcttattcccatttgacacacgagaaaataaggcatagagcagtgaagtaacctgcctaaggttttcacagccacaagtttacagcttggctaatagaacctacattcttaactgttgcactacactgtgcaactgtaccctgtgggctgtattttttccttcactttgattcatcagatatattttggggaagttaattcattttagtccctatatgccatatatgtttgtcatgagacagtgttgtgtgtgagagagcacttacataggtacttgtacatgtgcttgtgggatttttttgtgcacaaaattattttttgtcaactttggctttaaaatattctttattttaattgatgaattcatacacctagtatttcttcacatttttaaatttaatcttatgcattgtcttttttttaatttataagtctagtaaattttaagttgttttcttgggtgcctttgcttaatatttagttccatttacaaacttaattatggtactttagattccctaaataattagtgtaattcactacacaaacagggaagaggaaagagagagaaaacactcattattgatgaaaaccttagctagtttggcgtataaggtaactaccttaattcactaaagagtgtctctaaaaacaaaaataggaaataataaaactgcagcaaatatatagaattgtgagcactgaaagcttaaaatttttgttgtcaaaagcaaggcaatgaaaataagcgaaaagtaaaatactggaaaagaagaaacaaagacatcattatttgtagttttttttaccttgaaattcaaataaaatctacaactgatgtattagaactagtaagacagctttgcagcatgcaaacttgtgtcagacatcaattttattcccttttgccagtaaaaaaagtatgagaaagtataaaagtgagaccatttacaatagtatctgaaactatggagtatatagaaataaatttaacaaaaggtgcgtgtgacttctgtggggaaaattataaaacttattgggagacattaacaaagacctaaataaatgggcatacatatggtatttggaaaacttgatattattaatatatagatatcacttttcccccaaatgctttataaattcagtgcaggctgtatgaaaattccagcaagatgttttatggagcttgataagccaactgaaaaatgttacggaaatgcaaagatcccagtccacctcccatctctgacaagcaagttagtgaacagtataaagactttttaataaatggttctgggaaataaataaaatttgatttcttctttattccatatgcaaaaattcatttcaattgtgaaagactcctgtgtaaagctgtttagaagtcaacataggtagaagcccaaagacattcatttatccataagaggcactcactgaccagatatttttgaccaggatatgtaatctagagccagagaaattcaaaatttgttttctcttgaccctgaggagcaagtcaagtcatcttttagctaataatgactccaaatctgtgccctccacattgattgagagctcttcccttgtccccaagattcgtgttcatggaacttgatttttaattgtgacttgattctgcaatgcttccttcagtttgcttcaacagattggactcattatgttttttttcataaaatcttctcatattctaactgcagggctgttaaatcatacaagtatttaaatgacttgtttttagattctgcatattcctcctatctttgtcttgctctaagttcagggttcagtaaaccatagcctgcagaccagcttaccacctgtttttgtaaataaacttttattggaacatggccatttgtatacatattgtctgtggatactttcacactgcagttacagagttgagtaactgaagaagatgaggcttgcaaagtctaaaatattatctggccttttacagaaaaagtttgcctactcacaacttctaaggtgattctaatgacaacaaggaatgacagtttgaataccttccccagaaaagctaacttcatacttgcaggacaaattttacctttatttgttatgaagatctactaatagcatgaaaattatgtcttgaaaattaaaattaagactggatgtggtggctcatgcttataatcccagcacttttggaaatcaaggcacagggagttgtttgaggccaggaatttgagaccggcctggccaacatagcaagaccctgtctatacaaaacagattaagtaattaactggaactgggagcatgcacctgtaattcaagctacttgggagacagaggtaggaggattgctggagcccagaaggtcaagtctgcagttagccgtgatcgtgccactgcactgcagactgggcaactgagtgagaccctgtctccaaaaaaaaaaaaaaaagtttatattcaaggagaatatcgttggctaataactatgtttcttatttttgtttataatgtttatataaaagccttaacacttttgttatcagtattcactttccaatttatcctacattgaatttcagttatttttcttgagtcaattattataaagtaagctaagaaaatcttgactttggtatcaccttagaattatttagtcctattacatgccctatagttgttttgggggtggggaggggcattgaaatgtgaactgcagttattcttttaccatatctcatgtaaataaactattcgcctacacacttaaagtcaaatttaccacatatttgcgaagttaaaaggttaaataaatctaactttttttagtttcttaaaattatgtattaagtatgtgtccaagctttgattcatactcagcgtaatatttcattttcttccatcagttgatgtagatataataatagttcaataatatgattttatactgatgaatttttgagatgacctgattgattatcctgcctttatatttctgttatctgctagtaaaatctttattgtttaaaacatttcatatccatgcctaataatttttagatttaatgttgtattaataaatagtcttgtgtgccagaaagtaaagtcttgttttagttctgatgtatcttcattttgaactctttatttctattaattcagatagtagcgaaacagtgcattactttttgtacagtttcatagtactttttaaatcttactctgaacatttttaatattttctttcacctacaggagtggcatcaggattataggaaattcagggaaacaactatgtatctcataattgggctagaaaattttcaaagagaaaggtaaggcaaagtggacaaatatgaaaagagcataatttttgcacttaattctattcaggtgtgacctcatccatggaaaagattttattcatactctgtatttttaataaatgttttattttagatcagttttaaatttacagaaaaattacacagttgatatagagacttcccatataccccacataaaatatattttccatttaaaactccgtaaggttggcattagtgtctgtgtttattagctctcaaacactacccttgaagctgagtctgatcttgatatcaagtcagagatagtgtttgcagtctgtctttgtgaactttcaggttctgtaaaaagtgtagctgtagaaaatttttgtgtactgtgactttaaacaaattttggattaattttcatttaaattaaggatggtcttaaaggaatatctacttatttaattatactattattttaattgttattaagaagaaaggatacattttgctttacttacattttaggttatttactagtttgcatgtatttctccacatatttcttaatgcgtgttgttgaacattaacttccctagtgattgttttttgagaaaatgctttattttcaatgcagtgtatattgcagccaagtaaaagggatattgaatttttcctttcttttttgttttatgaaatttaagaagctcccacttaggtaatgatgcttctttttcaaaaaaagaaacaaagatcagtgtttaattctggagctatgctgtccaacatagcggccacctgacaaaacttaaataactaaaacttttaaaaccaaagttcagttcatcggttacaccggccacgtttcagtagttcagtagcctcatgtggttagtggcctctatttttagccagcacagaacatttccataatcacagaaatttctattggacagtactattctagaggacagtactttcatttttatattaatagttatcaaaatttttagttatcacacaaaaggaaaaattaatgttttacttaacaatttgtcttaagtacttaagtacaaattatttaaagtcctagtcattgtgctatttataagataatttcactttagtcattgatgtagaaaacttactttgatcaatacctccaatttatgagttatgtcaatcaagattttatttctttaataggaatattcaaatgtactattagaatttatatttgtgctgatttgagaaaaataatgtgatcgtataattcaatagagtgagatataaaaaggcatttcagtgttacagataaagaaatcagacttcacagagatgtagtaactttgtcaaggtcacacagctaactaggagaagaaaaattaaaatagagacctcgtattcttgtataatttaatgaaatcatgtaagtacaaaatgtattcatttatctcaataagaattaaaaagatgaaactgtcactttgtacctatccggatagcttctgtattagttgttcccagttaacatacattaaaggaatttgagatataacttggaaatatgtttaaatattacaatttgcttgtcagttttcaaatacatacttattcagaaagttaatattctagtatagtaaatacttaccaaattagaaggattaactagaaaatcaataatggtgacagatattacttgtggaatatcttttaaagaaatattggtgtgtgtgcgactgtgatcccagctactcaggaggctgaggcaggagaatcacttgaacccgggaggcggaggttgtggtgagccaagatcgcgccactgcactccagcctgggcgacagagcgagacactgtctcaaaaaaaaaaagaaagaaatactgttttttttttttttttttttttttttactttaaatctttaaatatagcagttattgtagctagctgtttgtaaaatattgccaaaagattctgtcaaaattgtttttaatgaaaatgtaaacatttaaaggcttgaatgaaatactgatggacccttgtgagtcctgagaacagtgaagtgaaatcatggttgcaagaaccataattttatagagtgtaccaggctacatgatcttattttatcttagataagaatatggtaattggactgctaaatcttattctaaatttatttgaatatacattcgtaagcactttaaagtttgataacatatggaacattttgcgtacctcagtagagaattggaacaaggtcatggtttcagagcaattctcaaagaggtgactcaggtctagaaagccagatgtcagtgtcattcaggagagatcttcttaacaggaaactcagtagctataaaggaaaagatagatgtgctagttacttattaattaacgaactactacaacttaatgttgtaaaacaacttttaatattatcacttccttcgtttttcataaataacatctttaactgagaatatgtttattaacctaatatcatttcaaaataaaatgttatacttaatctcaaaaacaaattcctagaaagccgttttcaaaaaatgtataaaatagacctatttatcatgacaccttcaggtgtgtaatttgatttgccatgaatgtatacattaatttttaaataattttacatttaacatttgggatgtggaatggatttattttgtatctaagtacatgaattaagtaataaacagtaattattggcaggagcgtctagagtttaaaattgtgtttctttacaatatttcattttttaaaatatatttttccatattaatctgtgaaaaaatatattaatgaaaaactgacgcaaaggaaatattttaaaataatattttttatttcagttatacaaatacttggctagatatagtttttattttgacatgttagaaggatagttttgaggtaaaagtaattctttattaaatatttttttcttccatttttgttttgttttgtatttttgagttggggtcttgctctgttgcgcaggctggaatgcagtggtatgatcatggctcactacaacctcttaccttctcagctcaagaagtccttcctcctcagcctcctgagtagctggtactacaggcatgtaccacgatgcccagctaatttttttttttttaatgtttttgtagagatgggggtgtcaactatgttggccaggcaggtcttgaacttctggcctcagctgatcctgtcaccaccacctcccaaagtattgggattacaggcatgagcgactgtgcctggccccttttcttccctttttaaaacctaatttgaatttcataatatctagacttacattaatataacacatatgcctaattctatcacttcttttttttttgagacggagttttgctcttgttgcccaggctggagtgcagtggcgtgatctcagctcacctcaccctccacctcccgggattctgctacctcagcctgccgagtagctgggactacaggcatgtgtcaccatgcccggctaatcttgtatttttagtagaggcggggtttctccatgttggtcaggctggtctcgaactccctacgtcaggtggtccgtctgcctcagcctcccaaagtgctgggattacaggtgtgagccgccgcacccggcctctatcagcttttttatgtttgcaggctttttgtttttgctttattccactaggtttcccagatttagaagaaatctttcattgtccacttcctctatttcctttagatattcttatttctattttttttttacatttttctcagtaactaaaactgtctgcacatagaaaagaacctgtctaagttgtcattgaacaaaccaaatgatgtttgtgatcatttacttcatataaatgtgacattgcgttaaacaattagattgttggctttcacattagctccaattttgagtttaaatggaagacatcaggaaaataaataccaaggaaaacagaactatctgactttatcagttattgcctcttttcccagattttttcttaatttatagctcttctttttttacttttaagataactatctctgggtttcagatgttgctgttgctaaaaaggcgctctcaagcatacactgcgtcagatgatattttttattataatgtagattatcaaaacttaagcatatacttaaaatgtttcataattatagctgactttgtttctacaaaggtgaaatactaatgttatatgtttctttttaattttcaagttatatagattccttgctgttcctcatctgtgcttatcagaataacaaagaactcttgtctaaaggcttatacagaggacatgatgaagaattgatatcacattatagaagagaatgtttgctagtaagttgaatgcatatagtatgatcttatcattttgtctgacattgggcaagttttccagactcatatataagtgattgactccataaactctgaggggataagaacatgatgatgtctataaactggttctagtcccttcagatggaaaagtacactcagtactttattcttttctctttatgaatcccaagtactataggtgataaatgagaaatgttcttaaaatagcatcagtttgtttacatttctgtatttagatttcgtcatcacactaccactcctttttttggtgggagaggaagggatgcatagataagccttaaaaaatgttttatgtaagtctataagaatatgcaggctggcgcagcagctcatgcctgtaatcctagcactttggaaggctgaggctggtggatcacaaagtcaggagatcgagaccatcctggccaacgtggtgaaaccccatctcgactaaaatacacaaacacaaaaattagctggatatggtggtgtgcgcctgtagtctcaactactcaggaggctgaggcaggggaatcgcatgaacctgggaagtggaggttgccttgagccaagatcgcgccactgcattccatcctggcaaccaggtgacagagcaagactctgtctcaaaaaaacaagaatatacatagaatgtattagagtaatttgtttaacttaaaaaattgaattttcaggtacaagaatagtatagctgactttaaacatacatagaaccaaaacctgatggttcctctgaaaccttcaaaaaatggtataatgtttctcatcattttttgtagtaacccagccacatttggttatttgttttacataggaattgaaatgaaacctcgtcaagattactttagtgttcctttcagattttttcacgttgtatatttacaaagtgtcaggttctgagggatacaaacatgagtaagatgtacttcctgtcctcagaaaactcagtctggtaggagacataattgtttgttctggaataagtgccattatgagaaatatgcacaatgatatgcctgaaatatttgggaagaaccttaagagacaaggtaaacctcgtctggatcttgatggataaatagaagttttattcatgatagagaagggagaatattccagtacacaacagaaaatcaagataaattcactgtggctatccaggttatgaggaagtggggtaaggtggaagtgatgaagctgacaatacttgtcgatgtcagatgatgaagaaacttagatgacattcaaatgagtttgcaccagtgtaagtttgattaggtttggcataatgaggtttgttttcagaaaataattctggtaataataatagcattctagaggatgaacaggaaagaagtagattgaagtcaagaaccttagaggggaaagtcaagggacggagagtgaggacctcaactcatgtagtacggtaggtatgatggtgaaggaaatgaaatcggcatgtcatagctgttgggtgagtgggaagaaggaaatggaagagtcaaagctgccaaacttactagtttttcgtttaatattagggagtctaataggaggaacaaggttggctttgaacatgttttatttaagagatttccaggacattctttgattcagtgaacttaacattaaacttgtcattaaattttatatatcatttaatgcatacttccaaaaattgtagtaaatacttgaagatttatctcattttattctcttaacccctatggttggaagataaaataccctattattaatataaagaaagtgaagctaacagatttagctaatctgttcacgattggtgtattagtccgttctcacactgctataaagatactacacaagactgggtaatttataaaggaaagaggtttaactgactcacagttccacatggttggggaggcctcaggaaacttaaaatgatggcggaaggtgaaggggaagcaaggaccttcatcacatggtggcaggagagagaagtgcaagcagaggaaatgccagatgcttatgaaaccatcagatctcatgagactcactccctgtcacaagaacagcactggggaaactgtccctatgatctgatcacctcccaccaggtctcttcctcaacacctgggggttacaattcaagataagatttgggtggagacacaaagcctaaccatatcaattgggtaattgattcatggccaagttggacttaatagcacaaccatctttccaaaatcaaaataaattgcataagaattatgtggtgtaaatctaaatatataactttttttatttgaaattcagcttaaaagtcatgtttatcatgctgtaaacataagattttaaataagaacccttaaatattataggtcttatacctgtatttatctcttatgtttcttattgcatggatttctctgttctactagatcagtgatcagcacactatggcttgtgctccacctaccacttgtttttatagataagttttattgaaacatagccatgcacattcatttatatattgggtattattgtctttgtactacaatggcagagttgaatagttgcaacagaaacttcatggccttcaaagcctataatagtcctcgtctggcccttcacagaaaaagtttgccaatccttgtaccaaattgtaagctccatgagagttttctgtattaatcacttgagtgcccctgcatctgcagaaatttctggcacgtggtgttgactctgtaggaagtttttgaagggaaaagtgaattgattacctttatatttctgtatcaaggaatacaatagtatatattcagttgccattaatggagatgagtttttcaaaaattaatatggattctgaatttctttatttttaaaactattttgagtgcttatacaattttataatttggggaagttaatctctagagaagaaaaaatggcccctgtgttgatgatcggcataagccaaacatgactgaaaaacacaataatgttttctccaccgctgttgcttttgtttctgttgttgccatatgcatagctttttctaaagagagattttcagttctagataggttgagattgttttctctaaataccgtttgttctaatactgtttgtgaacatatttatgttgtcttccttattaatacttacagatccttaatttaaaaaggaaacaaaaacctattcttttttttttcctgcattgcattaagaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaacgtaagtttaaacaatggtagtaggcacctgagatgtccggattaaatgcagttagaattagatgttatttattcttgccattttttatattaaatacaatattaagtattaatattttcacattcacatgattactctttttccatattgatgaactaagctgtgtgcattgcagttgccatttatgtttttgtctccccaaaatggcaattatcttacctattagagtaagttaatattagtaaatcatgttgacaatgatcgtgtaataatttctatctttagttagatttaattgtttgtatttgcagcacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 38602 - DNA, 18391 bp, Homo sapiens
ggcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggaggtgaggggcaggggtggggaccagctatgcccagggtccctcaaagtgctggaggggctgtgacttggtggggagtgggtctgtcacagccatcctctgtccagggtggggcaaggcctgggacagtgccaggcaccccaggaccccttccaggcttgtctcctgctccaccgcctcaacaccccccacccctgcccaagctgtttctcctctgcctctctgcttccctgccccaggacttctctcttctcctctgcctctccttggacccctgcccttcctctacctctgacctgtgaacacacagacacatgctcacacactaagtcccaggcacacagaaggcaatgtggaccagcacaaacctccactctcccggctccatcccagcgggcctgtggctggccatgagaactgggggctacctggagggaagcatcctcatcccaggtgagtgggcaccagcccttccctgtatgtgtgttgtgggtggaagcaggcatgagagcatcttagcccataggtttgtattcagggacttccaaacccagacctacaaagagtgtgtcttctaccagatcttgttcaaaaaagggtttgtgatgatggaactacacgatagagggagtgagcaagaacaatgaggattagagtggagcgtgaaatagtctaggagcatggcttccaaaacatatgctgtgaggtctgtccacctgagagttgggccatggatttaattctgagcctcttagcaggcaaagcaaagacagaaagcagatcggctgtggatttctgtctataaaatgtgagttcttggccaggtgcagtggctcacgcctgtaatcccagcactttgggaggccaaggcggatgaatcacgaggtcaagaggttgaaaaccatcctggccaaaatggtgaaaccctgactctactaaaaatacaaaaattagctgggtgtggtggcgtgcgcctgtagtcccagctcctcaggaggctgaggcaggagaattgcttgaacctgggaggccaaggttgcagtgagctgagatcctgccattgcacttcagcctgggcacagagccagactctggctcaaaaaaaaaaaaaaaaaagatgtgagttctgagaaatggcacgattcctaactaaagccaggacaaaatatcccttttttttttgtgagatggagtttcactcttgttgcccaggctggagtgcagtggtgtgatcttggctcactgcaaccttcacctcccagattcaagtgattctcctgcctcagcctcctgagtagctgggattacaggtgtgtgccaccacacgcagctaatttttgtttttgtttttgtttttttttttttgagacggagtctcgttctgttgcccaggctggagtgcagtggcgtgatctcggctcactgcaagctccacctcctgggttcatgccattctcctgcctcagtctcccgagtagctgggactacaggtgcctgccaccacccccagctaattttttgtacttttagtagagatggggtttcaccttgttagccaggatggtttcgatctcctgacctcgtgatccgcccgccttggcctcccaaagtgctgggattacaggcgagccaccgcgcccagcctaatttttgtattttttaagtagagacgggttgtcaccatgttggccaggctggtcttgaactactgacctcagatgatccgcctgcctcggcttcccaaagtgctgggattataggcatgagccaccgcgcccagcccaaaatattcctttaagatgataggccctgtcagtagggtttcttccagtcctccttcatagagacacaggaggtaacaaaaaggtgggctgtttctcacagcaccaagctgggccctgcttcaggaccaggatggcaaaacttatacaacactcactgctatgggccttgccaaatctgggtgtcacagatcatgtgagggagcagaggcaccttctccaagatcacccagtgatgtgtgcattgtctgttcattcattcgttcaccctgatgttcctctgtgcccagcccagagataccaggcagagtgaggctgaaggagcccatggtctggggcaaggtctcacccacaggccttgtaaggctgaaagccttctgcaaggatttcagaggcagtgacagcttccagaggccctgggacttgtggccttgcagctctgagcctccctacccccatccctggcctttatagagcaaacaggctggattagctgcctccagaacgtcctggcagagtctgggccctgggccaggttccaggctggcaggttggagggtggggagcgagctcgagtagggcctctgagttccctgcccccagttcctgccaagactgcctcagtttctctcccattcctttttcctaccatgcagggctccttcctccccgccccaccaccgccagtggcaattctcacacacatactccatcctgcattctttcatcgcagtcctgtgggccggttctcaccttcacatctttgctttcctgctttcctcaccttggaatgccccctaggtcctgtccaccaggaagctctggcctcatttggccacagcctagagtcttgggccttcttgcagttactccctcctaaagtgctctcctgtgttctgtggtctcaggcacttccttttttgtcacaaggcctcagtttcgtcatctgagaaatgggaagggttagacacaaatctctctcgtggtggaaaaagcttgtgctttggagtcatatggagctgaattccatccaatccacttagttccttaacttttatgagcctcaccttcctcatctgttagatggggtcttataaaaacagacagcacacactgcggtgaggcttcactgacgacgtggatggtgctggcattcattgccctccccagcaaaggcccctccagctgtgctgggctctgactcctgcttccctggctggccgcttatttaatggtaggccttggcattgtcgccttctcttccgggagcccagcccgggccaagtgagagagtgaagggggagatggggtgtagtggagcctggggcttgagctgcccttgtccacagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggtgagtgtcctctcccagagctgacagagcggggtgggtcagggaggcgggtgatgagccccggggtcccagtatcccacacggttccctgagctgaggggctggggacctgcaggccgtgtggtacacccggggcaggggccatgtaggctctgtccttggggggctggcttcgtgggacggcatcgggatcttctttgactctccggcagaggatactcaggtgcgtagtggtctcctgcctgccagcccgcctgcccgctcacaccctccccctcccgccatgtccgcggctcaggctgcttctcacctccctgcaggacagtcctgccatccgtgtgctggccagcgacgggcacatcccctctgagcagcctgggtaagggcctgtctggactgaccactcacctccatttttgcactgggaggggcccatcccccccatccgagcccctgccccagcctcctccagcagggggcccaccctgccgggccgccatacttgctggactctctcacttagccgacgtccgcccccctggggcttgattccttcgacccagcagccccaggtgaaatgacacaggctggggcctgtgatgagtatctttgctcccatgatctcatcccatctccaacaccctccataagtggggggttattcgtcccatttacaggtcaggacattgagcccagagaggggaagggatgtgccgtgcgcagtgctgaactttgagcccagacttacccctggagggtcctcgcccttccctgcatagctgtcccttccctttcccctgatgatttggcttctgtccctccccggccctactgcctcctcagtagctgggccggtttgtcagtgtctctcagcaaccttctctcggctcataacaattagagtaattgcctgcatttatggagtgagctgattgtatgccaggcacagcaccaagcccttctcatttactgtcttagttaaccctcataacattgttatgaggtcgttccaattaccatcctcgttttagagatgggaacactggggtttggagagatgagatggcttgcccaaggtcacatagctcggggcacaaacccaggtggctgctgtggtgctggcttctcccctgccctgtgctgcctccctcttggcggaaggcggcactgtcagacgctctgctgtgagtagcctgaggtgtccagagacactcagcgtttaacactcttctcctgactccccagagcctgccgagccgacctgtcagggaggcagcctggtcacattgtccttggctgccgggacatgtccaggtcatccgtcctgagtcagctgcattctgagccctggcagctgggagaggaaaaggaagccagaggcacagaggacttggagtttaaaagaaggaggagggagaggccaggcacagtggctcacgcctgtaatcccagcattttgggaggctgaggcgggctaatcacctgaggtcaggagtttgagaccagcctggccaacatggtgaaaccctgtctctactaaaaattaaaaaaattagccgggtgtggtggcgagcacctgtaatcccagctactcgggaggctgaggcaggagaaccgcttgaacccaggaggcaaaggttgcagtgagccgagatcgcgccactgcactccagccagggcaacagagcaagactccgtctcagaaaaaaaaaaaaaaagagagagagaagaaggagggacgtaagggtgataggacgagggtgataggtgggtcgggggaatggagggcagaaactgtattgttggtccaggcctttgtccccttaaggaagggccacagggaggcccctggccccttctgtaaatccaagtcccaacactccgtcaggcagggcttgcttcccctgctcctctctcttctgccaagggagcagggtacaacaagggagactcaagctagacaaggtacatgtcccatgccagctcgcccagcggaaagggaggtggcacagcaaatctgggcagagtggcttctgggactgccctcactgtccaggccttgagtcctgtatatcctggctggattccaactgcccacaagagtcaggcatggtggctcacacctgtaatcccagcactttggcagccaagacaggtggatcacttgaggtcaggagtttgagaccagcctgaccaacaatgtgaaaccccatctctgctaaaaatacaaaaattagccgggcatggtggtgcatgcctgtagtctcagctacttgggaggctgaggtgggaggatcacttgagcccagcaggcagaagttgcaatgagccacaactgcaccactgcactccagcctgggcagcgactctttctcaaaaacaaacaaatgaacaaactgcccacagggatggagctagccaagggctgggctcctgtcattgggacttccggaaccggccacaccccttcagagcacggatcacctactgggggcagaggctgcgcgtgagtcacccttcctgcttctgacagggctctgagttacagagctgctatgtgtgcgtgcccacggccccaacacaccagtgcctgtgacaccacgtgaggtccctggcacacacgggccaacatccacaggggatcctccatccctacacagaatcctaacactcacccagagcacatacatgtaagggctcacatgagaccaggagtgcgggtcacctccatgccattctgataccaagccctagggccacctgccatcccacggccaggggagccagggagtcagaggtagggacacccccccactgctcactctctccatgtccctcagatgtccttgaacagtggcctcactcccagtgatccaggtgagttctgtgtggatgtggggcccctgcttttggtccctggaggtttctttggggtctcagcagccaccggcaccctggcaggtgaggatcccactggacaggtaagagcagaagggcagtgatgaataaatcaccctcagcacaccttctaaagagcactggggtggcgtcagccacttcaccacatgacctgggcttctgtgacccttgggagaagtcatgtctgccttgagacttgcaagtctcaaatgggataaaacaagagaagctttgatttcagtgctggccacataagtgcccctagctgtgagttgcgggacaagtggaagacagacagcaaagaggggcatttaggaaaatggagcaaagaaatgtgacaccatggagagtccacggagggtcccacagcgggaaagctgagggcaaccagagcgtgggagtccttgaatgccaggaccttggtctggtttctgaggaggagagtgacatggtcagagctatgctggaaaggtggccactgtgcagttgctactaccagtagcagctgtgctctgggggcctaagagtgtcagatggtctgctgccatggctctagcccaggatgttttgggatcgtccagttctgccacaggggcctgcctctgactgagtgtgaggttcaaccctcaccacccacccgtctacctgtcaaccctcacacctttcctaggaagtaagcaagacaagcatcagacggtggcccaaagtcacccctcttgcctcggtgggatatcatggcggttagggtgaaggctgagcgagggggttgctgggtggaggggtcttacttctccttcatctgtccccttccagatgatcatgatgtcctgtccttcctgaccttcagcctgagtgagcccagcccagaggtgatgccagccctggcctacctgggaatggcagcccagggaccctgccctcacccatgtcatggtgccctcagacctgccattccagcccttacctccacctggcctctgagctctgctcaggccagaccttgtgcagggcagtgctgcgggccagggccggtgtgtgaggtctcgcaggctggctggctcaggctgtgacattacagttcagagcgatcagtgccaggtctcaaaaggtgcagggggctgtgggagcacagaggaggagtcccaaccagccagggggtcaaggaaggctgcctggaggagatgagcttaaaggagcctcggaccagcacatataggcttgaggccacagcagggagggaagatggtggggatctgcgtgaaggcagaactcagagggctggaaactgcagggccagctggccagggaggaaggctgggctcgtggggaagcctgtgggaaggctccccttgcttctggatctcccatgggtttggggcccgactttctgtcttcctcccctaggttccccctcagcccttcctggagatgcagcagctccgcctggcgaggcagctggaagggctgtgggcaaggctgggcttgggcaccagggaggatgtaactccaaaatcagactctgaagctcaaggagaaggtagggaccgagagagcgggcaggtggcgcccatctgagtgtcacagcatcctccacccttatgaccaggggtcctttaatcagtagggaaactgaggcctgaggaggccacatctaagcaggccctgggcccaagtgttctgtgctatccccaccttaccactcagactcatcttccaggagagggtcttggaggcagcagccacaccttctggcacccctctccaagaagccaccccaaagataagataggctgtgttaccccaccatggctggctgcccatcccagctctgccctaatccccaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggtgagaagccctacaggcatccaaggctccacctgcgggcctgaaagaggagcaagcactgtagtcagcaactagtctcccctaaggcctggagggaaaggaaggcagggatgaaatgctgcaggtcacaggatggggcagggcagcatgcaggatggcatctctgcacaagcaaatgcgcacggggctggggctgaggctggggctggggagaggagatgccagctatttggactcagctctgtagatgaatgacagaaatagactaggtgctaatttgcatgtagcttcacatgcgatttgcatagggcttgcttaatgctcagttgcaccagaagcctcattgcatctccattgccatctggctcctcccccagggagtcataactcgggtcatgcccagcctgggggcctgagagctaaactcagccaaggtgttagatactgggcagaggaggccagcagctcttgtgggctttgctgggctctgacagctcgaggttttaatcttgtgtcagagcagcttaggctgggctgctagtgtggggaagaggggaggggacttacactccagggccaagcctctctgatcctatccccaggccctggatgcttcctgccagattccatccaccccagggaggggtggccacctctccatgtcactcaataaggtagggacccaaacactgggtgttgaccagcactggccccagcttggctggtgctctgggagaaccagggcagagaggactgggctgggcctctgcttccttcaggggacagaaccacttttagaagggagacgtattttggcttggcatggtggctcacgcgtgtaatcctagcactttgggaggccaaggcggacagatcacgaggtcaaaagactgacaccatcgggcagatcacaaggtcaaaagatcgagaccatcctggccaacatggtgaaaccctgtctctactgaaaatacaaaaattatacaaaaattagctgggcgtggtggcatgcatctgtagtcccagctacttgggaggctgaggcagaagaatcgcttgaacccaggaggcagaggtagcagtgagctgagattgtgccactgcactccagcctggccgcagagcaagactccatctcaaataaataaataagaagggagaagtattttgagaaaaccctgaagtggccactgttgggaggaaacaaccacccctggggagaggggcgtgagtggagggggaatgtggatgcccttatggatgaggtcagagaaacacagtgtgtccaaataaggaggccctggtaatctgggaaggcctctggaaggaagaggctgcagtgccgctgggaaggtgggctctgagaagagaggggctatgtcctgggccctagacaagaggctgcccctctgcaggactctgccaaggtcggtgccctgctccatggacagtggactctgctccaggccctgcaagagatgaggtaagggactgggtggggacccctccaccaccttgtttctccgccttaagttcctccattagcccttcattccttccatcatttcctgagcgcccagcacacagcctgtcaattggaagggctactggtggagttaggtttgttgagttgacttgaatttaattgaatcaagtttaatgttttgcaagtcctagttaaaaagcaattctctcctggagaagcccatcatgaaggccccctcagacactcccaccctcaggaggcttaagaaatctgagcattccttcaatggcagctcctaggatgaggggcattttgttgggggctcttggagagggagcacagccaagatcagaccagttggatgagacagtccctgacttggttttgtgcccccattaacttcccggtatcccactctaggccaggcctctggagccctgggggttgggggagtcctggggatgctgtggaggaggcatgcatcccaggctgaagcctaaagccccacctgtacacacacagctagatgcctagggttgggggtggagaggcacctagatgagaagaaggaaaggagttaaatccccaggggctgggaatggaaggcagagccggggagcctggggttgacacagatagctttagggagatctttatctgagctaaagtctcaggatctaggaagaaggttggaggtgaaaagaccagcccccaagaaggggccccatggatggtacctgttccccatccatgtgctgcccttggggagatgggaaatgattaggccatctgggtggaagcagaagaggtaatgagtcatcttacttggttaccacccccggttagggatgcagctgtccgcatggctgcagaagcccaggtctcctacctgcctgtgggcattgagcatcatttcttagagctggaccacatcctgggcctcctgcaggaggagcttcggggcccggcggtgaggggaaagtagtgggcagcatggggtccccaaccttgacgtctgggctcagccacccttcttccagcacttcagcagccccaagccctcctgcctttgccctcccctcccaggactgctggcaagcacatctgtgcctgcgtcagtgtctgtgtgtccgtgcatacgtgccaccacacatctcatcttttctctgtcctctctcctctctgaagagtcccacagactcagcagcagcagggccctggacacccctcgatccaatatccaatgaccagaggggaaacagggtgggctgtgtccaagatcactgagtccagtggtagtcagcgcttccccatgccctgtcccatcctcgttccctcgccctcaccctgctcaccctgtctttggctctttacttctctcttctcttctcttgaaccctgggccccttgatgatcccaggccccaggccttcccagctgttcccacagatgcagccatgggagctggggtgggggaggcagctttgtacactgccccctctccaagttccctggatgagagccaggacgccccaagcctggggaaaggaaacggagcatgcacatggcctagattccaggtcccccactccttctgggtaagaagctaagctaggaccttagactttcccctttcagaaggcagcagccaaggccccccgcccacctggccagcccccaagggcctcctcgtgcctgcagcctggcatcttcctgttctacctcctcattcagactgtaggcttcttcggctacgtgcacttcaggtgggccaccccgtgagcaggatttcccacagcactggcatctcttggttctcagctataaccattggatttaggagaggggacacttcagctcagaggggacctgccgagtccccaaatcacaaagagcacagtgcgggatagggcccattctctcaccaagcactactgaccacctgctcggcccccagccccatctgggtcctgctctcacggagctcactcacacaggtctaactgaccctgtgtcgtcaatgccatgatgtcaggaagctgaggggctacgagagtgcaggagaacacacttgaccccccttggttagggaatcaacctggaagggacatttgatatggtcattaaggtgactaggagttttccaccctgacaagataggtaaaggcatagaggcagagggaacagcatgagaaaaggcagggaggcatgagaaaaacataatattttagagaaaaagtggcaagttcagtaatgttggagcaaagggcaggacgagtttgtgaaattgggcaaagagatctgaaaaagtgagaggaggtcactagttttgcttggtgtgtgtttgctgaatgaacgtgcaccgtttagagatgtggggtgtgctaaaggcctcagcaatgagactgacaatctttgttggtggaatttcaagacaagaagagtccgtgtgggctgggatggtcctggaggaggagtaaaatgagctaagctttaaaaagcacaaggtagaaatgctcacaggcttcagcacatgcacaggagtgcagtggtggcaatcagcctggagccactaggacagaccttacatgcccagggggaaagcgtggaccatatgcagcgggccaaaggagccacagaaagtccaagaacagcggaggttgtggtgcagtgagtgtagcaaggcaagcatgagagtcctggtttttcaaaagcccataaaggagagacgcaagtaacctgtaaccttctctctggcagcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctccccatgctgtgatatgctggtcttctttccagcctcaccctaatctctgtgaaggcttccaccccttctgagtacctggctgggagtgcgctccaagcaggcaaggaggccaaggcctggcttaacctccaaaagaccggataccccacgggctttgaaccctcgactatggagggaaagagagccatgactgtatataattctgtcctcaaactcacccataacagagagcagtgtctcccagtgtccctcctggcccagctcagccagcatcactgagcagctctctccctccccactcctagctgctccaggggcagcaggggaggcgcgtgacagagcaaccctgagaggccaactcgtggaaccataactgggattcccgctcgcgccctcaggtctccctcccttttccagcgtcaagctctctgggcagctgctgggttcagtgacttgggtgggtggggagaatggggggcacccaaggctgggtttttaccccttgctgctacctggatctcccagctgaaatcctagttattagtggcccaggagaggagaaagttggaagaggctatggaacagggttccgggagtgtatgagctcaacccctctcccgggagagcgaccccaccaccgcaggccctaatcctctgtcagcagtgcccagcggagctcggcgttgaaggaggcacgtgggggaggcgggagtggggagcgggcacgtggtccagccttctcagccccgtgctgccccccgcccccagtgaggaggggtttggggaggtgggggcgggcccgggcgggggcgggcggcgggcggtgccaagcgtggggcgcgggcccgcggcgggagctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagtgagtgggatcccttcctggctccaacgacctcccctccccacccccacagctgctcagtccatccccgggccagcctcaggtcccaatcccttctcccctactttcctagacacggtaagagaccgggaggtgtcctctacactgcccccagacccatcctatctgacacccaaaaccccgctccagcatcatgctccggccaagggggagtggggggaggggcgaccggacgagggaccgaccggagcctgggacgaggaagggggtgcacgtgcgtttctgacgaaacgataatcccttaatccgatctggtcccagccgcctatgtcttccaactggggctcctctgaacttgaggctctgaaaaaagtggtgcagccgctcagagtcgcggagacagaccctgagatgggggcactcacaaacattgagcacttgtgtgcccgcagtgctgggacagagtttggggctggactctgctgctaggctacttgggttcagagcctggctttgcctattagctggataactttaggcaagttacttaacctttctgtgcctctgtttccttttctggaaagtggggatggtaatcataatacatgccttgtatatttatgaagattaaatgccaatgcatgtaaactgtttagcacagcacctggcacatgataaagtctcataaatgatagctattatttcgctcaatcctgataacagttttgtgagttgcaaaattttatccccattttacagaagaggaaggtaagtgacttacctaaggatatacctaaaatggtagtggagctgggatgtgaacccaagtttggcctgaatacttttccccacatgacatagcttgtcagtgagggaacagcagaccaagttggaggccatgagggacaaataattaggatctgcagagagagccagacagactgccaccctggttccctagttccatccagtggcagagacgacaaagggcactgtgatgggcagaggcagcagaaacctggatgtccgggttggagcgcttttgctacacacagggaccaatgcagcagctgctaggactcagagaccccttctgtccctccctcgaagacctcaacccccttctctcagccctcgtggtgactctgcctccggtgaccctgcaggatggagcgggatgcacagttcacacagaggaaggcagagcgggccacactgcggagccacttccgagacaaataccggctacccaaggtaagctggccccggctgtgaggcacatctgggaccctgagctctgggttctggactccttcgccccattctgggcaccacagccctcagctatgagactcacagggtatttggttagatccttccttctcattcatttgttcttttattcattcactcactcgtagttaaatctgtgcccaccaagggccagggctttgtgctgaggggaccccagtcctcatgagactgacaggtctgtatttctggagccaatctaggcctcttctctcctccaccccccatatccccaccaagcctgggccaggcctgggcagaggaagacacaggggaggcagaaatcagtagatttgactgcagaggtgagtgttctgggggtttctgaacctactgaagggcagaacttacttaaggtgggggagagaagccctgtgtgtgccaagtacttgaccttcatgtcctcatctaacccccaataatgctgccaggcagctatcacccacagcgacaaaagatgaaactgaggctaagagaaatggagggacttggctaagatcatacagccagtgagccatggagctgggaccagccctcaagccggtgaatatgagcctgcctttgctccagggccccaggctgctttccagagtatggagtctgcccgtagagagccaagtacccccttggccggccaagcagccagagagtatatctcaggagatccctgcccccacgctcccctgggcagtgcaccaccagatgggcgtgtaagtgtgctgctcctgttgtctaaggaggggaatgaagcacaaatctctcccagaatatcaccctagtgcatccagaactgtgctggactcaggggaaaacagcacagggctatagcgctcctgattttgatcttccacttgaattgaatgaccaaatatatgaacatcacattcactcattcaacaaatatttactgagtccccagctgcttctgactccccacagggcaccaatcttttggaaatctgtcacggggaaaaaccggtccagaaagcctgcctcactgcaaactcttctaggaataaaatcattcctcagatgcttgcgctaggcatataagagacacctgccatcagcaaagtcagagttgagcagaagagccaagacttggatgcaactgagtaggacataaggcgccccccagaagaatagtgaagggcaatggtcatcgtaggtgccatgcaaaaaaacacagatgttggaatcagtgacataggtttgaatctagctccccaacatcctgcctgtgtgatcttggataatttaagttacttaagttacttaagttagttaagtaacttaaatttaaagtaagttacttaaatcctgtaagcctcaatttccttatttgtgaagtggaaataacaatacctacctacctcacagggttattgtgagaattaaaagcacccagctcaacgtctgccatgtaatagatataatagatgtttgataaatggtacccatcactatttttggttacacccttaagcataacaagagtcaaaacatgacttagctgactgtaacagtgtgactcataggtattttcattttgtctttactcactgtgctggtccttcagcatctcagagtgaaataaggtaatataaaaaggtctccatgtccaggcatcaaacgcttgatcctgggatgtgggggtgggagctgagctcactggaacatggggctcaagaatctaaggggccgggcacagtggctcattcctgtattcccccggcactttgggaggccaaggtgggcatatcacttgagcccaggagtttgagaccagcgtgggcaacatagggagacctcgtctctacaaaaaaaaaaaaaaagaaaaaatagaatctaggggcctggaacccagtccaagcctcctccctgtcctctcaactctgggtcctcacagacttccactccaccccaccccctcttcccctcttcccttcagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtg

SEQ ID NO: 38603 - DNA, 13222 bp, Homo sapiens
actgatcccgcctggggccggctgagtggcacttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgggtaggagaataacgtatgtagaggcgcgtaatgccaggcactgtgtgccaaacgttttatgatgcttttagaactctcgtaacattcaggtgctgagggagtttgggggtagcggtgagctggtaaaaagcctgttggcaacgaagactgatactttgaaaatgctcgtttttatttttcccgtcttttagaatcctctttgccaagagtaaacattcgtctcccctctccctcacgcccctgcgatgtattgttttgatgcggatgtatgaacagttaatgtcaggggacgtactttaaaaaaaagtctaattgcaagttagatgtggttaaatgccctcaaaaaccacacatactggtagtttgaactttgttttatagaattaaatgcagccgggatcacaacactaaaaacctactatttgacacagtttgatccaatcttttttgaaaagtatagagattaacattatgctaatttttaaatacttgatttctagaccaggatgtaatcaataaaaacggatattaatatttagcaccaattatttaattatgctagttattttacattgactgcaagccacgtaaaacagttaggccgggcgcgctggctcacgcctgtaatcccagcactttgggaggccgaggcggacggatcaaaaggtcaggagtttgagaccagcctggccaatatggtgaagcccgtctctactaaaaatagaaaaattagccgggcgtggtagcaggctcctgtagtcccagccacttgggaggcagatgcaggagaatcgtttgaaccctggaggcggaggttgcagtgagctgagatcgggtccctaaactctagcctgggtgacagagcgagactccgtctcaaaaaaaagaaaacaccaaaaaaaaagaaaaacaatttgttattttttggaattaggtatgtacaaagtacttagaacagctggcatctaacaaagactaggtaagtactaaccaccattattgtgatgatgataatgatgaattttaaaaatgccatcccagagaaaaactagtcctttttttatgttgcccttatgcccttattgaaatactgaattttttttttttttttttttttttttttttttttttttttagatggagtctagttctgtcgcccaggctggagcccagtggtgtgatctcagctcactgcaatctccacctcctggcttcaagcgattcttctgcttcagcctcccgagtaggtgggactacaggcacccaccaccatgcccggctaatttttgtatttctagtagagacagggtttccccatattggccaggctggtctcgaactcctgaccttgtgatccatctgccttggcctcccaaagtgctaggattacaggtgtgagccactgcgcctggtcagttttgtcttttttaaagatatgtttttgaatttagaatttaaaaaccctgactaaaatatatttacccattttgatcatatagctttgttactttatggaggaaaagtggacaaattaaaaaaaaaattttctttttttttttttgactcagggtctcattctgtcgcccaggctggagtgcagtggtgcagtctcggctcactgtaacctccgtctcccaggctcaagctattctcgtgcctcagccttccaaatagctgggattacaggtgtgtgccactgcacctggctaatttttgtagttttagtagaaatggggtttcaccatgttggccaagctggtctcgaattcctgacctcaggtaacccacccacctcagcctcccaaagttctgggattacaggcgtgagctatcacgcccggcctattaatacaaatggtcttaatttaaatgttatgatttttcaaacttacccactgtctcttaaactagtgacataatagccatgatttcattactgctgtctgctttgaatattttgaacaagaagccaggttgttattccatttttttctttctttctttaaaattttttgtaagatattataccatattccgtttcttaaggttggtacagaagtaattaggaaaatgaaatcactactttcagtgcttgggatgggacagagaggtgggcgcttctggaggcactagtatagccaggcctgtatccaaatttacaaggggcccggcacagtggcctgtaatcccagcactttggaaggctgagttgggcagaacacttgaggtcagaagttcgagaccagcctggccaacgtggtaaaaccccatctctactaaaaatgcaaaaattagccaggcgtggtggcacacgcctgtaatcccagctactcaggaggctgaggcaggaggattgcttgaacccaggaggcagaggcagcagtgaatggagattgcgccactgcactccatcctggacagcaaagtgagactatcgcaaagaaaaaaaaaaaaactgagttcaagaccagcccggccaccatggtgaaaaccagttcgttacttaaaaaatacaaaaattaactaggcatggtggtgcatggctataatcccaactactcgggaggctgaggcaggagaatcgtttgaacctgggaggcggtggttgtagtgagctgagatcaacccactgcactctagcctgtgtgacaaagcaagacaccgtctccaaaaaatacaaacaaacaacaacaacaaaaaaaccccacaaatttacggcaagaaactttacagatcttttgcattaaaaggttgatctctatcaaggggaaataggcaaaatgctgatgtgagtgtattccattctctgccctcttctccctccctgtcaaacaagagaatcatttgagtatatgctcctcttgctttttcttaagagcgggagcaggggacaggcaatgctgtggtgtcaggtggacctagatttaagtccccattattctacctagtctctatgtgactttggaaaaattaaaagtcagggaatcttggtggcaaaataaactggaatgtgattcttggtgagtgtcttcactgtcattctacaaggacagaccagactagatatttaatacatagtgagaatcttttcactgtgtcagaggcatatctggttttccatatgcatatgcctctgacacaatgaaaatttagcagtgaagtgtaaattgcccattgctagtctgacatggcagcccagaactccagtgcacagcatctaataatcctgaactcattggctataatgcaccattgtcatctacagacaataacgggttttttgtttttaaactgtagctgtgtcagcgtgttatgatgccgtcccgtaccaacctggctactggaatccccagtagtaaagtgaaatattcaaggctctccagcacagacgatggctacattgaccttcaggtaaatgcagaagagaactgacaagactgactggctgtgtttctgttaagttagcaggaagaccttccagatggagattttgctaactgtccttggggattagaaggagcaacaagaagaaaactcagctctgagaccctttcagccataatcgcagaagagggccgtggcagggtagtttcaaaccaattccagtattgtccatttctaagaatttttagttgtaatgcgagagccttgtagttacaggttttatttactttattcagaaactaatcagattgtgttttgttaagtggagttttttgttgttgtttctttttttaaggaactttaaaatttttgttaggtggaattttttttatcactgtttatttacactttagtcaaagcccgttcaccttttaagggagaaacttattactaaagccagcagattgtgggaatcttccttctttcctgatgtcatgagatccaatttattaaaggtattctttgtgataaatagtaagtaaaacacagtatttattaagtttgtatcctaccctaaccatttataaactagtcaatactacagcatctccttttgcacacttccccttacaatagaatgttctacgtggaactagggccaacgaggaagtagcaggaaaccatcctttataaataaataaattactctttggacccacatttgaaggagagataaaaatagatctggaaagatctgggaagcttccagccacttaggtcagatacaacgatgagccaaaccttggaaaatttgtctctgaatcttaaccttgaattgaatttgttcataaggcaggtttacttgctatgtggaacaaacaactaatcatttggaataagctgaaattgccttcttttccttttttttttttttttttggagacggagttttagtcttgtttcccaggctggagtgcagtggcacaacctcggctcactgcaacctctgcctcccaggttcaagcgattctcctgcctcagcctcccaagtagctgggattacgggcatgcgccaccacgcccagctaattttgtatttttagtagagacagtgtttctccatgttggtcaggctggtcttgaactcctgacctcaggtgatcatcctgcctcggcctcgcaaagtgctgggattataggcgtgagccaccttgcccagcctcttgttttgttttgttttgtttttaagatgtagtcttgctctgttgcccaggctggactgcagtggtgcaatcctggctcactgcaacctccccctcctggttcaagtgattcttgtacctcagcctccctagtagctgggggattacaggcatgcaccaccatgcctggccaattttcgtatttttagtatagatggggtttcgccatgttggccaggctggtctcgaactcttaacctccagtgattcacccacttcggcctcccaaagcgctggaattacaggcgtgagtcaccgcgcccagccttttttttttttttttgagacagggtcttgctcttttgcccaggcttgggtacagtggcacaatcaagactcactgtaaccttgaccttctgggctcaagtagtcttttcacctcagcctcctgaatagctgggaccacaagcatgtgccaccacacccagctaattttaaaattttttgtagagacaggatctcttaaatccccataagttagtacagccatctatgtgccaggcagttaataaatatatatctaacaaatgaatgactgtaaagtcatttctgtttttgttttaaagaaaagtttcttatgatacaatgaatgatttatggaatgagattcgaactagagtgaatgacattcctctgagattcctttgagtaactgtgagagcaataactagagcttcatctcttgccagtcccttttatttctcagagctgcactgggtggtaggacatacttaagacacataaagtatctagtttggttcttaattaccctcctgtttttgctgttgttgtatttgaaacaggctctggctctgtcacccaggctggagtgcagtggtgcaatctcagctcgctgcctcttcacctcctgggctcaagccatcctcccagcttagcgtcccaagtagccgggactgcaggcacatgccaccacgcccggctaatttttgtattttttgtagagacgaggtttcaccatgttgctcaggctggtctcaaactcctgaactcaagtgatccgcctgcctcagcctcccacattgctgggattacaggtgcgagctctcctccctgttttaaagtgtttgagactgggcttgatggcttatacctgtaatcccagcactttgggaggcagaggtggaaggactcccttgagcccaggagttggagaccaccctgggcaacatagtgagacctcgtctctacagaaaaatttaaaaattagctgggcatggtgacgtatacttgtagtcccagctacttgagaggatgaggcaagagaattgcttgagcccaggagttcgaggctgcaatgagctgtaattgcaccactgcactccagcctgggtgatagagcaagactccgtctctaaaatcataaaaattaggccgggcgcggtggctcacgcctgtaatgccagcactttgggaggccgaggcgggcggatcacctgaggtcaggagttcaagcccagccaggtcaacaaggtgaaaccctgtctctactaaaaataccaaaaaaattagctgggtgtagtggcgggcacctgtaaccccagctgctcaggaggctgagacaggagaatcacttgaatccaggaggcagaggttgcagtgagccaagatcacgccattgctctctagcctgggcaacaagaacgaaactccatctcaaaacaaacaaacaaaaacataaaaattacaaataattaattaaatgtttgaacccaggtatttgcattaatgttcttcgttgtctttttcatctctatttctcttccagtttaagaaaacccctcctaagatcccttataaggccatcgcacttgccactgtgctgtttttgattggcgcctttctcattattataggctccctcctgctgtcaggctacatcagcaaaggggtaagctgacgggcatgtgggaataagttgtgagatttttaaaatgttagccaaggctctagtgtgcgtgtgtgtgtgtgtgtgtgtgtgtgtgtgtgtgtgtgtgtgtttgtccgtcccagtggtctgttttttttgagacagggtcttgctctgtcatccaagctagagtgcagtggcacaacctttacctccctgggctcaagcgatcctctcacctcagcctcccgagtagctgggactacacgtgtgtgccaccacacccagctaattttattttttatttacttatttttgtttgttttattttgtgtagagacagggtttcactatgttgcccaggctgatctctaactcctgaggtcaagcagtctgcctgcctcagccttccaaagtgctgggattgcaggtgtgaaccattgcccctggccaattttttttccaatttttatgggtacatagtaggtgtatatacttaggggatacatgaggtattttgatacagccatgcattcataataatcacatcaggctaaatggggtatccatcccctcaagcattcatcatttgtattacattccaattatacttttatttatttatttattttgagacagagtcaggctggagtgcagtggcataatatcggctaactgcaacctccgcctcccaggttcatgctattcttgtgcctcagcctcccgagtagctggaattacagacgtgcgccaccgcacccggctaatgttggtatttttagtagagatggggtttcgccatgttgcccaggctggcctcccaaagtgttgggattacaggcatgaaccactgtgcctggcctatttttagttatatatatacatatacacatacatacatacatacatatatatatattttggagacagagtcttgttctgtcacccaggctggagtgcagtggcaggatctcagctcactgcaaactccggctcgtgggttcaagtgattctcctgcctcagcctcctgagttagctgggactatggtggcaagccagcacacttggcttatttttgtatttttagtagagatgggtttttgccatgttggccaggctggtcatgaactcctgacctcaagcggcctgcccgcgtgggcctcctaaagtgctgggattacaggcgtgagctaccacgtccagccttagttattatatttttaaatgtacaataaattattctctagtcactttgtgctatcaaatactagagcttattcattctatgtaactatattttgtacccgttaaccttccccattcccccctacctttcccagcctttggtaaccatcattctacaatatccatgagttcaattgttttaatttttagttcccgcaaatgagtgagaacatggaaagtgtgtctttctgtgcctggcttaatttcacttaacataacgttctccagtttcatccatgttgttgcaagtgacaggatctcattctttttagtggctgaatagtactccattgcatatatgtaccatattttctttattcacttgtctgttgaagaacactttggttgcttccagatcttggctgttgtgaatagtgctgtcataaatatggaagtgcagatacctctttgataaactgatttcctttcttttgggtatatacctagctgtgattgctggatcatatggtagttctatttcatactgttctccatagtggctatactaatttacattcccatcaacattgtacgagggttcccttttctccacgtcctcgctagcattcgttattgccgttttttttggataaaagccattttggctgggtgcagtggctcacgcctgtagtcccagcacttttggaggccgaggcaggaggatcacttgagcccaggagttcgagaccagcctgcgcaacatagcgagaccttgtgtctatattttttaaaaagccattttaactaggatgagatgatatctcattgtagtcttgatttgcatttctttgatcaatgatgttaagcaccttttcatatacctatttgccatttgtatgtcttcttttgagaaatgcccatttttgattggattattagattttttttcctacagagtttgagctccttatatattctggttattaattccttgtcagatggatactttgcatatattttttcccattctgtgggttgtctcttcctttgctgtacagaagctttttaaccggatgtgatctcatttatctgtttttgttttggttgcttgtgcttttgggggcattactcaagaaatctttgcccagtccagcatcctggagagtttcccccatgttttcttatagtagtttcatagttttaggtcttacatttaagtgtttaatccattctcatttgatttttgtatatgtcaagagatttgaggggtctagtttcattcttcagcatatggatatccagttttcctaataccatttattgaaaagactggttctttccccagtgtatgtttttttgttttttggtttttttgtttgtttttttttttttgagacagaatctcactgtgtcatccaggctggagtgcagtggcaccatctcggctcactgcaacctcagcctcccaaataactgggaccacaggcatgtgccaccacacttggttaatttttttttcattttttgtatagatgaggttttgccgtgttgcccaggctgatctcgaactcctagactcaagcagtccaggagtacagtggtgtgatcacagctctctgcaacctcaatcttcagggctcagtcgatcctcccacctcagcttcccaagtagctggagttacaggtgtgagtcaccatacctagctaatttttttgtttgtttggtagagatgagatctcattatgttgcccaggctggtcttaaactcctaggctcaagcaatcctcctgcctcagcctcccaaagtgctggaattacaggctttagccactgcacccctctgactatgtttcccgttgtgtgttaattatggtcagtgtgaggcccaccctagcctcccaaagtactgggattacaggcgtgagccaccacacccggtggatgtagaattttatcaaatgcttttctagcatcgattgaaataatcatatggtttttgtccttcattctgctgatacgattttatcacattgattggtttgtataagttgaaccatccttgcctctctgggataaatcccacttggtcctgatgaatgatctttttaatgtattgttgaattcagtttgctagtattatcctccttattgaggatttttgcatcaatgttcatcagggatattggcctatttttgttttttcgatgtgtctttgcctagttttggtatcagggtaaaactggcctagtagaatcagtttggaagtattctctccatgtctgttcagaatagtttcagtaggattagtattctttttttttttttttttttttgagacagggtctcatctgtcatgcaggtgtagtgcagtggtgcgatctcagctcactgcaacctttgcctccccggcttatgtgatcctgccacctcagcctcactagcaactgggaccacaggcatataccaccatgcccatctaatttttgtattttttgtcaagacaggattttaccatgttgaccaggctggtcttgaaatcctgagctcaagcgatctgcctgccttggcctcccaaagtgctgggattacaggagtgaaccaccatgcccagccaagtattaattctttaactggtataattcagcagcgaaaccatctagtcccaggcttctctctgctaagagactttttattatggccttaatctcattactctttgtctattcaggttttagatttttttcattgttcaatctttgtttttatattcatgtctggtacagcagattccagcagaaaaaccaaaaagattttcttttacattttgttctctgttggcaaaacatgtttttcttcctttgagcaacagtaaacttccatagttcctataggggaggtggtggcaggtaggcaaacttggcctctgagatattagacagtttgccctgtcatagtttggaacaacatggctgagcctggcatacaggagtcctgattggtaaagggctgtagctggagcagcatgctgtcattgtagctgtgcagtgccatggacatactgtcagtatttggagagaaatagcaattctgttatatgtgtggggtcactgtgcctcgtaagtcagttccttcttacagtaggtttggttggagttcctgttgagcttcaatatgaaaccttagaaacctaaagtagttggtggttctttctcatgggctgtccccacatacacagtgtccaagttgtcttgaaccaattctgactataattaacacacaacagggaacacagccagccaggtgcagtggctcaagcctataattctagcattttgggaggctgaggcaggaggattgcttgagccccagagttcgagaccagcctgggcaacatagcgagacctcatctctaccaaacaaacaaatgtacaaaatgagccaggtatggtgactgacacctgtaactccagctacttggaggctgaggtgggaggatcacttgagcctgggaagtcgaggttgcagtgagctgtaatcacaccactgtactccagcccgagcaacagagcaagactcttacctcaaaaaaaaagaaaaaagagaaagaaaagaaaacctgaaaggctgagaaaaacacagagtttattgtagtggtatctgtacaattacaaaaggtgaaaaacaaccaaagtgtccagcagctgtatgtggggcagttaggtaaaactgtagtatgtccatttcggtggaatgttacacatccttacagtttaaatgtatgaaaaggttttaataatattggccacaggacacagagtatggtgtgttcacaactaagagctttaaaaaaaggaaaagaagccaaaatatctggatgagaatgggtcatttttttctttataattgttaatattttgtagtttgtcttcaatttataatcaggaggaaaccttttcccttggtggtatacaactcaaagaaaaagtactgaagagtataaaatactgatctaaggattaggtctgtgacgttttattttaaaatgtgtaactcttacggtactaatgtgtttgcctccttctgccaccagggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttc

SEQ ID NO: 38604 - DNA, 27526 bp, Homo sapiens
tgattaaaaagagattgccctgcaaggtaaatcagttaaaaccaacctctcctgccctgagtggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggagggtgagtgtgggccgggggcggtgcatgagatgatggggcgagctgaggtccacccgggcgacgctctggacctgcgcgaaggccggcggtgcgcgactcgccccttcttggcgtctccccgggcgcgtctccccgacttctctccccgcgcaccgcccgctggtggcccgcgaaagggggccggtgggctgagggccggtggacgggagcccgggggtggttgggccgcgttcaggccgccctcagcccgtggctggtagccaggagggacagtgcggtaagcgctgctgaggcataccctctggtgataagcaatttattattaataacattatatcaaataccgacattgttgtggccgtattaggagccaggaactgtgcatcgtgctttatttacatcattatcccatttaatgctcccacaaaccctgtcagatcggttccgtttagtgtctccatttcacagatgaagatgctcaggccccgcctaagtttgcgcttctgatacgtggcagaagcctgtctctctgacgccaaagcccagtctggagtccacgctgctggaccactgtcttaaggaggccagtcttgctcagctccctgcatgaaaaacagacgagaaacacgggagactcccggtaacccccaacttgccggtagggaaggcagccactctagaggcatggcgagggtggagagtggaggccttactttcatgctccttcaccccactcctcatagtcctgttaaagtccagaccctcggtctcgcttgtcatttagaccttaacaggaataggcaggtctttcttttccctggggtgtcctggatggaggcaggacagcagagagttgtggagaagggtgagtcatagtaacacaattaccatgaatgaaagcgctcactgtgtaccagatgctgtgctcagtgctttacgagcatcatcttttggaatctttactgttttgtttttgtttttttaagggatgagggcttgctctgttgcccaggcgggagtgcagtggcccatcatggctccctgcagccttgaactcctgggcttaagtgatcctcccacctgtttcccaaagtgctgggattacagatgtgagccactgctcccggtttatgtaatttttatttttatttttttttgagatggagtctcgctctgttgcccaggctggagtgcagtggcgcgatcttggctcactgcaacctctgactcccgggttcaagcgattctcgtgcctcagcctcctgagtagctgggattacaggtgcctgccaccacactgggctaatttttgtatttttagtagagatgatggtccaccatgttggccacgctggtctggaactcctgacctcaggtgatccacccacctcggcctcccagagtgctgggattacaggcttgagccaccgtgcctggccttagtaatttttaaatgcatatgcagtagatgttatcatgctcattttatagaagtaacttaagactcagagccaataagtcctttgacaaggtcatacagccagaagttgaggagccttgattcaagcccatgtctgcctgacttcagagcccaacctctgcattttcactatacttaactgctagcctcacagaggggatggcatgggttggatatcttctgtttcagcccctccaccgtgctctgtgccctgtgtggctgtcctgtgtggaataaataccagctgtcctaccgtcttgcttccattgtgttggaatgaggggagagtgaggtcagggtattgattctctccgctccctccctgagaagttattgaaggctggctttgcccccggtggaaagcattgaattctagaaagctgccctctgtgttacccttgatgtttcaaggttctgtgactacttctctctccagactcttaaggtctatgagtggtaactggctcctcctctactgttactggccttggaattccttaccattgcttttcatttctctgcacccagcctacacattagtggtcccttcattaaactctcctcaacttgcccaagttaaatgtgctgtttcctggcagaaccctggctgattcagggttcagcttgggtctttggtcatcatggccaggccatgaatggggtgaagacagaagaaacttcaccagctgatttcttctcagagtagctgaaaatctgaggtgttttttttttttttttttctgcagaggatgccactggcagattatgctggcctcaggtgctgaggccctgagagactaagcaacctggaggtagcaatgctatccaggtgtctaggaatggaagcaaactcctggcttcaatacccctatgccactcttccctaggcagtcagctagcaaattcttactgagcactcatcatatgctaaacactgtgctgagcactggggatccagtggtgagttagagcagcaggcctttggggaaggcagccactaaataactacaaattactaagaaaattgcaagactgagaaatgcatcaaggagagtcccagggcgtttttgggaactgtaatgggagacctcccaccctggtctgagggtcagggaatgtgtccttacagaggtgacatttagggtgagatctgaatgaggaggatgaaggatttggcaggaggaagcttcccagcagagaaacagccctcaggaaggctctaaggcaggtggggataggaggagtgtaaatgatcagggactagagggatctgatggccacaggtgagagtgcagacagaggccacattggggcctggtagctctgctacagaatgcagatgcattcacagggtaggggaagccactgaaagagttttagcaggggagtgacatgatcagatatgccttttatctttcagtttcacttgtattgctgtgaaggtcagggtctggaggggggatagcaggctgaccagggagaccagtttaggtggctacagtagttgcccagacaagaattggctgtggcctttgctgagaagtgttagttgggatggggaaagtagatggattgtgaatgtgtttagcaggtgaaatttttttttttctttttgagaaggagtcttgctcttgtcacccaggctggagtgcagtggcaccatcttggctcactgcaacctccacctcctgggttcaaatgattctcctgcctcagcctcccgagtagctgggattacaggcatgcgccaccatgcctggctaatttttttttttttttttgagatggagttttgctcttgttgctcaggctggagcaatggtgcgatcttggctcattgcaacctctgcctcccgggttcaagcgattctcttgtctcagcttcctgagtagctgggattacaggcacccgtcactacaccccggctaatttttggtatttttagtagagatggggtttcgccatgttggccaggctggtctcgaactcctgacctcaggtgatctgcccgccttgacctcccaaagtgctgggattacaggcgtgagccactgcgcctggcctaatttttgtattttttagtagagatggggtttcaccatgttggccaggctggtcttgaattcctgacctcaagtaatctgcctgccttggcctcccaaagtgttaggattacaggtatgaaccagcaagcccagtgtgcaggttaattaatagaacttagttattgtgcctttccatctctttgaattgtaaacaccactcatcataatcatcatcatcaccacagccatttatggagtgtttaacctgtggcagggaccatacacatcttttctcatttaatcttcacagtagcctcataattttctacattttggtggtattgtctccatttgctaaatgagcacacagtattgcctatggaaagtatggattgctgtccctccaacccttgactgtttttggtccctcctcatttgcctttcctgccagaagccattgtgaaaacacctgcagctggtaaagagccttctgagaaaagctggaagggtgtgaaggtgctgacctaggctagggctccctggcagaattggcatggtgccctcacacttgtccttcagacaacttctttgctgccagtgatgcaataattatcactttatgtatagctcaaactgcagtctcttaaaaggcacattaccagtcgggtgcagtggctcacgcctgtaatcccagcacactgggaggccgaggtggctggatcatttgaggccagaagtttgagaccagcctggccaacatggtgaaaccccatctctactaaaaataaaaaaagtagccaggtgtggtggtgcgcatctgtaatcccagctatttgggaggctaaggcaggagaattgcttgaacccaggagatggaggctgcagtgagctgagatcgtgccactgcactccagcccggacaacagagcaagactctgtctcaaagaaaataaaaaataaaagcacattaccaagggagggttcaatgactgtcacatagtatgacatttttattttcgtgtggaataattcagtgtttcttttcttcctaattcctaaatgaaaacgttggtacctgaaggcataagatttttttgttcctaatctgtactgtgtacttaaatatttttacaatgtgcagggggatggaggggacaacactcttgaacttaaaataccagctccatgcaccacttacattcccttttgattttgtgcaggggctatctgagggtcatcagagagaaccagattaaaatttgtgccctgatttttttatcctgaggttcttcgttttggcattcttcatttacttgtggaatctagaatgttgattaggtagcaagagcaaatctctgaagaactgtggtgtttgggagttgggttggaccccaaacctggcatcctttcttttccagactcttagcctctctggcttcatttcctgctttgtcttgtggctgacacagaaaacatgtgtgtttgttttttcttctgatcatacaggcaatacacactcattaaccaaaggctatagaaataaaaggctatagaaataccgccaatgtgatcccgcccctccaccaatttggcaaagctcccttcccaggcacccagccgcttctctggattgtagtcacagaagtgcttgaccttctgctaaagactcactttgctgcccaagccttaaactctgtcctatgtaacctccattgccacctctcccttcttacctgcctttttttttttttttttggatacagagccttgctctgtcacccaggctggagtgcagtggcgtgattctcggctcactgcagcctctgcctcccaggttcaagtgattctcctgcctcagcctcccaagtagctgggattaccggtgcatgccgccacatctggctaatttttgtatttttagtacagacgggatttcaacatgttggccaagctggtctcgaactcctgacctcaagggatccgccctccttggcctcccaaagtactgggattacaggtgtgagccacgcgcccagccccttcttacctgctttctcatcagctttgtgtatcctcagattgctcctatgttccaaatagcaaaatagaaacctcccttagtcttccttgcctgtagcgaatctaccctaccttcctcgccccctttatagctagatttttggaaagaattgtgtatatttatccatgtagttaccattttggtttctctatttctttatgtggatccatatttccatctgttaacatttttcttctgcctgaaggagttccttgaagatttttgtcatgtgggttcgctggtaatgaattcttttatcttttgtatgtctgaagaagtgaagaagtatttatttcacttattattttttttttttttgagatggagtctcgctctgtagcccaggctggagtgcagtggcactatctcaggtcactgcaacctccacctcctgggttcaagcgattctcttgcctcggcctcccgagcagctgggattacgggcgcccgctaccatgccaggctaatttttttttttgtatttttagtagatacagggtttcaccatgttggctaggctgttctggaactcctgacctcaagtcatccacctgcctcggtctccctaagtgctgggagtacaggcgtgagccaccatgcccagccaaaatcatttttttctttttttttgagatggagtcgcactcttgcttgctttgtttccagtgagaaacctgttgttatcctttgttcctctctacatgatgttttgttttttttcctctggctgctttaaagatttttttctttgtcactggttttgagcaatttgattgtgatgtgctttgttgtagttcattgagtttgggttttgttgagcttcttagatctatggatttatagttttcaccaagtttggaaagtttttggctataatttcttcaaatatttttctgttcctccactctcttctcttgccagtactccagttactgtacattagaccacttgaaattgtcctacggcccactgatgctcttaatttctttccattctttttttttttcctgtgtgtttcattttggataggttctttttatttatttatttatttatttatttatttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgacgctcccatctccctcccggacggggcggctggccaggcagaggggctcctcacttcccagtaggggcggccgggcagaggcgcccctgacctcccggacggggcggctggccaggtggggggctgacccccccacctccctcccggacggggtggctgccgggtggagacgctcctcacttcccagacggggtggctgccgggcggaggggctcctcacttctcagacggggtggctgctgggcggaggggctcctcacttctcagacagggcggttgccaggcagagggtctcctcacttctcagacggggtggccgggcagagacgctcctcacttctcagacggggtggccgggcagagacgctcctcacatcccggacggggcgacagggcagaggcgctccccacatctcagacgatgggtggccgggcagagacgctcctcacttcctagatgggatggcggccgggaagaggcgctcctcatttcctagatgggatggcggccgggcagagatgctcctcactttccagactgggcagccaggcagaggggctcctcacatcccagacaatgggcggccaggcagagacgctcctcacttcccagacagggtggcggccgggcagaggctgcaatctcggcactttgggaggccaaggcaggctgctgggaggtggatgttgtagcgagccgagatcacgccactgcactccagcctgggcaccattgagcactgagtgaaggagactcctgcaatcccggcacctcgggaggccgaggctggcggatcactcgcggttaggagctggagaccagcccggccaacacagcgaaaccccgtctccacccaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggctcggcatcagagggagaccgtggaaagaggagggagagggggagggggagagggagagggagagctggacaggttctattgctatcttcaagttgactattttcttccgtattgtctactttaccattattcttatagagtgcaattttcatctcagacattgtagttattataatttacgtctttaaaagtacgatttgggctgggcacggtggctcatgcctgtaatcccagaatttgggaggctgaggcgggcagattacttgaggccaggagtttgagaccagcctggccaacatggcaaaaccccatctctagcaaaaatacaaaataattaggctgggcatggtggctcacgcctgtaatcccagcactttgggaggccaaggtgggtggatcacgaggtcaggagttccagaccagcctggccaacatgatgaaaccccgtctctactaaaaatacaaaaattagctgggcatggtggcacatgcctgtaatcccagctattcaggaggctgaggcaggagaattccttgaaccggaacccaggaggaggtagcagtgagtgagatcgtgccactgcactccagcctgtgctacagagcaagactctgtctcaaaaaaaaccaaaaaaacaaagacaaaataattagctgggtgcagtggctcatgcctgtaatcctagctgcttgggaggctgaggtggtagaatcgcttgaacccgggaggtggttgtgccactgtactccagcctgggtgacagagcgagaccctgtctcaaaaaaaaaaaaaaaaaaaaaaaagaaaagaaaaaggctaggcctggtggctcgctggctcacacctgtaatcccagcactttgggaggctgaggcaggcagatcacttggggccaggagtttgagaccagcctgaccaatatggcgaaaccccatctctactaaaaaaatacaaaaattagctgggtgtggtggtgggtgcctgtaatcccagctactcaggaagctgaggcaggagaattgcttgaacctgggaggtggaggttgcagtgagccgagatggtgccactgcactcagcctgggcaataaagggagactccatctcaaaaaaaaaaaaaaaggaaagaaagccaggcgcggtggctcatgcctgcaatcccagcattttgggatgccgaggcgggaggatcacccgaggtcaggagttcgagaccagcctggccaacatggcgaaacctcatctctactaaaaaatacaaaaattagtcaggtgtggtggcaggcacctataatcccagctacttgggaggctgaggcaggagaattgcttgaacccgggaggtggaggctgcagtgagctgagattgtgccactgcactccaacctggacgatagagcaagactcagtttcaaaaaaaaaaaaaaaaagggtacaatttgatctttttttttttcccgagacagagttttgctcttgttgcccaggctggagtgcaatggcactatctcggctcaccacaacctctgcctcctaagttcaagcgattctcctgcctcagcctcccaaaaagctgggattacaagcatgcgccaccacgccaggctaattttgtatttttagtagagatggggtttctccatgttggtcaggctggtctcgaactcccgacctcaggtgatctacccgcctcagcctcccaaagtgctgagattacaggtgtgagccaccgagcccggccaatttgattgtttttatttttatttagttatttttttgagacagggtctcactctttcgcccaggctggagtgcaatggcttgatcttggctcactgcaacctctgcctcccaggtcgatttgatatttttaatatcttatatcttgatatctactttactttttgaatgcaatacagttacaattattgttttaatatccttgtctgctaattgtgacatgggtgcaagttctgggtcagtgtggcttgattgattattctcattatgtgtcctattttcctgcttccttatatgtctgataattttttactggatgccagacatgaattttactttgttgaatgctggatattttagattccctatacatattctttttttttttttttctgagacggatttctctcttgttgcccaggctggagtgcagtggcatgatctcggctcattgcaacctccacctcctgggttcaagtgattctcctgcctcagcctaccgagtagctaaaattacaggtgcccgccaccatgcatggctaatttttatattttaatagagacagggtttcaccatgttggtcaggctggtctcaaacttctgacctcaggtgatccacccacctcggccttccaaattgctgggattacaggcgtgagccactgcacctggccccgtatatatattcttgagctttgttctggggtacagtgaagttacttgagaacagcttgattctttcaggttttgcttttaagcaagcaagctgttattttctttagggttaatagtgtcccactactgacgcaggtccttttgtatactctactcaataccctgtgaattatgaagtttttcagtctagctggtaagaagaggtaccattccctgctctgtgtgaatgttgggtactgttccttcccatcctttctggtagttctttctctggcactgggtagtttactcacatgcatgtgatgacccgtaccctgctgtatacttgggggggcctctgcagatctctggagtcccctctctagatagctcctctcatctgcagtattctgtcttgcaaactatggcttcttggtctccttggactcttagctccatctcctcaactgggagagtctgctgggctctgcctggatttcccctccctgagccacagtgggaacgccatcaaggcagtaagttggagcagttgtagggttctcttcatttgtcgcctgtttctcggatgtcactatcctctgttgcctcataactgatttcctgaaactgttgttttatatatattatctatttggttgtttcagtaggtaaggtaaatctggttcttgttactccatcttggccagaagcagaattcccagataatgtttttgaatctctgaatgaatccacagagctctatgccctagtgtgaggtagatcagtagggtaactgtagttcataatagcctattgtatattttaaaatagctagaagagaagaatttgaatgattctagcatgaagaaaagacaaatatttaaggtgatggatatcccaaatacattgatctgatctttacaaattgcatgaatatattgattatcacatgtgctttgtgattatcacatgtacatctgttatgcatcagcaacaacaaaaagctctacagggatattctttgaaatcttatacaaatgtgcatacctgaggaagcccccagaccttcccaactttgaagtcagttggtcactgacactccagtgacatgctgttggcacgcagaactcatcacccagcgggtggtttcttaaccacatggtgagctttcgtgagggctgctggcctcactggtttctgctggttggtgcctggcacaaagtctggcagctggtgttgagttgatgagttggagggcaggaggcattgctatggaggtgagtggagttgggtaaatagatgtacgagactacctgggactcttcccttatctgagcattatgctcaagacccaccttctagctccaaagtgggggaaagttctcttcttcctcctgctgctgcctctgcactgccgagcccatctcccagcactcccaagggcagcagcccaagggtggcaggcaggagagcagagtccagctgtcagaggccacctcaggaaggagctgctgtgtggcttgaacagtgttcttcaggcagtgtggctcagcatccccgaggtatcatggcagggagcctacggctcgttctggagtagcagccagaaaactttgctcgcagacttggctttgctgcttactatctgtgtaccatcggacactgtgctgagcctctctgtgccttgcctcgttacctgttcagtggtcttggtaacccttgtcttgcccatctcacaggactgttataatgtgtgcaaagatgctttgttctagtagaatcttgcataaaaccatgatccttttcttggatattatcaaacaaatgaaactcttatcaaaaaatgaaagtgtttatattctattttcctaatgagatatctgaactggaatgtttttggttataatccacatggcaagcagcaagtttagggcagagctgtgtgtttgtctattatttgacattcattattttgtttgcttgtttgtttgtttgttttttgagacggagtcttgctctgtcgcccagactggagtgcagtggcgcagtcttggctcactgcaacctccgcctcctaggttccagcaatcctcttgcctcagcctccctagtagctgggattacaggtgcctgccaccatgcccggctaatttttatatttttaatagagacagggtttcaccatgttggccaggctagtcttgaactcctgacctcaagtgatccacctgacttggggcctcccaaggtgctagaattacaggtgtgaaccaccatgcccggccttctttgacattcattaatttattaatagtacctgcttgtgaccttcttcctaacctgggaaatggtgagtagctctctgatagtttaatgaaaggagacctttttgtctccagaggggaaaatttcgtgttagaggggaactgtaattctttggggttcatttgttttgaagtcaaatatgactctgaatgtgctggcatgttttagttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggtaaggaaaaattatttagtgcttttctccttttcagtacatttattttatgattaataccctatcaactttgaaatggaaaatcatgatcttgatcatattgtaagcgagatagcatttaatggctgcttcagtgaaaatcaactttgccctctgtgatgtttatagggagacgaggaaatataactagtgttgattatgcttttcagatggcctaaacctagttatccttgggccagtctcaccaccaaacctcacgatagaaatcccagtggacagatagttgcttggcaccaaaatcatagcatttttccttttgagacagagttttgctcttgtcacctaggctggagtgcaatggcatgatatcggctcactgcaacctccgcctcctgagttcaaatgattttcctgcctcagtctcccatgtagctgggattacaggcatgcactaccatgcctggctaattttgtatttttagtagaaatgggtttcaccatgttggccaggctggtctcaaactcctgacttcaggtaatccacccgtctcggcctcccaaagtgctgggattacaggtgtgagccaccgtgcccggccatttttcttcttccaaatgaagtatttatttattacagaggcaatttaaacatatctggattactaaaattataatttaccattatttagactagtaatgcccctggaaaatatgttatattgatgaaattttctctttcatcaatgactgacaatttctgtggggtggttcagaaaacagaagggtaggatgcattcacactgcttatgtaagagaggtaaatcctgactctaagagctgtgactgttgtcagtgagggcacagcacctgtagtgcacatagctcctccaagggcagtgctcggcgctggctttgcatccactcctgagtgcctgtagatgctgtggtctgtgggactcccacaggtgtcactcacatgactgggagagagcagtttaaacagtctgagttatggattaaacaggtggtggcagggacggtgtaccctttttctttttttgacacagagtctcactctgtcacccaggctggagtgcaatgggatgatctgggttcactgcaacctctgcctcccgggttcaagtggttctcctgcctcagcctcccgagtagctgggattacggcacatgccaccacgcctggctaatttttgtatttttagtggaaacgaggttttaccacgttggccaggctggtctcaaattcccgacctcaactgatttgccctctttggcctcccagagtgttgggattacagatgtaagatactgtggctggctaggacagtgtactcttgaattgatctaacctttggccaaacatatcgatatgactgcttagttcagacttagctctgctgagatgatagtttggatttgagatcgtagtcctctaataattccattttagatggtttgagatgcacaattcaaaggtgggggcaattgcctggaccctgtgagtacttagtacaggcatacctcaaagatactacaggtttggttccagaccactgtgataaagcaaatatcgcagtgtagcaaatcacgtgaatattttggtttcccagtgcatacagaagttatactatattgtagtttattaagtatgcagtagcattatgtttaaaaaatgtatataccttaatttaaaaatactttattgctaaaaaatgctaacgatcatctgagccttcagtgagttgtaatctttttgctggtagagggtcttgccttgatgttgatggctgctgactgatcaggatggtagttactgagggttggggtggctctggcaatttctttgagacagagtattgctctgtcacccaggctggagtgtggtggtgagaccatggctcactgcagccttgacctcccaggctcaagtgatcctcccagctcagcctcccaagtagctgggaatacaggcatgtgccaccatacctggctaatttttttcttttttttttgtagagatgaggtctcactatgttgcataggctggtctcaaactcctgggctcaagtgatcctcctgtcttggcccctcaaagtgttgtgagtcgtgaaccaccatgcctggcccacagtttcgtttcgtttttttcttttcttttcttttcttttctcttttctcttctcttcttttctcttctcttttcttttctttcttttttttttgagatggagtctcactctgtcacccaggcgggagtgcagtggcgtgatctcagctcactgcaacctccatctaccaggttcaagctattctcccactgcagcctctcgccgaataactgggattacaggcgtgcttcacatgcccagctaatttttgtatttttagtagagacagggtttcaccatgttggtcaggctggtcttgaactcctgacctcaagtgatctgcccaccttggccttccaaagtgctgggattacaggcatgagccaccacacctggcctgtggcccacagtttcttaattcctttcacgaaagaattctctgtagcatgcaatgctgtttgatagcattttacccacagtagaacttctttcaaagttggagtcaatcctctcaaaccctgctgctgcattatcaactaagtttatggaatattctaaatcctttgtcgtcatttcaacagtgttcacagcatcttcaccaggcgtagatgccatctcaaaaacctactttctttgcttatccataaaaatcaactcctcatctcttcaagttttatcatgagattgtagcaattcagtcctatcttcagactccacttctaatcctagttttcttgctatttctaccacatccgcagttccattctccattgaggtcttgaattcctcaaagtcatccacgagggttggagtcagcttattctaaacgcctattaatgttgatattttgaccacctgccatgaatcacagatatttttaaagtcatctagaatggtaaatcctttccagaaggttttaaatttattttgcccaaatccatcagaggaattgctatctatggcaactatagccttatgaaatgtatttcttaaataataagagttaaaagttgaaatccctccttgattcatgggctgcagaatggatgctgtgttagcaggcctgaaaacaacattcatctccttgtgcatctccaccagaactcttggttgaccaggtgcattgtcaacgagtataatattttgaaaggaatctttttttctgagcagtaggtctcaacagtgggcctaaaatactcaggaaaccatgctgtaaacagatgtactgtcatccaggctttgttgttccttttctagagcacaggcaaaataaatttagcataatttttaaaggccccaggatcttcagaatgggcaatgagcaatgagcattggccctgtggttgctcatacctgtaatcccagtactttcagaggccaaggtgggtggattgcttaaacctaggagttccagaccagcctggggaacatggtgaaaccttatctctacaaaaaatacaaaaacttgccaggcatggtggtgggcaccagctacttgggaggctgaggcaggaggattgcttgagcccagaggctgaggctgccatgagccatgattgcgccactgtactccagcctgggtgacagagcaagaccttgtcaaataaataaataaataaataataagatttattgttaaataaataaataagaccgcagctacactggcctctaaaaagagtccgcctgtcctttgaagccaggcattgacatctcttgtctagctatgaaagtcctagaagccaccttattccaatagaaggctgtcttatctacatgaaaattgatttttgagtatagccaccttcatcaattctcttagctagatgttctgggtaagttgttgcagcttctttttttttttccccattgatctttgatgttactatgttgtagcttctctatcagcacttgctgcctcaccttgcacttttatgttctggagacagcttctttcttaaacctcatgagccaaccccagctaatttcagacttttcctctgcagtttcctcacctctctcagccttcgtagaattgaagagagttagggccttgctctggatttaggctttggcttaaatgttgtgactggtttgatcgtctatctatagcattaagattttctccatatgagcaataatgctgttttgctttcttatcatttgcatattcattgagtagcacttatttttatttttaagcatcagaggtcaccacactggatggagtagcacattaacttcctttaaaaacttttcctttgcatttataatgtggctgtttggtgtaagaggcctagctttcagcctgtctcctatgttggcattcggcatggcttcctcactaagtttaatcaatcatttttggctttgatttaaaatgagagatgtacaactcttcctttcacgagagatgtacaactcttcctttcacttaaacagaggccactgtagggttattaattcacctaatttcaatattgttgtgtctcagggagaggcctgaggagagggagagagatggggaatagctggtcggtggaacagtcagaacatagacatttactgataaagttcactgtcttctatgggtacagttggtggcgccccaaaacaattacaatagtaacatcaaagatacttatcatagatcaccataacagatataataataatggaagagtttgaaatattgcaagaattaccaaaatgtgacacagacacaaattgagcacatgctgttggaaaaatggtgctgaaaaacttgctggatgccgagttgccacaaactttcaatctgcaaaaaatgcaatgtcagcaaagtgcaatggagtgaaatgcagtaaaatgaggtatgcctgtatttgaaatgatgaattatgaaaaatattaaaataacttgtaatattaggaaagcgcagaggaaagtttaaaactttctgcttaattcagcaagacttaaaaaaagtgaaagtttataacttgtcatttgatcatacttttttgctggttcctggattcatatggttcaaaatccaaaaggttccgagggttccttctctcgctgctcctacccacccgttcctctccctggagcagcagtgtgtcctgtttcttgggtatcctttcagaaaaatgtacttttactgctaactttaatgcttgtttcttttaccacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcaggtatcttccattggtggggtttacgtccatcctcctggctgatggttgcagttatttggaggtcctaattagttaagttagaagcagaagagggggggcatgaactgtgtcctgggatggaaggcaaggcaagagtgaatagtgaggattatcatactcctgagggagctggtggtgtcactttatggaggccccttaaagaaagtgggctgttctctgtgtggtggatttaaaggtggcaggtggtagcacctgatggcaggggaggggccagaagacttttgagggccatagccagactgaatcagcacaattggtatcacagtaggatattcctttgtgactttaaggcgcaggttaaatccccatcccaggcagcccaattcccagcacccctgttttgtgtctactcaggatttcttcccttccttttctttttctttccttcttttccctttccctctttccttctttctttcctgcgtacttattcttgcagtcatgttctgtagtaggcactcgatcaagtcatgaattaatttagctctttaacatgacatttatctttgttttatatttctcgtgtatcattcactgggtttttgtccaggctggccttgaactcctgggctcaagcgatcgtcctgacttaacctcctgagtagcaggactacaggcatgcgccaccatgccaggctggtcattttttttttcttttttttttttttttgaggtggaatcttgctctgtcacccaggctggagtgcaatggtgtgatctaggctcactgcaacctctgcctcccaggttcaagtgattctcctgcctcagcctcctgagtagctgggattacaagcacctgccaccatgccggctaattttgtatttttaaacggggtttcaccgtttgttggccaggctggtctcgaactcctgaccttgtgatctaccagcctcggcctcccaaagtgctgggattacaggtgtgagccactttttgtcttttttaaatgtttagtaaagtaagttacagagaactttgttgagatggtatatgtttctcctaagtgctgcgattgtgcctgagttataaactgttcttctcttccaaatcagatgctccttagtaggtcagcctcaacaaggaggttgtgtgtaaataaatctagaacatctgaaaaatggtcaattggtggtaaaatgaagttgagtaaacttccattactctgtacttgaggccaggtgcagtggctcacacctgtaatcccatcactttgagaggccaaggtagaaggattgcttgagcccaagagtttgagaccagcctggacaacatggcagaactccatctctataaaaaaaaatacaaaaaattgactgaggatggtggcacatacctgtggtaccccagctacttgggaggctgaggtgggaagattgcctgaaccaggggaggtcaaggtcacagtgagccgtgatcctgtcactgcactccagcctgggctacagagtgagaccctgtctcaaaaaaaaaaaaattgtattccactgattttcattgtgggaatataactgccaatgtttacctgaaacttttatgaagaaagaaatggctcaacaaattagtaattttcatataggcttctgggttatatctaagtgactgggcccaagggagcagactgattggaaggacagatcacgtcagtgtccagctttggtggggcctccactgcccccaggcatactcagtgctctttggttctgggtctcacactgtccctcctgcctctcccgcaactccctccctaacctgctttcttctttccttccttcagctccatgttgtatcttaattatggagactaaggctcttgctgttattatatgggctgggacatgtttgcttcttatgttaatatttaagttacagcatgtgtacaaaagaaaaaaatcctggttatacactattactattttactaatgcggaaaattgaggcttagcaaggttaaataatctgcccagagttcacattggttcagtggcagaactgaggcttcaacccagagtgttttgacttgggagcttatcaccactagtctgtattatgtaaaggtgaaataagcccgcacagttatattccttctaaacaagtcatcctgccctaattgtgaacatcctggtgtgtttgttagatcatatactcccttgtgccagcttaccaaaccaattgcctactgtaagttgatcttttttgagggacagggatgggcattctgaagagttggaaattttttctgtcaaataagttgacacagtgtgctttgtccatgaattagagttttctggtctggtttgtttagacaggaacttaactagtggaataattgtgccattggtagatccatattataattgaaagcaactcagattgcagaaaaggagtgccccccagccatgacccataagcaaagaggtcagaaacaaatgaaaaagccaaaagtttcaagtatcagaaatctccgtaggtcacacgcaacttcctcatttatttctgtctattctgagatggtaattgtatgagaaagccctctattaataataaattcaggttttttgacttctttctcttgtagcctttctaccaggtttggcaccgtagctgttcctaatattttattatttcaaggagctaaaccaatggccagatttaatcatacagatcgaacactggaaacactgaaaatcttcatttttaatcagacaggtatgtggaagtaatgtgctgaggaagaagatattctattgctgggggtctgtgccttctgtgggttctgatctgctataatccttaagtgaaggattcaagactgactttgagttgtaaaacttctcttctaatgaactgttatgatcctgttaaatacttcccaatcagtatgaagtttaacatgaataggtaattttaattattatagatactttttttttcccttttttttttttttttgagtcttgctctgtcgcccaggctggggtgcagtggtgcgatcttggctcactgcaacctccacctcccgggttcacgccattctcctgcctcagcctcccgagtagctgggactacaggcgcccgccaccatacccggctaattttttgtatttttaatagagacggggtttcaccgtgttagccaggatggtctcgatctcctgacctcgtgatccacccacctcggcctcccaaagtgctgggattacaggcgtgagccaccgcacccagcctttttttccttttttttgaggcagagtctcactctgttgcccaggctggagtgcagtggcatgatctcagttcacttcagcctccgcctcctaggttcaagtgatttgcgtgcctcagcctccagagtagttgggattacaggcgtgtgcccagctaatttttgtatttttagtagagacagggtttcgccttattggccaggctggtctcgatctcctggcctcaagtgatccacccgcctcggcctcccaaagtgctgggattttacaggtgtgagccactgtgcccggtctattatagatactttattgtttgattgactgagacggagtctcgctctgtcacccagactggagtgcaatggcataatctcagttcactgcaacctctgcctcctgggttaaaacgattctcctgcctcagcctttctagtagctgggattataggtgcgcaccaccacacctggctaatttttgtattttttagtagagacagggtttcgccctgttggccaggctggtcttgcactcctaacctcaagtgatctgcctgccttggcctcccagagtgctcagattacaggtgtgagccaccgtgcctggcctattatagatactttaaaacaagtgttactgaaatataattcacataccatacactttacttataacttttaacgcacatttttcacttaatatttacacaaagatatgcataagtcatgagtgtacagggtgatgaattttcacaaagtgaacaccctgggtaaccactctgatcaagaaacagagcactggcttatgcctgtaaacccaggagtttgggaagcctgtgcgggtggatctcttgaggccaggagttcgagaccagcctggccaacatggcgaaaccctgtctctactaaaaatacaaaaactagctggggatggtggtgggtgcttgtagtcgcagctactcgggaggctgaggcatgaaaattgcttgagcccaggaggcagaggctgcagtgagctgagatcacagtactgcattccagcctggttgacagagtgagactccgtctcaaaaaaaaaagaaaaaaaaaaagagaaacagaacattaccagcctcccttcagcaccactgctcctgccttccccaaagataaagataaccacagtcttgactcctaatatcatagactgtgttacttgttttggacttcatattaatggagacatgcaggatgttttattttgtgtctgtttttttcatccaacagtatgcttgtgagatgcacctgcattgtcatgtatggttatgttttgttctttttctttgctgctactgttccatttattaatccatttgtagatgctatcttagttccttaatatttgccaaaacatatggccttattttttattgtttgtaaaacattgtaaagcattgtaaattgaaaaaattacctccattggaaaagttcattcctctaaagcctcactgtctcaattgtgagcatcccactcttcccaaagtatgctcactggaaataaataaaaattataacacacattgcatatatattaaattgcatataatcattttagctaacactaaagaaaaaagagctgagttggctgataggagtaaaagtaggatattacaaggtggttagctagtccaagtcttgtcatggatccctgattgtcatttcgattgatgtgtggagagggagccattttattcagtgctctaagaaaacctagaacacaaatctgggagtcagagcatctttggtaatccctgtttccgttggtggcttgttgttataacagttctttcagtaaattattaaaagcattttggggctgggtgcggtggctcacacctgtgatcccaacactttgggaggctgaggtgggcagatcaactgaggtctggagttcgagaccagcctggccaacatggtgaaacctcgtctctactaaaaatacaaaaaaattagccaggcatggcggtgtgtgtctgtaatcccagctacttgggagggtgaggcaagagaatcgctcgaacccaggaggcggaggttgcagtgagctgagatcgcaccactgcactccagcctgggagacagagcaggacttcatcacagaaaaaaaaaaaagcatttcgaatttagcattacttaacctgtgaaaacattctgtagacacctgagaggagttttactagttacttactgaactttggtctcaaaagacaccaaaatacaactcttataaacacattgactaagaaacttctgatgagttcacagaaattctagtgttttagttgtgaacagctgaatgggttcctgatcctttgatgcagtggggagaaaggcaacttacaaattacactgataggcaagtgaaatccatcccatatatttatatatatactagtggcaatgcttattttaggactgcatgtcattttgcataccatacataatacttgagaaaaatctgtggtgggtgctttttctgcctgatttgaaaccagtgatttttctttcaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtaatcccagcactttgggaggccaaggcgggaggatcacttgaggttaggacttttgagaccagcctggccaacttggtgaaaccctctctctactaaaaatacaaaaaattagctgggcgtggtggcgggcacctgtaatcccagctacttgggaaagctgaggcatgagaatcacttgaacccgggaggcagaggttgcagtgagctgagatcatgccactgcactccagcctgtgcaaccagagcgaaactccatctcaaaaacaaacaaaaagaagtattgaagtgtaaaacactgttcttgcccacaagttgattctagtctagttcaagacacatgtttagtaaagagacaacatgtaatttaaacaaactttttttttttttttagacaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttagtagagatggggttttgccatgttggccaggctggtctcaaactgctgacttcaggtgatccacccgcctcagcctcccaaagtgttgggattacaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctc

SEQ ID NO: 38605 - DNA, 5365 bp, Homo sapiens
ggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccagggtgagtgccgcctgcccggcctgggcactgggcgcccggggtatcccgcgggccaaggggcggccggcgcgggccccgctgacaaccctggtttctcgttttctgtcccagcacttccggggaaggaaaaatcgctgctacaggttggcggtcagaaccgtgattcgagcctttgtgaaatgcaccaaagcccgatacctgaagaaaaagaacatgaggaccgtaagcgtggacccgggacacccgccggccagcgcactcgcggcccctgcgtttctgcgccgcgacccagctagtgtgcagccgcccggccaccctcagccccttcctttcataccttgcttcgaaactccgacaaattatgtcgccccgcaggcaaactgtgggacatccgttctcccgccccgccgccacccccactgtcaccccctgctccagcccctcgcccgggccactgcagagccgccttgacactctccctgcgtcgccagccaccgccctagtcgctgctgctctcatccctccggtggcttcccttccctttggcagctgaagtcaacccagccccttgccaaccctccagggctactatctgctgccgtggtgctcctcgaagagaccacgcctgctgccaagctctgcccacccggaaccccccgcatttctgggaggctggcgcctccactctgtccacgtgccgcctcattactgcgcctcaccactcccgtctcagcctcatgaacctagcatctaacgtaccccggtttttttttcttaccccgagacggagtctcgcgctgtcacccaggctggagtgcaatggcgcgatctaggcttaatgcaacctcgtctcccgggttcaagcgattttcccgccccagtctcccgagtaactgtgactgcaggtgtgcgccaccaagctattttttgtatttttagtagagaccgggttccgccatgttggtcaggctggtctcgaactccagatctgaaatgatctgcctgccttgccctcccaaagtgctgggattacaggcgtgagacaccgtgcccagctgggtttttgctgtttttaattttgaaacagggtcttgatttcgcttaggccagagtgatggcaccatcatagctcactgattttgctatttacttttagaaaaatattctttagatcaattagaggctttgctgggacataacatccagaagtcatttttaagtatcttcatgttttcttatttcagctctggattaatcgaattacagctgctagccaggaacatggactgaagtatccagcgctcattgggaatttagttaaggtatgggtgagtatgtgggtcccactgaaattctggacatctgcagaaaccatcatgcggggcgtggtggtgcttcctgtagtcccagctaatcaggaggctgaggccagaggatccctggagactgacttctgggctgtagtttgctatgctgatggggtgtccatgttaagtgtggtatcaatatggtgacctcttgggagcaagggaccaccacgttgcctaaggaggggtgaaccagcccaggctggaaacggagcaggtcacaattcccatgttgatgagtgatgagattgtgcctaggaatagtgccagcaacagcctgggcaacatagtgagaccactctctacaaaaaaataaaatttgctgggtgtggtggtacagagacatgtaatgtcagctactgaggagtctgaagcagggggatcactttgagcccccaggagtttgaagctgcagtgagctatgatggtaccactgcactctagcctaggtgagagcaggaccccgtctgacagaataaagaaagccatggctgggcagggtggctcaggcctgtgatcccagcactttgggaggctgaggtgggcaggagatggagactagcctggccaacgtggtgaaaccctgtctctactaaaaatacaaaaattagccaggtgtggtggcgggcacctagaattccagctactctggaggctgaggcaggagaattgcttgaatttgggaggcggaggctgcagtgagccgagatcatgccactgcactccagcctgggcaacagagcaagactccatctctaaaagtaaataaatcaaaccctcccatcagacctggcgcagcctgttagcagtccatgtggcagaggcgaggagtgccactccagctgcaccgtagctgcactctgtcttggtgtggggttctggcaggtctgggagcttaccgcactggttggcagcagagcagaattggaaacagggcacgtctttctgggatgtaagtcctgatgtttccccattaagaaaaaaggccaggcatcccaacactttggaaggctgaggcggacagatcatgaggtcaggatattgagaccatcctggctaacaggtgaaacccggtctctactaaaaatacgaaaaattagctgggcatggtggccggcacctgtagtcccagctactcaggaggctgaggctggagaatcgcttgaacttgggaggcagaggctgcagtgagccgagttcacgccactgcactgcagcctgggcaacagagtgagactctgtctcaaaaaaaaaaaaaagtgtagaaaaacttgactttaacttcaaagtttaatttgaaagtttaaacaggccaggcgcggtggctcacacctgtaatcccagcactttgggaggctgaggcaggtggatcacaaggtcaggagatcgagaccatcctggctaacatggtgaaaccccgactctactaaaaatacaaaaaaattagccaggcgtggtggcgggcatctgtagtcccagctactcgggaggctgaggcaggagaatggcgtgaacccgggagacggagattgcagtgagctgagatcgcgccactgcactccaggctggtcgacagagcgagactccatctcaaaaaaaaaaaaaagttaaaacaatgaggctgggtgcggtggcttacacttgtaatcccagtatgttgagaggcagaggcagaggcgggctgatcacctgacatcaggagttcgacagcagcctgggcaatgtggtaaaactctgtctctattcaaaatacaaaatgagccaggcgtggtgctggcatgcgcctgtatgctactcgggaggctgaggcaggagattggcttgaatccagaaggcagaagttgcagtgggctgagatcacaccagtgtactccagcgtgggcgacagtgtgtgactgtgtctcaacaacaacaaaaagttttaataatgagtgatttctgatgacatagcaggtgaaataggaacttacagaaaggaaggggaatgttttggagcgaacggatggtttatgcaagtgtagcaaaatcttggtgattactgaatctggtcattatgctagtccctctgcttgtgtacattaagtttttcctaaaaggttgagggggtgggtattttgcagaaggcactctttggtgctttacaaagatcttcagggtaggcttaggaggtttgactttcccattttactcagggaactgtagttaagaaaggagacatacttggccgggcacggtggctcacgcctgtaatcccagcactttgtgaggctgaggcgggtggatcacgaggtcaggagatcgagaccatcctggctaacatggtgaaacaccatctctactaaaaatacaaaaagtagccaggtgcggtggcgggcacctgtagtcccagctacttgtgaggctgaggcaggagaatggcatgaacctgggaggtggagcttgcaatgagctgagatcgcaccactgcactccagcttgggcgacacagtgagactctgtttcaaaaaaaagaaagaaagaaaggagacagactttgcacaaagcatacaggtcacaggtagtacagttaggtcacaggtagtaggccactttgtcctcggtagccgaattttgtgtttttgttcctttttttttttggatacaatctcactctgttgctcaggctggagtgaagtggcgcgatcttggctcactgaaagctccaattcccgggttcacaccattctcctgcctcagcctcctgagtagctgagactacaggtgactaccaccatgcccagctcatttttttgtatttttggtagagacagggtttcaccgtgttagccaggatggtcttgatctcctgacctggtgatccgcctgcctcagcctcccaaagtgctcagattacaggcatgagccaccgcgcctggccttgtggttttttttcttgtattttttagtacagacagggtttctccatgttggtcagactagtctcgaacttccgacctcaggtgacctgcctgccttggcctcccaaagtgctgggattacaggcgagacaccgtgccctgccttggtagctgaatttaatgctcaaagagacggccccccttttctactccttaaactctggcattgttcactagcttctgaaatcctctgtggttcttgcaggcacttccaggttggcttaaagggttaccctaggccagcagtcagctcagtcagggtggtgaccaaggaccctgaacaaggtgtttggttccccgggccgacatcaggactggagtccagcctccctgcagattccacaggtgcttccctcacccgtgtccacatttatccttcagcatcctgcctggaagtcctctgctgtgccacccagataggattctcctaggccttccctccccccaggcgagtgtgcagctgggttcttcctgagccagcgccgcaaccacgcggagccggagtgtgtgtctcacactgacagcaggttctgattcattcttttttcagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaac

SEQ ID NO: 38606 - DNA, 5370 bp, Homo sapiens
ggcaagatggcagcggctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccagggtgagtgccgcctgcccggcctgggcactgggcgcccggggtatcccgcgggccaaggggcggccggcgcgggccccgctgacaaccctggtttctcgttttctgtcccagcacttccggggaaggaaaaatcgctgctacaggttggcggtcagaaccgtgattcgagcctttgtgaaatgcaccaaagcccgatacctgaagaaaaagaacatgaggaccgtaagcgtggacccgggacacccgccggccagcgcactcgcggcccctgcgtttctgcgccgcgacccagctagtgtgcagccgcccggccaccctcagccccttcctttcataccttgcttcgaaactccgacaaattatgtcgccccgcaggcaaactgtgggacatccgttctcccgccccgccgccacccccactgtcaccccctgctccagcccctcgcccgggccactgcagagccgccttgacactctccctgcgtcgccagccaccgccctagtcgctgctgctctcatccctccggtggcttcccttccctttggcagctgaagtcaacccagccccttgccaaccctccagggctactatctgctgccgtggtgctcctcgaagagaccacgcctgctgccaagctctgcccacccggaaccccccgcatttctgggaggctggcgcctccactctgtccacgtgccgcctcattactgcgcctcaccactcccgtctcagcctcatgaacctagcatctaacgtaccccggtttttttttcttaccccgagacggagtctcgcgctgtcacccaggctggagtgcaatggcgcgatctaggcttaatgcaacctcgtctcccgggttcaagcgattttcccgccccagtctcccgagtaactgtgactgcaggtgtgcgccaccaagctattttttgtatttttagtagagaccgggttccgccatgttggtcaggctggtctcgaactccagatctgaaatgatctgcctgccttgccctcccaaagtgctgggattacaggcgtgagacaccgtgcccagctgggtttttgctgtttttaattttgaaacagggtcttgatttcgcttaggccagagtgatggcaccatcatagctcactgattttgctatttacttttagaaaaatattctttagatcaattagaggctttgctgggacataacatccagaagtcatttttaagtatcttcatgttttcttatttcagctctggattaatcgaattacagctgctagccaggaacatggactgaagtatccagcgctcattgggaatttagttaaggtatgggtgagtatgtgggtcccactgaaattctggacatctgcagaaaccgtcatgcggggcgtggtggtgcttcctgtagtcccagctaatcaggaggctgaggccagaggatccctggagactgacttctgggctgtagtttgctatgctgatggggtgtccatgttaagtgtggtatcaatatggtgacctcttgggagcaagggaccaccacgttgcctaaggaggggtgaaccagcccaggctggaaacggagcaggtcacaattcccatgttgatgagtgatgagattgtgcctaggaatagtgccagcaacagcctgggcaacatagtgagaccactctctacaaaaaaataaaatttgctgggtgtggtggtacagagacatgtaatgtcagctactgaggagtctgaagcagggggatcactttgagcccccaggagtttgaagctgcagtgagctatgatggtaccactgcactctagcctaggtgagagcaggaccccgtctgacagaataaagaaagccatggctgggcagggtggctcaggcctgtgatcccagcactttgggaggctgaggtgggcaggagatggagactagcctggccaacgtggtgaaaccctgtctctactaaaaataaaaaaattagccaggtgtggtggcgggcacctagaattccagctactctggaggctgaggcaggagaattgcttgaatttgggaggcggaggctgcagtgagccgagatcatgccactgcactccagcctgggcaacagagcaagactccatctctaaaagtaaataaatcaaaccctcccatcagacctggcgcagcctgttagcagtccatgtggcagaggcgaggagtgccactccagctgcaccgtagctgcactctgtcttggtgtggggttctggcaggtctgggagcttaccgcactggttggcagcagagcagaattggaaacagggcacgtctttctgggatgtaagtcctgatgtttccccattaagaaaaaaggccaggcatcccaacactttggaaggctgaggcggacagatcatgaggtcaggatattgagaccatcctggctaacaggtgaaacccggtctctactaaaaatacgaaaaattagctgggcatggtggccggcacctgtagtcccagctactcaggaggctgaggctggagaatcgcttgaacttgggaggcagaggctgcagtgagccgagttcacgccactgcactgcagcctgggcaacagagtgagactctgtctcaaaaaaaaaaaaaagtgtagaaaaacttgactttaacttcaaagtttaatttgaaagtttaaacaggccaggcgcggtggctcacacctgtaatcccagcactttgggaggctgaggcaggtggatcacaaggtcaggagatcgagaccatcctggctaacatggtgaaaccccgactctactaaaaatacaaaaaaattagccaggcgtggtggcgggcatctgtagtcccagctactcgggaggctgaggcaggagaatggcgtgaacccgggagacggagattgcagtgagctgagatcgcgccactgcactccaggctggtcgacagagcgagactccatctcaaaaaaaaaaaaaagttaaaacaatgaggctgggtgcggtggcttacacttgtaatcccagtatgttgagaggcagaggcagaggcgggctgatcacctgacatcaggagttcgacagcagcctgggcaatgtggtaaaactctgtctctattcaaaatacaaaatgagccaggcgtggtgctggcatgcgcctgtatgctactcgggaggctgaggcaggagattggcttgaatccagaaggcagaagttgcagtgggctgagatcacaccagtgtactccagcgtgggcgacagtgtgtgactgtgtctcaacaacaacaaaaagttttaataatgagtgatttctgatgacatagcaggtgaaataggaacttacagaaaggaaggggaatgttttggagcgaacggatggtttatgcaagtgtagcaaaatcttggtgattactgaatctggtcattatgctagtccctctgcttgtgtacattaagtttttcctaaaaggttgagggggtgggtattttgcagaaggcactctttggtgctttacaaagatcttcagggtaggcttaggaggtttgactttcccattttactcagggaactgtagttaagaaaggagacatacttggccgggcacggtggctcacgcctgtaatcccagcactttgtgaggctgaggcgggtggatcacgaggtcaggagatcgagaccatcctggctaacatggtgaaacaccatctctactaaaaatacaaaaagtagccaggtgcggtggcgggcacctgtagtcccagctacttgtgaggctgaggcaggagaatggcatgaacctgggaggtggagcttgcaatgagctgagatcgcaccactgcactccagcttgggcgacacagtgagactctgtttcaaaaaaaagaaagaaagaaaggagacagactttgcacaaagcatacaggtcacaggtagtacagttaggtcacaggtagtaggcccctttgtcctcggtagccgaattttgtgtttttgttccttttttttttttttttttggatacaatctcactctgttgctcaggctggagtgaagtggcgcgatcttggctcactgaaagctccaattcccgggttcacaccattctcctgcctcagcctcctgagtagctgagactacaggtgactaccaccatgcccagctcatttttttgtatttttggtagagacagggtttcaccgtgttagccaggatggtcttgatctcctgacctggtgatccgcctgcctcagcctcccaaagtgctcagattacaggcatgagccaccgcgcctggccttgtggttttttttcttgtattttttagtacagacagggtttctccatgttggtcagactagtctcgaacttccgacctcaggtgacctgcctgccttggcctcccaaagtgctgggattacaggcgagacaccgtgccctgccttggtagctgaatttaatgctcaaagagacggccccccttttctactccttaaactctggcattgttcactagcttctgaaatcctctgtggttcttgcaggcacttccaggttggcttaaagggttaccctaggccagcagtcagctcagtcagggtggtgaccaaggaccctgaacaaggtgtttggttccccgggccgacatcaggactggagtccagcctccctgcagattccacaggtgcctccctcacccgtgtccacatttatccttcagcatcctgcctggaagtcctctgctgtgccacccagataggattctcctaggccttccctccccccaggcgagtgtgcagctgggttcttcctgagccagcgccgcaaccacgcggagccggagtgtgtgtctcacactgacagcaggttctgattcattcttttttcagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaac

SEQ ID NO: 38607 - DNA, 10061 bp, Homo sapiens
gtgctgaccatgctggaactgcggcgactacagagcctgcgggaacctcccctttcgcccaagatctgctctgtccccctcatcctcctcccagggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggtaggtcaaaagccggggccgcacctggcttcctctgcagtccccttcctggagtgtcatccctgggtgggggtccctcctacgctcctccaactgtgcggaggcagctcggggtgcgtgcggaaggaggcccgggggccgccgggagtggggtgccgcctcacctgcgctcctcgggacctgcgagcgggcggcgggagggctggggcgctggctggagaagtgggttgagagttggagggggaggcggggaggggaggcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggtgaggcagggcctccgcggcccgggagaccctcttgccgcaggaccctctgtcacgaggagtccccagggccatgcccccaccccgtcctgtccacaggacgtctttcttcctccaacctggtttccaggaggactcacgtaggagggagggacagctgggtgcaggtgtttctccccagaaaaacggctggagagcgggaggagaggcctggggctggcgcgtcccgtccaccttctgccgcctgcacgcctggaccctggctggagccctacggtggggtggctcctgggacggggccagggagcggcggggctgccggacgctttccccagccccggggcacgggaagagctggacagaggaaagtgttcggggcagccgggaagagcccaccacctaccaggcgtcgggcggcccgcaggggaatctccgtggtgccggcctggttcagatccgactcttcaggcgggggcgaggcagatctaggggttggcgtggggcgggggaagcggtggtcctgggggcccggaggtagctggaacccgaggtgccctcagggcgaggcctgggccgtcaagggaaggtctggctggaatctggggctgggctggaagcagtctgaagctcctttgtacgtgtgcggaattgtctaactcctgtcctttctaaccccaaggaggccaggtgggtgaaagagtgaaactgctttgaaaagtaggtagagtacgaatgggaggtgttattagaattgttaataatatttgatttaaactgtgatacttagccaggatgtccattagaattgcctatgcaggatttattttagagccaggcaagctgattctaaagtgcatgtgaagaagtagtctagcaaaaatggccatgacaattctgaaagaaaaaccacacgaggggatcatgaaacagcccaattagcattaagctccatgttaaaattgtggtaatgatgcctagcccatgagacatgccaatgggcagaatataaggactagaataggcctacattcctaggggaacttcatttctgctcaggagagaattttaaatcactgagaaaaagaggatgtattttccgcaaatggaacgtatctttcagaagttaaacatctgaatgacagcaacagaacttggatccgtgtctcccaacggcgaaggttggtcacccagctcccaaattccagatggtcggcatttaaaagtgaaaactgaaagcataaaggcacttagaagaaaatgtggaagattattttataatctcgaaacggggaagtcctttaaaagtgtaagagctagacaccataaatagaatgaaatagaacatggattgtatgaatatacaagcaaggtcaaaaaataaacttcaaattgtaaagaaacatttgaaactcatatcacaaacggtaattttgtgaatagataaagaacttccatagaaaaaagcaaaacaaaacaaaacgaaacaaggacataggatgtgaacggagagctcacaaaagaagaaataaaaatggccctgaacatatgaaaagacaaccaacctcactcataataagagaactatgggccaggcgtggtggctcacacctgtaattgcagcactttgggaggctgaggtgggaggattgcttgagtccaggagtttgagaccaccctgggcaacaaagcaacaccccatctctctctctaaaaaaagagaactggccgggcgcggtggctcacgcctgtaatctcagcactttgggaggccgaggcgggcggatcatgaggtcaggagatcgagaccatcctggctaacacggtgaaaccccgtctctactaaaaatacaaaaaattagctgggcttgatggcgggcgcctgtagttactcgggaggctgaggcaggagaatggcgtgaacccgggaggtggagctggcagtgagccgagatcgcgccaccctagcctgggcgacagagcgagactccatctcaaaaaatgaataaataaataaatacataataaaaaaatgaaataaaagaaaaccatggattaaaaatatatggaaatcattacagaaagcaggtcagtggttgctcatggccagtggttgggggtattttctggggaggggctttagggaatgtattgctgtgtaggaatgtcctttatcttgattgtagctgtaattgcacaaatgtgtaaatttgtcaaaactcgttgagatatacatttaaaatgggacatttttattacataaaattgattaaaatcaatgcatttttccccatataaaaggaaaaagataaaagagtttgcctcctgcatgtgaattgctaccacctccgtggaggataactgacaatatctactaaaattgcaaatgcgcattcctggtgccctgccaattccacattgtctgtaatggaaaaggattagaaataacctaaatgtctgccaatagggaaccacttaaataaattatgaggaattcatactctcaaaatatatgcagttacacaaatgagtgaagaagcttttgtgaaagttgtcagaatcataatcgagtcacttgagttaaaaaaaaaatctgaaaatggaaggcccacaaggcagggttctcatgcgtaaataacctgggaacaaaagtcatcacaaaggactctgtaaaatgacaaccttacacaaaaaaatacttctgtgaggacatccaccagcaactgcctgtctaaccctggacttgtgtcacccttgttattgatccttgtagccaaggatgatcacctcaaagagattatgtaagtctccccatttttcctttaaaaacctttgtcttcctttacctccctgaacgtgcacatgatttactatggtaagcatattctcattgcaatgccctattccagaatcaatctcattttcttttggagagcctctctctgttatttaggttgacactttttatggactcatgtaggattattctaaaaacatatgatcgtgtgatcacagcatcatgcaaatcagtgtgtatagtatgctgctatttgtgggaaaagggggcagaaatactttttcacacttttgtatgcaaaaatgtcatggtaggatttataagagactgataatattactttgcatctgcaaggcaaataggtggttgagggaaaaagatgagcgataaggttttaaaggtatatatacccttttgtatctcttaacttttttatgtgtaaaatcactattgatttccagtgccattgatatctgcactgggaagcccctttgaattttgacaaagacactgttttttgtttgtttgtttgtttgtttttgttttttttgagatggagtctcactctgttgcccaggctggagtgcagtggcaagatctgagctcactgcaacctcagcctcccaggttgaagtgattctcctgcctcagcctcctgagtagctgggactacaggtgcacaccaccgtgcggatttttgtatttttagtagagagggagttttgccacattggccaggctggtcttgaactcctgacctcaggtaatccacccacctcagcctcccaaagcactgggattacaggcgtgagctattgtgcccagctgggatcttgacaaagacactatttctctcctttcacctgtgctgtgtatttttccctcgcctagttcccagacctcactgctatatgtcttctccctggcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtaagactggggtggtgcggggttggggggcacgttaacgaggtgatgaggtcaattaaaatatagagccaaatcttcaaaattaaaacgttttatttgggaggagagaattgcaatttggggcatacacacagaccaggtggtctccagtatgtctttagaacaaagagaaggttagaggcttataaaaaggagaaatgttacatattgcccttcatgaaagatcataggttttggggagctggtgagctctgatgggtgagcgatggcatgagtaaaactaatcctagagttgtagcaaggtcagaagctgtagataaagctggtttcaggttgcagcaggcagcttcagcagcctgatttgtagagaattacattttgggagcaacattttgtgccccgagtgctttttgcccctggcctctcgactctgttttagttgagtgtgacaagaatgaccccatttgtaggctcagctttcacagtggaaactctccttcttcaataggatgcaaaagaggaaagtgggttgaattcccatgagagggacatgagaaatcactatttatatctcattctgtgtaggaaaaagttgtaagtgtccccacagaaatttggatggaaaggaagaatcgacctcctctttggcacagaggagtcggtcccagccagaggtagggcaacaggaagaacagtctagaggctgttaattcggttttattgaccccacatggactgaaagcctacaggtgcaaggcaatgtgttcagcacttcaggccaagctacagagagaatccctgggctatatctaaaagtactcagtgaccatcagaaggaacagcagctacactaatgactggaactaaaggtagatcaggtgagggagaagcacatctgacatccttgagggcaggagaaccctgaatggagaaggaataggtatagacagaggtggaagatggacaaaaaagaattccaggttaaagaatggcaggagcaaaggcaaagaggccagaaggcatagggcaagttctataatggttaagagtaaagggaatgggcttcatgaatgggtgatttgggcccatattgctgagagccttgaacgaccaggtgaggagtctgtcctgaatcagctttgacagtgagaacgctgtcaatggattctgagcaggaacctgcctcagagtcaggaggcatccaggtgagaaggatcgaggatctgcactcacataatcatagcagaaatggtgaggagacaaaggagtccctgtccttcacagacctccatggcatgggagtgaaggggtttggggcataaggaaagagaggcattcacagcatgcagagagggttgaagtgtgggtgaccaggagatcggagccctgaaagtcaggaggagcagccattcgagaggtgtgtgtgtgtgtgtgtgtgtgtgtgtgtgtgtgtgtgtggtagtaggggatttggatgtgacaaatccgagatgctggtaggatgtggaggtggtgacagttgggttttccaggaagaagaggagttctcttctgagtcggagttgggtgtgtgaacggcttattggggtatgacacctatgaaatgaaaagagggggagcaggattgagcaggaggaaccatcaggctgcaatgcagactctgccaggccagtgggggagctcccaggcaaaggttgcccactgcaggagttccacactgggtggagatggcccttgagccactgtcttgcttaatcattggctggggggccctcctcagtgtgtgtcttcagcttgaaaaattagggtgaccctgaaggagctgacaactgcaggctgtcagcaatcaaacaagccctttcttgaaggaggtctcagcggcacttctttgtgtctgccacagagccctcaagagtgtgtgtttggatctgaagagaaaggataggccagaagctcaggtcaggctgggggtttggatgggacaatgggacctctgaaggagaatggggggggaaaagtgggaatcttcaggtgggatgagaaagtgttgaagttgggaaaaattgatgaaggataaatagccaagcctatgagaagggtgaggggagacccaggccagtgctgcttcatggattttaaggggacagaatcttccagaatcagagctgcagagaggtcaaggcagaggaaaaggagaggagagccacctaggtaggagccaggcagctggtcccagggcagccggggcatgtggactcacgggaaggggtctggtttctcatcctgtcttgcaggtgactcagatattgctgggggttgtgagttgtgttcttggagtgtgtctcagcttggggccctggactgtgctgagtgcctcaggctgtgccttctgggcggggtctgtggtgagtaaggaacaggctgtgagcctggagggaggcaagtggtgatgggcaagaaggcgcttatggatcttggttggggctttggggaagcgaccaaagtctctggagccaaatggcctttggccatgaggaggctgctctggggtgtagctaaaaccctgtcacttccatttttctcttgaagacagatgggaggggtggggcaggtataggtggaatcctggtctgtgtgtcagagttctttgtctgtccctgggatcctgcttcacattggctattctgggaactgctggtgggagggtgatgatagaccaattcagaagagtaaactggaggcctttttctggtgtctcttttcaggtgatcgcagcaggagctggggccattgtccatgagaagcacccgggcaaacttgctgtgagtcttggacaccctctctccaccttgttcactgaccccctcctgaattctgctccattatctgtcttctgccctttggttgtcaatatcttggggtctttcttggaggggaggagagggtttcctggacaagggctggggaagaggagagggatttgaggcggggacctcatgactcttccaccgattgaaggagcgtgtgtcatgaccctctttctcttccagggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgagggtgagcaggaagagtccagtcttcggggacccatcacagctcttttttcccagggagctgggggccctggaggacagagatgtaggctctttgagcttggacttcatgctgggtctttcattcaggaggttttaatgtaagctacagacatttttcagacctcatgacacgaagattctctgaatcaaggagggtgaggaacaaagaggagacatttcagagaggagatagtgggtcacccttctggcttttctggtgtgttggtatcacagttttccattactgaattaaaaaccacaccaaaatgtagtggcttaaaatgacaacttattatttctcacggtgctgtgagttggctggattcagatgagccattctcactcacgggttttctcatgcagttacagtcagatgggggtgaagttatccaagtgctcgccgaggctggaggtctgagatgatgtagttgcatggtccggagctcagcgggggctgtcagcaagagccggcaatggcttctccacttggcttgggcttctcatagcacagaaactggattccaatggggagtaccctagttgcaagcatttcaggagacagaaagtagaagctgccagaccagctaagggcttccctgtcactgtatagtgtcactttcactgtggccaaagcagttctaggcccttccagattctacgggttgaaggaatagtctccacttcttgacagggagtgataagttcactctgcagacaagccaacgggatggaagctgtggctggaaacacagtcagctgtggtgggagcagcaagctggatagagtcagtgcctgggtgggtggagagggtggtgatgtgggcagcattggagtagctgacacctgactatctttgttcttcccttatctccagaagttgttcacagcaatccgtgccctgttcctggctgtctgtgtcttgaaggtcattgtgtccttggtttccttgggagtaggtcttcgaaacttgtgtggccagagctcccagcccctggtgagttgtcggggaggggcctctgggcagcgtgagtctgggtggtgagtgtgtgggacaggtaggagtgcggggccaggggcacccgaacctgaggctgggcctggtgcccctcagcttctttccatatgcagctctcccctttgctgtctggggaatgtggccatcaccatggtcctgggccaactgtcgccgccctgtgcctctctgcgccctcctctgctctgatctccccactctcccctctgccctgtcccaggtgttcgtctgactccccttcctctgccaccttgttttttttttgcctgatctgcttttcctgtcaccttttcctttccctcctcctttcctctttctgctttctgagttctatgatactaactctgcctgcatccttttcccctaaggatttcttttttcttttttttccagaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagc

SEQ ID NO: 38608 - DNA, 96268 bp, Homo sapiens
acgggcggccggatttgcccggaggccgcacccgcctccggcggggctctcaggtatgtgcgccgcgggggtccctcaggggggttgggggtagcccagggaggtcggggtcgggggctggcctctgtagggcgctcagaggccgagtccccccgagcgccgcgtgggtgaggcttggcggtctggtcggggaccgggtcatgtgagtcacgggcgcccctcctttccgcccgcgcgccctcggaacgggcggcccaccctggcctgtcctctggcggcctcaggccggggccgggcgtgcaggggctgacacgtgggcaggaaagcgaggcagagccgccgccgcgtaaggccgggctgagggctcggcgtcaccagccagggctgcagagagcggcgtggcacccggagttggattatgcgtggctggcgtgagctggaagggagtcactcgcccacaagctctcaccacgcgagcttttattgtcccgttcaactgctccgcagtgtggagatcgcatagttacgcacgtcgtggttgtgtcgccccacagtactgactgcttcacctttgcagacagaggctccggcccggcgcggtggctcacgcctttagtcctagcactttgggaggtcgaggctggaggatggcttgagcccaggagttcgaggctgcagtgagctacgatagctccactgcaccccagcctgggcaacagagggagaccctatctccctctgaaatagtctaaaataaggaaactagaaatgcgataatgcccccaggaaattctttctcaggaatatatgtatttgttaaatggttcagtatatgatttattttttattttatttatttatttgagatggaatcttgctctgtcgcccaggcgggagtgtagtggcaccatctcggctcactgcagcttccacctccctgggttcgttctagcgattctcctgcctcagcctcggggtagctgggattacaggcccgcgccaccacgcccggctaatttttgcatttttagtagagacggggtttcgctgtgctggccaggctggtctccaacgcctgacctcaagtgatccgcccgcctaggcctcccagaatgctgggattacagacgtgagccaccgcgcctggcctcagtatatgatttataagctttatgctgtatgagggttcagttatgtatttatacatacttgataggaaatgctaaagttcacattcctatggatagcttttggtgcttttcaaactaacgaggctggcacggtggctcacgcctgtaatcccagcactttgggggccaaagcaggctgatcgcttgaggccaggagttcaagaccagcctgggctcgtctctataaaaagaaaataaaaaataaagctctaatgacagtcattaaaactagctgccaaacaccacattactagcgttagcggtctcagtgtacttgggtggttttaaaatgacacccattggacctgcaaaacgatggtgcttcccgatatgttcatgttattcatcttttagaatatggaagagaaagttcttagttctcgaaatattgtgtaaaatataaggtgacaacctggatctgttaaatgacattcatctaagtgtactctcaaagtcaaaattatcttttcatacaggtggaacttatattttaccttacttgctaaataagtcattgtcattaattgtatttgcactgtgtttttcagtgaaaaatgtactctgacctgaatcctgaattttccttgatggtcaaaagattaaggtatcaaatttccttttttctggatgtattatcgttttactctcttacattgcaatcccccactcctgcaaaaaacccacggagtttcagaataaaatgattagcatcagtaaacatggaaatatttttctttttggattaaattatttgtttatgttctgaggaaaaatctttaaaagcttagttttattgtttttgttgttctttataaccttagccttcagaaaaataaatgtttaactttgcttcttctgtgacttgttcacctgaattcaagaaggtggaattgggcctaaggaggtggctcacgcctgtaatcccagcactttaggaggctaaagtgggcggatcacttgaggtcaggagttcgagaccagcctgggcaacacagtgaaaccttgtctctactaaaaatacaaaaataagccaagcgtggtggggggcctacaaaaattagccaggcgtggtggcggggagggggttgggcagtgcttgtagttccagctacttgggagaaccacttgaaccagggagagaggttgcagtgagccgagatcgtgccattgcactccagcctgggcaacagagcgagtcttcatctcaaaaaaggaaaggcagaattgaagaagctttggaagaggtgaggaatagagctgtggaaattactattttttttttaattgagaatctcctgtgtgtaggtgccttacaaactggcttcatgagtaccctataaaacagatgtttttatttttaaaatcatcatggttttgttttgttttgtttttttgagacagtcttgctctgttgcccatgctggagtgcagtggtgcaatctcagctcactgcagcctctgcctcccaggttccagtgattctcctgcctcagcctcccgagcagctgggattacaggcgcccgccaccatgccaggctaatttttttgtatttttaatagagacgaagttccacagtgttggccaggctgttctcaaactcctggcctcaaatgatctgcccgccttggccaccgaaagtgctgggattacaggtgttgagccactgcacctggtcattatgttttaaaattacatacaagttgttaaaaaaatatgaacagcagaaatagattttagaaaaacagaatgaaattatccatctcttcccccatttagtgaatatttggagtatttcttttcacactgtaggtattataattcctgatttattagaagcagggagtggctgggcgtggtggctcatacctgtaatcccagcactttgggaggctgaggcgggcggatcacctgaggttgggagttcgagaccagcctgaccaacatggagaaaccccatctgtactaaaaatacaaaattagcctggtgtgatggtgaatccctgtaatcccagctactcaggaggctgaggcaggagaattgcttgaacctgggaggcggaggtttcagtgagctgagattgcgccattgcactccagcctgggtaacaagaatgaaactccatctcaaaaaaaaaaaaaaaaacagggagtgaggcccacagaaaccaaacaaattgttgatgatcaccaagcttgtaaatagggtaagattcaaacctgtgtatctgactccaaagttatactatttatactattccaaggagtattttaagtatttgttccatttagttagaaattatttactgtgatataaagtctaatgaatttcaactttagatttatgattgcttttgtaaaatatacagataatttgcaaagtaaggtttttttttatttttatttttcgagacagggtctcactgtgtcacccaggctggagtgcggtggcacgatcacagtttaccacagcctggacttcctgggctcaggcaatcctcccacctcagcctcctgagtagctaggactataggcacctgccgccactcccggctaacttttgtctttttggtagaggtggggtttcactatgttgcccaggctggtctcgaactcctgggctcaagcgatatgcccgcctctgcctcccacagtgctgggattccaagtgtgagccaccatgcctcacacaataaagtttaattatttgtagtaatttcccattcaaacgaagaccaaaattcagcttgaagggaacattcaatagcattccacaaagtcaaatgagttttctgccttagagttttccttagctggtttaaaattccaggtctgtttttcttgatccatagcatgcttttttctctcttaaaaatattttagaagaagattgttaggatttagaaaaacatagcatataaattcttgaaccattcatttttaaaaataatttaatttgaaaggtaaaaatatactttctactttctgtctcactaaatcagtctattctggacttttcctataaaagatgtatgtggccctttgtgaccgtcttctttcacttggcagagtattttaaaggtttatgcgtgtagcatgtatcaggtacttcatttcttgttatggctacatagtttttgttgtatgactgtaccacattttaaaaatctattcatcattgatggacacttggattatttccactttttgactattctgaatgatgctgcggtgaacttttgtgtgtgcatatgttttcagttctcttgggtgcgtttatacctaggaatggtacttccatatttaaatttttgaggtactgccaaacttttccacagtggctacaccattttaattcttaccagcagtgaatgaaggttccaatttctctacttcttcaccaacacttgttatgtgtgttttttattataatcatcctagtgggtatgaagtatttatttgcagttccttgatgactaataaaatttagcatctttcatgtgcttatggaccatttttatgtcttatttggagaaatgtctattcagatcctttgcccatttttaagtcaggttgtcttttattattgatttgtaagagtttttttttaatatgttctagatgtaagttccttaccagatttgaaaatgttttcatccattctttaggttatattttcccatttttcatagtgactttgaagcacaaaagtttttaattttgatgaagtccaatttataaatgttttctttcgatacttatgcttttggtatcatatgtaagaaatcattgtctaattggacttcatgaagatttactcctttgttttcttctaagagtttcataggtttagcttttacatttaggtttttatccattttgtgttactttttccgagaaaaggatccagtttcattcttttgcacgtggctatccagttcatttgctcaaaagactatttctttcccattgaattgtcttcacactctatgaaaaataaattgacctaaatgtgaaagtttatatctggacgccagttcagttcatccatatgtctatccttatatcagtatacattgtcttgattacgccagtttttttttttttttcgaaatggagtctcactctgttgcccaggctggagtgcaatagcgcgatcttggctcactgcaacctctgccttccaggttcaagcaattctcctgctccagcctcctgagtagctgggattacaggtgcgtgccactacgcccagctaatttttgtattttcagtagagatggggttttatcatgttagtcaggctgatctcgaactccttgacccaggtgatccgcccgcctcggcctcccaaagtgctgggattacaggcatgagccactgtgccaggccgattactctagctttgtagtaaattttgaaattgggaaatgtgagtcttccaaattttttttttccaagattggttattctatctccatatgaattaggatcatgtttccaatttctgcaaagaagtcagctggaattttgatagggattatgttgaatctgtagatcaatttgggaattagtgtcattttaacaatattacatcttctgattcattaacatgggatatctttctgtatatgtaggtcttttaaaacttctctcaggactgttttatcactgtcagaggataagttttgcacttcttaaaaccaagtaagctaagttagcaattcccaaaaattatatgagatggtaactcccgaaattctgtggcataacaagattatttccttaatggcaagcatattctggccccagaataatttagaatcaagtatagaattcaagagaatcaaggctgcagcagtaatactttgagtctatacccttgtgtatatttggcttaaatgttttaggagaattggcctttgaaaatttaagatatttgttatttcaaaataaaatgtgtaatcaactaatacaaagcaagttttgtactttttgttgaatttattactaagtattctttttgatgcaattgtaagtagaaatatttatttattaagagatagggtcttactgtgtggcccagtatggccttgaactcctgggcttaagacatcctcctgctgcagcctcctgagtaactgagattacaggtgtgcaccacctcgcctggctcagaatggttttcttaacttcatttttagattgttcactgtgaatatatcgaattacaatagtttaggctgggcatggtggctcacgcctgtaatcctagcacttggggaggctgaggtgggtggataacttgaggccaggagtttcagatcagcctggccatcacagagaaaccttgtctttaccaaaatcacaacaaattaattagctggttgtggtggtgcatgcttgcaatcccagctactggggaggctgaggtacgagaattacctgaacccaggaggtggaggttgcagtgaaccgagatagttccactgcactccagcctgggcgacagaacggtttttgtatgcttcaaccttactgaactcatttattcattctgatatttactttagtggattctgtatgattttctatatgcaagatgctgtcatttgcaaatagagatagtttttctttttttgtttccaatctgaatgtgttttatttcattttcttgcctaatgctcctcattagttttcaatgttgcatagtattttattgcatggacgcaccataattacttttaccaatctcttattgatggacatgaaggttatttccaaactcttgtggttataacaatgctgtaatagataacctattacaaagaacagttctcaactcttttggtcttgggactactttacctatttatgtataagtttcaagtttgggcttagaaagaatttaataatcatgctaattttgttttgttttctttttttttactcctggacccaagcggtcttcccacctcaacctcccaagtagctgagactacaagggtgaaccatcaccctgggtaatttttaaattgttggctgggcacagtggctcacgcctgtaatcctagcactttgggaggctgagacaggcagattacctgaggttgggagttcaagaccagcctggccaacatggtgaaaccctgtctctactaaaaacacaaaaaatgagccaggtgcagtggtgcgtgcctgtaatcccagctactcaggaggctgaggcaggagaattgcttgaattcaggaggtggatgttgcggtgagctgagatcgtgccactgaactccagcctgggcgacagagcaagatttcatttcaaaaaacaaaaagaaaaaaatttttaaaaattgttttgaagagatacggtttccctatgttgcctaggctggtctcatgcgattctcctgccttggcctcccaaagtgttgggattatagacatgagacaccacaaatttaaacaaggactttttttattttttaaagagattactttttctgagtaaacaaggacttttaaaacaaggtactaaaaatctggctgggcgtggtggctcgctcctgtaatcccagcactttgggaggctgaggtgggcggatcacgaggtcaagagatcaagaccattctggccaacatagtgaaaccccgtctctgctaaaaatacaaaaattagctaggtgtggtggtgcacgcctgtagtcccagctgctcaggaggctaaggcaggagaatcacttgaacccgggaggcagaggttgtagtgagccgagatctcaccactgcactccagcctggcaacagagtgagattccgtctcaaaaaaaaaattttttttaataaataaataaataaaaatcttgaaatttttattaggtcctggtgtttctaattttaatatgatttagttctcaagtgctagttaatacttcattaatcagccagatggaagtggggatactatggaaacagcataggcaaagcttaaagataaatgagaccatggtttgaaaatatagggtggcatgcgctttggttcaaggcaatttgatcatcacaacaatttggcttaaacagcactttggttgaaaatgaatatcccctagttatgtgtttttcaagtattggtcattttggtatatcatgagttgttttgcaaacttttgtgccaaagttttcaggaaaactttctaatatttgcttttgtgtttctaactgattttcagagaagttgtaattttgatgttttttccttttagtgagcatgctttaacaaaaaacaataacagaaactgtgtcaaagaaaaggacctgtaatcttcagggtttgtagtctttttcctcttaaaaaacccttttcctaattaatggcagttacatctgcatggctggtttgggtaagtcttcattttgttgtattgctgagtaacagtcaacaaaggtttatcaactcttggttaagggttcctttcatgttgtgagtaaacatgaacaatataggatcttatccttttaagctatcatgcaagaaacatgtgaggtctcttaaaaattcactgtgctggccgggcatggtggctcacgcttgtaatcctagcactttgggaggctgaggtgggtggatcacttgaggtcaggagttcaagaccagcctggccaacatggtgaaaccccgtctctacaaaaatacaaaaatcagccgggcatgatggcgggcaggtgcttgtaatcccagctacttgggaggctgagacaggagactcgcttgaacccgggaggcggaggttgtagtgagccgagattgtgccactgcactccagcctggatgacagagcaagactccatctcaaaaaagaaaaaaaaaaaaaaattgtgctggctgggctcagtggctcacacctgtaatcccagcactttgggaggccgaggcgggtggatcacctgaggtcaggagttcaagaccagcctggccaacatggtgaaaccccatctctacaaaaatacaaaaattagccaggcataatggcgagtgcctgtaatccaagctacttgggaggctgaggcaggagaatcgcttgaacccgggagtgagccgagatggcgccactgcactctagcttgggtgacaacagcaagattctgtctcagaaaaaaaaaaaaaattaactgtgcttataaatgggagctaaattaggaaaaaaataaaaagtaaaaagaaaatgaaaataaaaatttaaaaaatatattaacaaattaactgtactaaggtaggattctttttttttttcttgagacggagtcttgctctgtcgcccaggctggagaggagtggcacaatctcggctcgctgcaacctccacttcccgggttcaagtgattctcctgcttcagcctcccgagtagctgggattacaggtgcctgccaccacgcccgcctaatttttgtactttcagtagagatgaggtttcaccatgttggccaggctgctcttgaactcctgaccttgtgatccgcctgcctccgcctcccagtgttgggattataggtgtgagccaccacacccagccactaaggtaggattctgatctcacctgtatgttatttattatgcctctcttaatctttattttaaaatagaggtcaggttttttgttttctttatatataaagtatggcacattcagttgttcatcattcaagatgccttgccattcagctctgtttaatgatgtggaccaccctctagaaaagaaaatctttatcctatcttgagcattttggttttgaaagttttagatcaattgtaatttcggtatggtgttagaggataataagaagggaagtgtaaggtaaaaattggggcacatctataatgctgttaaaaacagacataactgaaaaatacaccagagaagcaaaaagtaccttctccttgaccattctagaggtgttgcagaagaaacagactttaggtgaagcatatatgtgagtataattatgttgcgcttgcttcttaatgaaagacatgtcaatgaaggactaggcacaaggtagagacgctgataatgttgagtcagctcaggaaattggacctgaagtaagaagatagagattccttaggatgccttgaccctcgagtagcaatatccaaataaaaatggcttaaaggaaagccataaaccaagataacattatctaacaagaagtctgaaggcagggcttttccattgacagtccaaggactcaatgataccatcagatacctactctgctcttctctctgttacacattcagccagtttgtgatatctttcctaagggttttaaaagggcttcagcagttccagaggtcacatgtagccataactaagttctatggagaaacagcagtttcctcctgtgcatatcccggtattagtgaagaaaccttttccaaaggcctgccagctaccttcaactctcttagaccccagtagctaggattgggttggttacatgccacgccctggctgtaagggaggctacaaggaagacttactggcactttttggcctctgaagtacaggcagactgtgccagccaggaagaaaggtagaaaaggaataattggttttgtttgtttgtttgttttgagacggagtcttgctcttgttgcccaggctggagtgcagtggtgggatctcggctcactggaacctccgcctcctgggttcaagtgattctcctgcctcagcctccccagtagctgggattacaggcacctgctaccatggctgactaattttttgtatttttagtagagacggggtttcaccatgttggccaggctggtcttgaactcctgatctcaggtgatccacccgcctcagcctcccaaagtgttgggattataggcatgagccactgttcccggccagaaggaataattgttagacaactcacagtgtctgccatatttgccacagaaaataactgacttgctctctgctgtcttactgtgataatatatttttttaacgcaatttacaaaagggggggaacattcttaaatttgaaactaggaattatgatatttgcagtttcatattgtatacagtaaacagtcttcaaattctagttctccttgagatcttatacaatgataacagttttaaaattatgccttctgttttttgaacagctttttactattgacagcttttaaggaagtagttttcatgttgtcgtgtttactctcttactagacaggaagacagaacagaaatccatcctcaacttctggggataatctgaggattataatgaaatatcagatgcttaaatgatttcaacagacttttagatgaagttgccattagcaccttgttatcatcaatgtaacacataggcaagtggattaaaataagagggctaaactggcctttatgttgaaattagaagtttcgttgtcctacaggcagaaatgacagtttcattggattctctatgttatagtaatatatcagaaggatagcttgagatgagactattttgaagatacatggggtggatattcaaagtgccttttacatagttactgtcctccacagtttccccattaaatgtggaatccttgtgattgcattcttggagggccatcgaaaactagtgaagcacagagagactattttttttctatagatattaatctaaagcaataattggcaaaaaaaaaaaaaagagatttaaaatgtaggataaaggccaggtgcagtggctcatgcctgtattcccagcactttgggaggctgaggcaggtggatcaccagaggtcagaagttcaggactagtctggccaacatggtgaaactccatctctgctaaaactacaaaaacttagctgggcgtggtagtgcgcccttgtaatcccagctactggggaggctgaggcaggagaattgcttgaacctgggaggcagaggttgcagtgagccgaggtcttgccactgcactccagcctgggcaacaagagggaaactccttctcaaaaaaaagaaaagaaaaaagaaaataatatggtgctgtgctatgggataatggggaatacctactttatatagggtgttcagagaaggccttgaaaagaagaaacatttaaactgaaattaaaggctgagttgaagcaacctattaaagagctgtgggaaaggcatcctaagtgaaggaaatggcgtgtggaaaaactgtgatacagaaaagaccttgacatgttttaggaatggacagaaatccagtgtgactgtggttgtcctagtggagaatgttgtgattttggacaggtggataagcagtcagatcatataggcaagtgctttacatttttaccttttgtgcagtggaaaacccaattggaagtatagtaggcataaattttgtagactacatacttaaatatacaaagatgtaattttctttctttctttcttttttttttatttttagagatgactttttgtttgtttgttttttgttttttgaggcagtctcactctgtcaccaggctggagtgcagtggtgcaatctcagctcatggcaacctctgcttcctggtttcaagcagttctcgtgcctcagcctcccaagtagctggaattgcaggtacacatcatcacacctggctaatttttgttttttgcttttttgagacggagtttcgctcttgttatccaggagtgcaatggcgtgatcttggctcactgcaaccttcacctcccaggttcaagtgattctcctccctcagcctcccaagtagctgggattacaggcatgcgtcaccacaccaggccaattttgtgtttttagtagaggcgaggtttctccatgttggtcaggctggtctcgaactccggacctcaggtgatccgccctccttggcctcccaaagtgctaggattacaggcgtgagccactgcgttcagcctaatttttgtattttttagtggagacgggattttgctgtgttggccaggctggtcttgaacccctaacctcaagtgatccaccgccccttggcctaccaaagtgctgggattacaggcttgagccaccatgcccagcctagagatgaggtcttgctatgttgcccaggctgatctccaactcctgggctgaagtgactctcccaccccggccttttaaagtactgggattacaggtgtgagccattgtgcttggccaacttcatttctaaataactaaaatttccttagctctgtttctactaggtaatagagaacaatcctgctaaacaatcttgccactttaggataaaaagtcagtagcttctggcttaactaaattaattacatgttaatctaaacccttggtaaatacttggtccttttggtaaatgttcagtttcctcacagagcccaccccttccctttttttccctatggtagatggtattggtagagaaatcttataatttttcctggcattaagggagagtcatcttatctttgtgctgtcctctgtccttctgagccattgcaaatgactggcttggtcttgaatgggattgtctgcctctgccacttctgaggatgatgtccctgctactactgtagcccctgggcaacacatctgtgcatgctgggtcctccttaatcccaggctgttttgggtatactggcccagtggtgagtgctgatatgcttgggaccctaataaagcagcttttcaggaatatggtttgggcatgtcattggctattatgcctttagcaaggcatgatattgtattaggtgcaaggttttactaaatggctacagtccctggaccataacttgggaaagggaaacacaattatttcccattctgggtccttccccacaaacactggagatttttcttacccttccgcaaataagattttttttttttttttgagacagtttcattcttgttgctcaggctggagtgcaatggctcgatctcggctcactgcagcctctgcctcctagattcaagcgattctcctgcctcagcctcccgagtagctgggattataggcgcttctaccacacccagctaattttttgtgtttttggtagagacagtgtttcgccatgttggccaggctggtctcgaactcctggcctcaggtcatccaccctccccggcctcccagagtgctgggattacaggcgtgagccacctcacctggcccctcaaataagatttagctccagataggacaggaggcaaaaattctaaatttacatccactctttcttttaactcttgtttttctttgaactcttcccccaagtttttatgtcatcttgatcagtgtgagagaactgtacttatgtcatcacctgcctttcctctgtgctggagtctacatgacaaattctgccatgaaagttttcttgatttggttggtgatagttaaaatcacagttttagaatttaaaaagctgtcttggccgggtgcagtggtatggttctgaggattaattttatatacacacatataaacactcacacacacatttgagttcaaaatgtatgttactacattttacaaaggaataagtgatttcatagattctgtatcaatattaaatcttggctgggtgcagagcctcatgcctgtaatcccagcactttgggaggctgacacagttaagatcacttgagcccagaagtttgagaccagcctaggcaacatagtgagaccctgtctctacaaaaaatacaaaaattagctgagcatgttggcacacacctgtagtcccagctactcaggagactgaggtgggaggatcgcatgagcccaggaggttgaggctgcagtgagctatgattctaccactgcactccagcctgggcaacaagagagagaccctgtctctcaaaataagtaaataaataaataaaaagttctcttttggccaggcacaatggctcatgcctgtaatcccagcactttgggaggccgaggcgggcggatcacaaggtcaagagttcgagatcagcctagccaacagggaaaccccatctctactcaaaatacaaaaaattagccggaagtggtggcgggtgtctgtaataccagctactcaggaggctgaggcaggagaatcacttgaacccgggaggcagaggttgcagtgagctgagattgcaccattgcactccagcctgggtgatgatgtgagactccatctcaaaaaaaaaaaaaaaaagctctcttttctcttaagcctgtaggtcttatgattgaaattcttagctttcaagaattatcattttaatggatcaaagacctaaatataagaactgaaactataaaacgcttagaaggaaatgtaggtttaaatattcatgaacttggatcaggcaggtttcttaaatatgactccaaaagtgcaaaagaacaaatagataaattggactttattaaaattaattttttttttttggtgagatggagttttgctctgttgcccaggctggagtcagtggtgccatcttggttcactgcaacctctgcctcccgggttcaagcgattctcctgcctcagtctcccaagtagctgggactacaggcgcgcaccaccacgcctggctaatttttgtattattagaagagatggggtttcaccatattggccaggctggtctcgaactcctgacctcgtgatctgcccactgtggcctcccaacgtgctgggattacaggcatcagccactgcgcctggcccttaaaattaaaaatttttttaaagtttttatttttttgagacagggtctcatcatgttgcccaggctggagtacagtggcgccatcatggctcactgcagtttcaacctctctagactcaagcggtcctcccacctcagccttctgagtagctgggactgtaggcatgtgccaccacatcccagtaagttttgtattttttgtattatagaaatgggggccaggcacagtgctcactcctgtaatcccaacactttgggaggccgaagtagacggatcacttgaggtcaggagttcgagaccagtctggccaacatggtgaaaccccctctctactacaaatacaaaaattagctgggcatggtggcacgcgcctgtaatctcaactacttgagaggctgaggcacgagaatctcttgagtccgggaggtggaggttgcagtgagctgagaccatgccactgcaccccagcctggttgacagggcaagagtctgtctcaaaaaaaaaaaaaaaaaaaaagaagtggggtttcaccatgttgcctagactggtcttgaattcctgggctcaagcaacctgcctgctttggcctcccaaagtgctgggattacaggtgtgagccactgcacctggccaaaattaaaaacttctatgtttcaaaggacatcattaagaaagtgaaaagacaacctacagaacgggattaaatatttgcaaattgtgtatctgttaagggtctagtatttagaatatgtaaagaactatcacagctccataagaaaaaagcaaataatccaattgaaacaatgggcaggccaggtgcggtagctcacgcctgtaatcccagcactttgggaggccaaggtgggcggatcacgaggtcaggagatcgagaccatcctggctaacatggtgaaaccccgtctctactaaaaatagaaaaaaattagctgggtgtagtggcgggtgcctgtagtcccagctactcgggaggctgaggcaggagaatggtttgaacccaggaggctgcagttgcagtgaatggagattgcaccactgcactccagcctgggcgacagagcgagactccgtctcaaaaaaaaaaaaaagggcaaagaatttgaagagatatgtctccaaagaaaatgtgcaaatggccaaataaacacatgaaataaacacatgaaaaggtgttgaaatcattattcattagggaaatgcaaataaaaatcacagtgaggccaggtgtagtggctcattgcctataatcccagcactttgagagactaagtcaggaagatcacttgagcccagaagttagagaccagcctgggcaacatagggagataggcgtggtggtttgtgcctgtagttccagctagtcgagaagctgaggtgggaggatctgcttgagcctgtgccgtcgaggctgcagtgagcagtgatggtgccactgcactccagcctgggcggcagagcaagaccctgtctctaaaataataaatgataataataataataatagagataccaattcacacccactagaatgactataataacttaaatctcaaaaaaaaaaaaaacccaaaaaacaaaaccccaacaactgttggtgaggatgtggagaaatgggaacccttatagggttccttactgatagggatgtaaaatgatacagatactatgggaaacagtctggcagttcctcaaaaagttaaacatacagttgccatatgacacagcagttccattcctaggtcatcccaagagaaatgactacatatgtccatacaaatacttgtacatgagtgttaatagcagcaatattcataattgtaaaagagtgggaacaacctaaatgtagatcagctgatgaatggataaacaatatgtggtccagccgggtgtggtggctcacacctgaaatcccagcactttgggaggccgaggcaggtggatcacctgaggttggaagtagaagaccacctgaccaacatggagaaaccccatctctactaaaaatacaaaattagccgaacatggtggctcatgcctgtaattccagctacttgggaggctgaggcaggagaatcgcttgaacctgggaggtagaggttgcagtgagccgagatcatgccattgcactccaacctggtcaataagagcgaaactttgtctcaaaaaacaaaacaaaacaaaaacaaaaaccagtatgtggtccatccatacaattcagccacaagaaggagtgaagtacagattcatgctgcaacatggataaaccttaaaaacattatgctgagtgaaagaagccacgaaagatcacatattgtatgatcccacttatatgaaatgtttagaacaggaaatccatagagatagaaaagagataaatggtttctaggagatggggagggaggcaattgggaatgactgttaataggtatggggttctttttaggtgatagaaatgttctggaattagtgtagatggttgcaaaatgtgaatacactaaaactactgaattgtatactttgaaatggtaaattgtatgctatgtcaattaaaaaaaagtataggccaagtgcagtggctgaagcctgtaatcccaggctttgggaggccgaggcgagtggatcacttgaggccaggagttcgagaacagcctggccaacatggtgaaaacccatctctattaaaaaaacaaaaactggctgggcgtgttggtacatgcctgtcatcccagctactggggaggctgaggcacaagaattatttgaatccaggaggtggaggttgcagtgagccaagatcacaccactgccctccagcatggtcaacagaacgagactgtcttgaaaaaaaaaaagataaattatggtatttgctttggaattaaataattagtaacttttagtaaggtttggtaaaggtttagtaacctttagttaacccagttaacttctgtgtcttatatttgtctttgtactgaagtagttgaatgccactgacccacagaatgagttgccagagaactggagcaacattctgtttgtgggaaagagaatactctgttactaccttaatattagattcccagcatatcaattgaagggttttaaatagtgagtgatgtgtttcaatttatatttatattatatttacacttgatcttagccaaaaggctgagaaagcgattttatattatatttataaagatcactttagctttctcctggagactggattggtagggacaaggtgacattggtgaacttggttagaaagtcagtcaagcccgtgtgcagtggctcacgcctataatcccagcactttgggaggccaaggcaggtagatcatctgaggttaggagttcgagaccagcctggccaacatggtgaaaccccttatctactaaaaatacaaagattagccaggcatggtcgtgggtgcctgtaatcccagctactcaggagattgaggcaggagaatcacttgaactcgggaggtggaggttgcagtgagccgagattgcgccactgcactccagcctgggcgacagagcaagactcagtctcaaaaaaacaaaaacaaacaaacaaaaaaccagtcagtactctagggaagaaataacaatagctatattatgacatagtagtgagttgaagataactgaatagccaaaatatattttggagatagtttgatatgagaggtgaggaaaagtaagtagtcatgtgtggctctttgtttctggctttaataactccagtagttctggaagagacttagtgggaaacattttggataaactgagtttgtccaaatggggttgccaagtggagagttgagtaaatgaagctagagctcaggaaagatgtggaccagagttataagtcatatttatttatttatttattttgagacagagtcgtgctctgtcgcccaggctggagtgcagtggtgcgatcttggctcactgcaacctccgcctccggggtcaagtgattctcctacctcagcctccagagtagctggtattacaggcacgggccaccatgcccagctaatttttgtatttttagtagagacgggggtttcaccatgctggccaggctggtctcgaactcccgaccttaggtgatcctcctgcctcggcctcccaaagtgtttggattacaggtgtgagctactgagcccagcataagtcatatttaaaacaatgggaatgggtaggaacacctagagatagagtgtgggaaatagaatagggtccagtatacagctgtgccaaatttcacatgtacaggttagatagtggagtgggtcagttctgttgggaatgccctgaaagtttgaataatgataagcacgtccttttaacatcatgaggtagtggtgacgttgtaagaggagtttcagtgtagtgggttgtcatgggttaaaacgttcagattgtcatgggttaaaacgtgaattggatatgaggaagtggagtgcacaaagatagttttctgaaagttttacttggaagaggacaaaaaattgagacgacagtttgaggaggatgaaaggtcaagaattctaagctagtgataaaaatttcgtcaacatcaatgaataggtaatgtaaacacattaatcctgggatggatgtgagaagagcaaagaaaggaatcctgggggaatatcagctctaaaggttgagtagagaaggaaggagtgatctgagaggtggaaggaggagtaggaattatcatagaaactttaagcttcttgagggcttgtgactgtgtcatgttcatcattttatctgaagttcttatcaacaaagtagctttcagtaaatatttattaaatgaagataaaaattttaagagccatctgcaatgtcaaatgtagcccacagttgaatgaatatgaggacagggaagtgtcccttgattttggtgttaagcagctgattgccaccttctgtagaacagcttcagtggagtctccataatagaaataaatgccaggttgctgaggactaagcgtggatatttgttgagagtggagacagtaagtgcaaacattcttttcagaaagctttgctctttttgaagctttgctcatagggagatacaagatagtaggtagaggggcaggctgtgtttagatgagagagacttcagcatgtttatatgctaaatggaaaaaggaaaaaggaagggagaagttgaagatgtagaataaaggaggtgtgtgtgaatgattgtacattgtctttgaggttagtgggaatggagtgaagatactgggttgcagtacagatgagaatacagtttccactgaagtaggaataaaggaacaatagatggtgcagatggggaagtgtttgggtggcaggtgagaattcgggatatgaacactttatttttttcagtgaaggggggataaggtcatccactgagatagtggggaggaaatgatgattgtaggggactgaggagaaaaggagaatttcaagaaagcctctgagggaggtgagagggcaagctgagtgggaatacttagaaaaaatggaatcatggatttttcacggctgtggtatatatatttgtatgaatgatctcctccttctctcagggctcagcagcctgggtgaacacacaattgaacagttggattgatcttggcctggattttatgtgtcagtgtgacagagagggtaaggaggcaagatatttcagtagcgagagtgtttgaagtggtgggccattgagtctaggctgaatagggaacaaatgaaaccagaaggtggctgctgggacatgaagtggttggtgttcaagactggatagtggaattgaagattgaacgggaggagcagttgctggttatgacagagtacaggatccagctatggagtgggtttatgaagtagagacaacgttcccaagtctttagtgaacatcagagagtgtcatctgttagaactttagctgcggccgggcaaggtggctcatgcctgtaatcccagcactttgggaggccgaggtgggcggatcacctgaggtcgggagtttgagaccagcctgaccaacattgagaaaccccatccctattaaaaatacaaaattagctgggcgtggtggtgcatgcctgtaatcccagctactcgggaggctgaggcaggagaatagcttgaacctgggaggtggaagtttcggtgagccgagattgcaccattgcactccagcctgggcaacgagtgaaactcagtcttaaacaaaaaagaacttttgctcaaaggcaggtggtagcagataagagataaggaaaatttagtgaagaaaaattcagtttttaaaaacgttttaggctgggcgtggtggctcacgcctataatcccagcactttgggaggccgaggtgggcagctggcttgagcccaggagtttgaaaccagcctgggcaacatggcaaaaccttgtttctacaaaaaatacaaaaaattagtcaggtatggtggcatgcacctgtagtcccagctacttgagaggctgaggtgggaggatctcttgagcccaggaagttgaggctgcagtgagctgtgattgtgccactgcgctccaacctgggcaacagagggaaaccctgtctcaaaaaaccccaaaaaacaaaaaacagcattttattttggtgatggaattctctattgtttcgaagagttttgtttgttttaaagacattaaccagttttctcgagggatattctatgaaaaagtgggttccatcatccaataagtttgagaaactgcaaactctatcccattggtaattcacaatgaacctcaacttagattaataaaggctctgggaaatgatgttactattaatgatttaacctttattgagcactgtctaaggctctgttctaaggctcccacgtgcattattgtttccagtctttacagcaactatctcatttaagttacactgctaagctagaatggaagagctgggattcaaatccagaaagacttgctccatagggttctcaagcctataaccagtatggaaacaggcttgacattaaatccagcatttccccatcttgtttggttatggaaccttattatcttttagtatttatagagagattagtcagttgtccacggcatggaccctgggaagtgttgcctgagtcagtttacactggtgactgcagtcttttaaacagcattgtttcagactataactagttttttctaacttggttctctgttgataatacttaaatgttatatttatttttctatttgagagccttatattttgacttcaaggcattttctattccctttcacaatgaccttcccaggaatcaaagatattgtcaccaccacacattacatttgagttactaaaacagtttataatccaaatagctatttcactttcttttctctggtctaagattatctcattgtaatttgttttttaaatttagagacagggtcttgctatgttgtccaggccagtctcaaactcctgagtagctgaaaatataggcatgtgtcacctcaaccagtttattgtaaaattttaatgtttagagatcttggagatcatcttttatttttaacagtatttatttagttttgcaggtagagaaaatgacagctgtgtagtgctgtggaaattataataattcatatccaagcttgaatgtcagctccacctctttactatagctgtggccttagaaaacctacttcatttcttgaaacttgtttcttcctctaaaaagatgaggataatatcttgcagggtggctatgaaaattaagacagttcatacagtatctggcacatggaaagttctcaatgttaattacccatttttttctgtttaaggaaatagtctcaatcctataccatgaatgaattatgaaaatagttggaaaggaaacaacagttttaaatgtaaactgtctcagtcttatgctgacatcagctacatttctggtaaagtgatggtgtcatgatacaggttatattaagagttaaaaccagtttccttctggctttccaactgacataataagcaaaacctgcctgggcaaacatagacctatttattggctcacttattattaatgttaaactagctttggtgctgacttctgttcttgttttaaaatttcactgttgtcatttaaaatctgacagaccttcagaagcttcatagaatgcttaatggtttaaatcgtctctagaacatgtgaagtatcttttccaaagtggttttctccatctgtcagtatgttcaaaatcatgtgtatagggccgggcgccggtggctcacgcctgtaatcccagcactttggaggctgaggcgggtggatcacgagatcaagagatcgagaccatcctggctaacatggagaaaccccgtctctactaaaaatataaaaattagctagccatggtggcgcgcacctgtagtcccaactactcgggtagtcccaactactcggaaggctgaggcaggagaatcacttgaacccgggaggcggaggttgcagtgagccaagatcgcgccactgcactccagcctgggcaacagtgcaagactctgtctcaaaaaaaaaaaaaaaaatcatgtatataggacagaattgcttatattttcacaattactactggatgcctgtttggttttcatagcaatcaacttttggagtttatgggcagtacttaacatatataacctaagtgtggataattatttaaaataaggctactggaagaaaaatctatagggatttctcagttttcacaacagcatcctgagcaaagaaaaaataggttggtttgagttgtatgtgatgagatttctaatattctattcgaaatgccccctagtaagcactagtgataggtattaatgagctgaatttgatttctagttccaactctgtcccttgcaacttcggtaaccttgaaggtttgtctacgtttcagtttcttcatatgtaaaagagattaccaatatttccctcccaaggctgctgtaacagtgaagtgttgaggtatttatttatttatttatttatttatttatttttttgagacagagtcttgctctatcgcccaggctggagtgcagtggcatgatctcggctcactgcaagctccgcctcccaggttcatgccattctcctgcctcagcctcccgagtagctgggaatacaggtgcccgccaccacgcccggctgattttttctatttttagtagagacagggtttcaccgtgttagctaggatggtctcgatctcctgacctcgtgatctgcccgcctcggcctcccaaagtgctgggattacaggcgtgaaccaccgcgcccggccgtgttgaagtttttaatatagccagcacagcatgtggcacatagtaggcacacagccattgcatgtttcttccagacatctcactgcatttttcagtaatattcttttcaagtacgttcttctttctcattccttaacatttaaaagctgtattgaagagagaatattaatgtttgcgaagtaaactgaaaatatttcctttgcagcccacacttgagtgttttaggccgggtgcggtggctcacgcctgtaatcccagcactttgggaggccgaggtgggcggatcacctgaggtcaggagttcgagaccagcctcaatatggagaaaccctgtctctactaaaaatacaaaattagctgggtgtggtggtgcatacctgtaatcccagctacttgggaggctgaggcaggagaattgcttgaacccgggaggcagaggttgcggtgagccgacattgcgccattgcactccagcctgggcaacaagagcgaaactctgtctcaaaaaaaaaagagtgttttagcaaaaaatgattttatgtatgacataccttggtttaaatcctggctttttaattttaattttttattttttgagacagggtcttactctgtggcccaggctggggtgcagtgatgtgatctctgctcactgcaacctccgcctcccaggctcaggtgattctcccacctgagccacctgagtagctgggagtagaggtgtgctccactatgcctagctaatttttctatttttagtagagacagagtttcaccatgttgcccaggctggtctcaaactcctgggcttaagtgatccaccagcctcggcctcacagtgttgggattacaggtgagagccaccaagcccggcctgaatcctggcttttgaatgtaatagtgttgtgaccttaggcaagctgcttaacctatccataaatattatgaggctaaagtgagtaatagtatgtgtaaaacatctagttcattgtctggtttgtatatttccaaaataaatgttattattttaagtggaaactgttgtttaatttgataattcatataattcatggcttttgagagcctgctctactcaaagcccgttaagagcaggcaggaacattgtgaacgaatgttgggcatattattatgcaagtgactgaatttggctttgcctgtaatcaggttcagcaaaagtggtattttctttctttcttttttttttttttttttaattgagatagtctcgtcctgatggccagactggagtacagtggtgtgatctcggctcactgcatcctccgcctcctaggttcaagcgattcttccacctcagcctcccaagtagctgggatcacaggtatatgtcaccatgcctggctaatttttgtattttttgtagagatggggtttcgccatgttggccaggctggtcttgaactcctgacctacagtgatccgcctgccttggtctcccaaagttctgggattacaggcgtgagccactgaacctggccaaaagtggtattttctattgcatttgaggtaacagaaattgatgggcttgttattgcatttggcgtggctggttttttttttccatgttgtctttctccactgactgtcaaaaaaaaaaaaaaaaaaaaaggctacattcatgagtgccacaagagagattcatgattcccaagtgctacagcagaccaaggtatctaaaaagtttttcatcttttgctgatcttgtttattagaaataaatatgttactctcctgtattaaaatttaacacaatattggcaagctaaatttaatcaaatattctgcccattttaaaattcacttcctagcctgtccatccttccttttattttgttgttgtttgattttgttttattgtatgcttttagcagcctgaagccatggtttttagtttctgtctgtagtgataagtggaaaggagggatgaggaaggggctttactggcccaaccagaaatagaaactaagaacccaggactgtattatctcccttggacacccaacactatataaaattgattcctgccctggcagactaagcgttggaaagctggtgctaagagtgttatgagaattcctaataaatagaaaagctcaaggattgacactatagtaaaagatttcattttgacatgtttataatttacttatcaagttaacaataaggtgtttttatttatttatttttgtttatttttattttattttttgagacggagtctcgctctgtcgcccaggctggagtgcagtggcttgatcttggctcactgcaagctgtgcctcccgggttcacgccattctcctgcctcagcctcccgagtagctgggactacaggcacctgccaccacgctcggctaattttttatatttttagtaaagatggggtttcaccatgttggccaggatggtctcaaactcctgaacttgtgatccacccgccttggcctcccaaagtgctgggattacaggcatgagccactgcacctggcctttttttggtatttttagtagagacggagtttcaccatgttggctaggctggtctcgaactcctgacctcaaggcctgccttggcctcccaaaatgctgagattacaggcatgagtcccaataagatttttaaagggataccaaaataatcaacatttattttagaaggtgactttcttcaatgagatgtcaatgtctactttctgttatatagtgctattgtttcttttttcttttttttctaagtgagggtctcactctatcacccaggctggagtacagtggcatgatctcgggtcactgcaaccttcacctcccaggttcaagcaattctttcacctcagcctccagggtagctggaactacaggtgtgcatgcctcgctaagttttgcatttttagcagttgttggccaggctggtgtactgtttcttttattgattgagttctatatttacacagcatgaaagtctcagttgcattaagtacattcgcattgttatgcaaccatcaccattatctagttccagagttttgctgtcaccctaatagagcttgtatatatgtctccaccaaatcttatgttgaattgtaattcccagtgtttgaggtggggtctgttgagaggtgtttgggtcatgaggcagatccctcatggcatagtgttgtcctcgcagtagtgagtgagttctcacgatctccttactccatccacctgcttctcctaaaactttgaaatatgcttggaattgaaagtgtttagtttgaggatagttatctaaaagtgacatacagggctcctgctttgctcttccttagtaaatttcctattttattacacagtttactaatacagaggactagagttttgttatttccatggaaaacattattgaatctaaatttaactagagatgtgtagttcagggagggagagtggttttataatatgaatcttggatttgaaatgaacttaaagcaaatgaataaaaattgtttcattaattataatgtctgaaataatgcatgtttttgtgaataaaaattgatataataaagtttaaagtgacaggagtagatataactaattgtatttataatttcttggatgtaaaataacatttttgaaaaatattatacaatgacctcacatacagtgacctcacttaatctatgtgaggctatacacagtggctcatgcctgtaatcccagcactttgggaggctgaggcaggtgattgcttgagcccaggggcttaagaccagcctgggaaacatggtgagaccctgtctctacaaaaaatacaaaaatcagctgggcatggtgaggcgcacctttggtcccaactacttgggatgctgaggcaggaggatcacttgagcccaggaggttgaggctgcagtgagctgtgatcgcaccactgcactccagcctgggtaacagaatgagaccctatctcaaaaaaaagaaaaaagtctatgtggaagataccacgttaattgttttgggtggtttagagatgtttctgtctccttcactgatgaccatgtgtctctgctgctgtcgctcactggtgattatcaactcaacttcttacatttgttttaacaaatatttatacaccctttgtaaatttgcatgagataaagtcattatagttaaaaaaattgtttttttttttttttttgagacagaatcttgctccattgactaggctgagtgcaatgacatcatcatggctcacggcagcctgaacctcctgggctcaattgatcctcctacctcagcctcctgagtagctgaaactacaggtgcatgccactatgcccagcttgttttttattttttgtagagacagggtctcactatgttggcaggctggtctctaactcctgggttcaggtgatcctcctgcctcggcctcccaaagtgttaggatttcaggtgtgagccaccatgcctgtcctatgaagtcattacaaagaaattaaattaattggtttcattggcagtattgaatttcaaagcagaaggggtgcttaagagaaataatgcctttggagtaatttctgatgctagatgaaactcatatctcatttaaggtgtccatctgaattttatgtttggatgattatgaattattccttaaagcttgaagtgaactctggctctctaggacaaattaatctttattcctttaatctttattcccttaggtatatattaaagggatcaaatttttttttagagtaatgtaaaattaagggacttcttttgttaggtgaatttctcaggttttaagatatcagtatcattgtggacattgactacattgtctactaaattctgtaattttaacttataattctcagtaattggctgggtgtggtggctgacgcctgtaatcctagcactctgggaggccaaggcggcagatcacctgaggtcaggagttggagaccagcctggccaacagggtgaaaccccgtctctactgaaaatacaaaaaaatgagccgggcgtggtggcgggtgcctgtcatcccagctactggggaggctgaggcaggagaattgcttgaacccaagaggtggaggttgcagtgagttgagaatgcgccattgcactccagcctgggtgacaagagtgaaactccatttcaaaaataaataaataaacaataaaaataaaaatacaaaaattagctgggcgtggtggcgggtgcctgtaatcccaactactcgggaggctgaggcaggagaatcgcttgaacccgggaggcggaggttgcaatgagccgagatcacgccactgcactccagcctgggctacaagagtgagactctgtctcaaaataataataataataattctcagtaatttttgcaatttttttggtacctaaaataatttctgttattgtgttggataactttgtcaacttcactttgggaatatctaaatataggtagctgcattcgagccagaggaatattgggtttttttgttgttgcttatttttgaggcagccttactttgtcacccagactggagtacattggcacaatcatggctcactgcagccttgaccttctgggctcgtgtggtcctcccaacccagcctcccaagtagttgggactaaaggtgtgcaccaccatgcctggctaatttttaaatttttttgtagggatggaattttgctatgtcacctaggctggtttcgaactcctaggctcaagcagtcctcccaccttggcctcccaaagtgctgggattacaggtatgagccaccacacccagttgagcaatactgggttttaatcaagattattgtctgaatattgagtcttaatgacttttttgattttgtttttttggccatagtattaagtttgcagttgataaccttctgtactaactagaagtagtatagaaactgcaaattaaaaaaaaaccccaggtaaaatgttgatggctgctatttttatttaaggtattagtaaaggaaaagaagtcagggacattatggaggtcaagttttatattattaaaactcaacttcatgatttatacatacttagaaatagtctgagtgatgtgtgaccaaaatatgatttctaggaggaatgattgttacatccgtggaatagctgcgtacactttattgttcttggtgcttaaactttagttgtcctgctaagataaaggaagacattctttcagttggaaatcataatgtatttctccattgaaacagtatggtttgaacagtgctatatattcttactcattattattccttaaatgaatattttaagctcctgatagaaggcaggtactgtgttatatgctgttggtgttaccagaatacaaagatgaagagaacaaagtattacacaattcctaatctcacataaatgctattttttttactagctgtggggagcacaaaataagtggttgaaagtcatctgacacagttacatttattcctttccttttccatggctcttaggaataaattgttctactctatggattaaattgccctttgtttattgcctgggatcccaactttatttcataattttatttctttgaggaaacgtttcacaagttttataacaaagtataactcaatttggagagcacaatctgtgcataagttggaggctacctattgtgaaatggaaaaatgcttgtcctagcattactaagttaatgtatagctggtagaaagttttcacttttaattgctaacttgcctagtgagagtgaaagattgattacggcaactaaaaagtataaaaactactgagtagtttttaggtacagtcagttcttcagtagaacaagaatctttagaaataactttcactaattctttactagttgtttttcctatttctcttggatatggatcatcagaatgttttttgtccctcttacccgcccccccccaccccgtctgccaccccccgcctcccacttttttgttgggaggcttatgtgagagcattagaggccttgaatgtttgggtagacaaggtaagtattcaaataaacatttcaagatcattgtgacagtgaaattatttgatatgaaaaaggatctcagttattagaaaaaacacaactgtgttaatactgacagccagcgttgctataagtgttttatgtgcattatctcacttaagctttacaacagtcctaagagaggaatgctgtggttattacacccacttgacagaccagggagcagaagcacagaaacccaaggatttctgccgtcagtgtcatgcatttggctggagttatgatgtcgtgcaagtaatgttccttctttttccctctaattcatttttatgtttttcttttacagggcaattttgtaagatttagtttccaggggtcaggtttgtttgggttttatgtccttgggaaatcctcagtaccttatttcccatattccatattttttaaccttaattttttttcccctcaaatgttatacagtttaatgagtcaagtggtctttcagggattgttaaaacaaacagtaattctcagcttccaccttcatttcctcctctcataggtaaccatcctcaactcataggtatttggaatttacctgtggtttttcaagaaacatttaaaaaattgatttacttgaattttcaggttagaacataaattatttgcatgatttgctgtgtccttgtgactaactcaaactaaacattctatcagttgtccaaatttcccattttctttcaaatttcccatttccttcacttactttgtcagtttcatcatcttgaagaagccttttccagagcacagtgctccaacatggagtagtctctgttttctcatagtgcccagcaattatccttggaattctcttttcttttctcctgcattggcacttctgtttcttctcctcttatgtcttcctgtttcatgggaggcaaatatttgataccttatgttttttgaaaacactttattttcctctcacccttcattagtggtttcactgtatgtaacattgagattgatgattttgctccattgtcttctagcttgtgttatgcctgttgaaagtacaaaatcattctggaagcttatctattgttagctatttccctcttctggaagcttgtaggatcttccctttgtttccactgttctgaaacttgtaaatgatatgctttaatatggttgtactgtattttaaacaattatgctctgcactcagtgtttttttgttgttgtttttgttttttaatttttaaatttatttatgtatttttaaatttattgtttttgtttgttttttgagacggaatcccactctcgcccaggctggagtgcagtggcatgatcttggcgcactgcaacaacctccgcctcctgggttcaggtgattctggtgcctcagcctacccagtagctggaattacaggcgtgcatcaccacgccaagccaatttttgtttttttgttttgttttgttttgtttttttgagacagagtatcactctgttgcccaggctggagtgcagtggtgcgatctcggttcactgcaacctccgcctactgggttcaagccattctcatgcctcagcttcccgagtagctgagattacaggtgtaccaccacgactggctaatttttttgtatttttagtagggacggggtttcaccatgttgggcaggctggtcttgaactcctgacctcaagtgatccactcacttcggcctcccaaagtgctgggattatgggcgttagccaccgtgcctggcttcactcagtgttttcagttaggaaacttacattgtttagttttgggacattttcttgaattatttcactgattttttttcctctctgttttctcccgtggattccccattgcatagatgctgaattatcttgactggacctccagttttttcttctttattctgttgccatctctttgattccttattctttctgataaattttcctaagtttaatttccaagggctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaacctagctaacttttttgatttttagtagacaaggtctcgctgtgttgcccagactggtctcgaactcttaagcgccaagcatttctcttgcctcagcctcctaaaattctgggattacagtgtagtatcttctgtattctttccatggacactaatgatggggtataaaattccttttatttatttatttttttattgacatcagaaattcctgctaataaaattctttttaaattttaagtttttttcttcccacagttgtccgtgtttcctccaagttccttttctattttttgttttcctttgttttctttttgtggtagatgctttcctcagatgagtggtaatccttgactatttgcagttatgcctctaaaagctgattggaagctcttagtacctcattggtacttgttgagtagagttcactctggggtgatctatctgtgtcatttgctggggcacccttcatgtcagcttctgattacttttcccttttctgaaaagggagaggtcttttaatttcctgtctggtgggaggaggtctgtatgccacttctgtgggagagtgagggaagtagggcagtgaggatttcagtattcagtacatatgtgttttcttaaggcttctgttttcattaagcctcccccgcaccaatgtgctttatgtttccctgctctgaaatcctcctgagggaataatcctctagaattttgccttggtgggaaaagcgtagtaacctaaccatgtggtatttaggaaggtactgagagattgagcgtttcctaaggagctttcagccagccttctttatttagtgctcccttcacacctgtttctacaggcgctatctgttaccagttcctgagccttttgaggattctgtggacgaaggttggtttttggctttccatactgctggtttcttggatctgctatgtcagttaccatttatgcatttgctttctagcttttaaattttgtttatgccttaaaaatacctgatgagggccaggcgtggtggctcaggcctgtaatcccagaattttgggaggtcgaggcaggtagactccttgcgtctgggagtttgagagaagcctgggcaacatagcaaaaccccatctctactatagaaaaattaacccagtgtggtggtgcacgcctgtggtcccagctacttgggagtttgaggtgggaggatcgcgtgagcctgggatgtggaggttgcagcgtgctgagatcatgtcactgtactccatcctgggtgacagaatgagaccccatctcaaaaacaaaaacaaaaaccccccaaaaaccttattagtattttagcacaatttggggaagaaatgaagttaaatatatgtatgttccatcttctctttacccagaacttatttctaattttttttttgttaagcatcttttttgttgtggtaaaatatacataaaatttattatttataagtatacagttcagtgacattaagtacattcacaatgttttacagccatcactactttctagttctagaacttttctatcacaccaaaaagaaaccccatactcattaagcagtcactccccattccctccctccctcagcccctggaagccacgaatgtgctttttgtttctatggatttgccttttgtggatatttcatataaatgaagtcattcagtatgcggccttttgtcacatgttttcatttaccataatatttttgtggttcatctatggtatagcatagatcactgcttccttcttttttatggctgaataattttcattgtgtggatatatcacattttgtttatctgttcatcagttgatgaacttttgggttgtttctgctttttctggctattgtaaatagtgctgttatgaacactgatgtacaattttttggggtgaacatttgtttttattcttttgggtatatacctcggtgtggaattgcgggatcatatatggtaattctgtctttaacttaatgaggaactgccaatctgttttcctcagtgactgtaccattttatattcctattagcaatacacaagtgtcccaatttctccacatttttgccgacactgttttccattaaaaaatttttattgtagtcattctagtgggtgtaaagtggtatctttttgttttgatttgcatttccccagtaactaatgacattgagccttttttcatgtgcttgttggccatttgtatatcttctttggaggaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgtcagaattggtgtcatttgtgtttatttaccaggttatttggaaggattatattttaggtgctctcctctcccccagtaaatggtattatgacacaagggttataaaggactgataagaaattacttaagacagaaagggaagttggcctgcttccaaaatatggtcccagcagaagtgaagttagttacacaaataactacagtcaaaaagctatttttatccatgataatgtatttgttgttattaatattaaagattatattttgccaggtgcagtggctcacatctataatcccagcactttgggaggcttaggtggatggatcacttgagctcaggagtttgagaccagccagggcaacatggtgaaaccccatctctacaaaaaatgaaaaattaaccaggcttggtggtgcgtgcctgtactcctagctacttgcgagtctgaggtgggaggatagcttgagcccaggaggtcaaggctgtggtgagccgagatcgtagcactgcactccagcctgggcaacaggacaagaccctgtctcaaaaacaaaacgaaacaaaacaaaacaaaacgactatatttctgcattaagtgggggtatagaatcctatctaatatttgagataataattgttatagtattttattgagcttttattgggtaccagatgtgttctaagtttttttcatgaattattttcgttaatcttattcattgttgtgtcctgaatgagtactcacatatttgttgaagggctcaatggtccctaaaaccttacatgctgttttggaaggttaacttgccaaaggtcacatagttggcaaatgatgaagctgagattaacattaagatctgattccaaagtagtctttcttaactatattgctttatgtggagttttgtcgctgatatctagacagaaagtctctagcaatggaaaaaaaataatttttaattaattttaatttttttagtgttttgcttcttttattttttttattttgtgagccaccgtgcccaattggtttcttttaaaagactagttagcttgtgctttaggcctcttgattactctgaggtatttaattaatatctttgaaatcctacgatttactgtatcacttctgcaatatctaaatttttccttcttacttatttctgttctccttctacagtcctttctattatgtttaatcatcaaaacattgttcttgttttctactgcagtctaatttttagtgttatgctgtttccagatgccatttgggtcattttcaaaaaaagatgagtaataattagcaagtaatgaatattgttctttttaccattcattaagaacaattgttaattgtcttattctattgtgaagaatatctgtaattcctgcttagaacctgggttgatagcaggatctcaggaagcacgaagtgtacacagaacgatatagctggaaaaagtatatatgttaaagaataatatgttgtctaaggacagaatggaactgatcacacaggttcttttttggtaagcttcaaaacttcttatctcccataaaagtactttttcttttataatatgcaacaataactttctgtttagttaattagttttaaagcaagcttaaacttataatttataaagaatcatatttgctccctatcattgttttatagctggggctatactgacaaataagaaaaataaaattcctgcccttgtggaggagacagttaaacaatgagacaaatacatttcagatggaaatgaggacaatggaagaagagtagagcaggatgaaggcatgaagggtgactgagagctggtcaatctttagatagtgtaatacaggaaactgctttgaaaagatgacttttgagcagagatcttaatgtactgagggagtgaaccatttgaggtctggggaaagaattcagcttcctcttcagatgtacaaaattataagatattgccattcttgtaactgaaaacctataaaagcaggataagaagtacggtttctaaaaacccatctaagagctgaggatacaagggaacctaaatgaaccaaactccagaaagtaatcaaactttcgtagtagagaagaaacccgtggttgctctaggatggaacaaccaaaggaataggaatccaccatagatgaggggaaaggagaaaccagccacatttttttaaatcagatttttaatggccacgtatgggctggtttgacaggttaggatcctgagaagccctagcaactctagcaccaaagagcaagtatgcacccacactccagctcctacccacagatgttcactgaatgttcaggagtagtaagccaaaagcctgggccagtgacgaactggcatagataatacctgaggcatttggaacctctcccaggtatagggcaaccacccttagaaggcaggattgctgagagaaatccagcagaggcactccaggctttcagttctggaatgctgcaggcaggggaagagctagagataactctcaccccacactctggcagtccatgttttcagccaccaaggactggggacagggcagaagaggtgagtgaaactgctctaattcatttcaggccttcacagaatgtaaggaagctggcctccagaaggctggctggagaggaggagcagggctgcacgagggcacctgagcttcagaaagcaaggtgtgcgactggagagcaaggagaatctagcaaaccaaactctgaccgtcgtgcttaatgcagagatagagctcctacagtttttttttctttcttttttaaaatataaacttgaatttttgaaatagtttcagatttaaagaaaaattgccaagatagtatagagagttcccatagatgctgcctctagtttttcctatttttatttaatttattttttttttagtttttcctatttttaacaccttatattagtatggtatatttgttataattaatgaactaatactgatatattttcattaactaaagtccatactttatttacctaatgttttgggatcccatttagctgtcacatctccttagggtcctcttggttttggcattttcttagacttgagcttctcatctcttgtttttgataactttgacagttttgaggagtattgttcaggtattttgtagaatgtccttctattgatatctgtttggtatttttgtcattgttacagtgaggttttatatttttgggacgaagaacatgcaggttaagtacaattttctttcctttttttgagacagtgtctcactctgtcacccaggctggagtgcagtggtatgatgacagctcactgcagccttgaactcctgggctcaacgcgatccaccctccttagcttcctgagtagctgggactacagatgcatgccaccacacctggctaattttttttttttttttttttaatagagacagagtctcactgtattgcctaggctggtcttgaactcctaggctcatgcaatcctcccacttcagcctcccaagtagttgggactacagacatgtgccactatgcttggcagtaccattttcatcacatcatattaaggggacatactgtcaatatgactaatcggtgttgctattgaccttgatcatctggttgaggtagtgtttgtgtatttctttactacaaagttactcttttttctcctctgtttacatactgtactctttggaaggaagttacatatgcgcagcctacacttaaggcatggggagttatgatacccctcctcaagggcaaagtgtctatataaattatttagatttcttctgcatgggagatttgtctcttcttcctcatttatttatccattcaattttttaaatattagtatggacttatggatattttataccttgggttaaaatcttattattgctttatttattttattggtcaagttgttccagctttggccactgggagctctttcagttggtatgactttttgatataccactgtcagtgtatgtgtgtgtatgtgtgtttgcactttctcactttctggcactacaagatgcgctagtatatttagagactaaagcatgtagtatatgctttagtatatgctttatctagtatatttttctgtctcaatcctagaattagccatttctccatggagccttggttccttttactggagaatggagaaaccaagatctaggtgctaggtgcacatgttgctactggggtgttgttgcttgtaggccatctcagctgacagagccagaaaatgtatgtatttatactaccctgtatatatccacatatctataaatatttctatatgtatccatctgtatctaattaagctaaacatgagtttatattgatgtattcggttccagttgaatcactacatggatgattctaacttcctgcccttgcttatctaaaaactcctgctccaatagtgagaaatctgtctcctaccatcagccacccatttacttaatcattctactctagcatacatgtaaggtactcccacagttttaaaaattggtggcttggctatgaaacacaagcaggtctctgtaattttacctaggctcagatcccagacctgctcaagtgaaggacttgatctcagtccttaaatatttgaagccagtgattaactgtcaaattacagctgcatcatagcccacacccagctcagttacatattggattgactcagactcccttctagtgtcctaacagaaaaattgtcgtgtctttttctggaagtaaaatattacttaatttaataagtaatctatttttatataaaatgtctggtgtgtaataaaaagttacaagacacaagaaaagcaagaaaatgtgaccaaaggtcaagagaagaaatagtcagtagaagaagacccagagatgatccagatttatcagaattatcagacagggatttaaagataattatgaaaaaaatgctggatgattgaatgataaaggttaacaatatgcttgaaaagatggggatttctgtagagtcatggaaattatgccaaagaaccaagttgaaattccattaaatagaggtgaaaaatatactagcagagaccagagaaaacaaaaaaaggaaagaaaagaaaaggaaagggaagggaggggagggaagggagaaagaaaaatatactagcagaaatgaattcattacatgggcttaacagtttatggacatagcagaagaaagaatcagtgaatatgaagacagattggaaagagaaaagacagaaaaagtcagggaggggtagaaaagagattttagatctgtgggataatatcagatggtctaacatatatgtaattggagtttcagaaggagagaagagaatgtggcagaagacatatttgaagagacaatgctcaggaacttctaaaattgatgaggtcatcaattcacaaatggaagaagttcagcaaatcccaagcaagttaaatacaaaacaaaaataagccaacaaatttaaaaatcccatatataggcatatcataatcaaactgctgaaaattgaagatggaagagatcttacaagcaacaggagagcaacaggagaataaaggcacattagttatgtgagaatggcaacatgggttatggctaatccatgttttcagaccagaaaaaaatggagtcttagctgagcatggtggcacatacttgaacccaggagttcgagtccagcctgggtaaagtagtgagaccccatctctatttaaaaaagaaaagaagtccaggcatggtggctcacacctgtaatctcagaactttgggaggtgggcagatcacaaggtcaagaggtcgagaccatcctggccaacatggtaaaaccgcgtctctactaaaaatacaaaaattagccgggtgtggcggtgcacacctgtagtcccagctactcgggaggctgaggcaggagaatcacttgaacccaggaggtggaggttgcagtgagctgagatcacacgccactgcactccagcctgtcgacagagcgagactcagtctcaaaaacaaagaaagaaaagaaaagaaaaaatagaatgttaaatacaatgggatgacatccataaagagctgaaagaaaaaaaaaaaaacaacctgttaacctagatttctatggccagcagaaatagccttcaaaaataatggcaaaataaagacttttgggacatatcaagaagggaaagaatttgtttccagcagacctggactcaaaaaacattaaaacatacacattaacaagatgtgggttttacagcatatatgtgattatacaaccatgaaagaacaaaaaggaggagatggaattatactgtcatatatttcttactctgtgaaaggagactgtagtaacttctggatgcatatgtaatctctagaacaagcactaaaaacacaaacagggataccataaagtcagtacatctgcctaagagggattaactgctacaagaatcattctcctacagtaaacagctagaaaacaggacaaaaatacatgaaacaactgttttcagacattggacaacaggcagcacaggatagtgatccctgagagaagggaaataactgatatgaaccctacaggggttcctataggcagtttccagattgtagcacagagtaggggaatccaaatagagcccaggagagtttggagaagtcaaggcaactagaatttgtggggcagaaaacaataaaaggaactacacagaaatctatagaagtaagagaatctttgattggacactcatctgcacatgcaaagtgtggaagtcagcagtgctggagaaagtcacactggaaatcagaacactgaacaattccaggagctcacacagagctgggaatagtttatgtttccattaggcatagtggagagactgtttcatacaaaggacattggctagagtcttcaaagtggggttaaattagctatagactaaaggcctttctaaacctaccctaagcttcaaggcaggttttgaaaggaccaggctgattctaagtaactcaattatgtgccaaaactaaactcttttaaagaatacagtaaaagccagcacctaacaattaaaatgttcagcattaataatatattaatgaaagattactaggcatacaaataataagcaggaaaatgacccataaccaggagaaaaatcaatagaaaagagacctagaaatgtggaattattagaaataattctgatgattgaattatcagccaaatatgttaatacaagtattataatgactagtagagaaatgaatgatagataaaaagacacaagccagatatggtgactcacgcctacacacttgagggtgggcagatcatcttgcccaacatggcaaaaccctgtctctactaaaaatacaaaaattagctgggtgtggtgggatgtgcctgtaattccagcttgggaggctgaggcacgagaattgcttgaacctgggaggcagaggttgcagtgagctgagaacatgccactgtactccaacctgggtgacagagtgagactttgtctcaaaaaaaaccaaaagactcacaagtagtatctaaagatgaaaaataccagatataatatccaaaactgggggaaaaactggatgtgattaacagcagattagacactgtggaaaaaaagatcattaaatgtgaaggtatagcagtagaacctattcacattgaagcacaaagagaaaaaaaatactagaacaaagttaatagaacatcagtaacctgtgggacaatagcaagttgcctaatacatgtataattggagttccagaaaagtggggaaaggtagaaagcaattactttaggaaatagtgtctgggtggccgggtgggtggctcacacttgtaatcctagcactttgggggccgagaggggtgcagatcatttgagatcaggaatttgagaccagcctgtccaacatggtgaaatctcttctctactaaaaatacaaaaattagctgggcttggtggcatgcgactgtaatctcagcttcttgggaggctgaagcatgagaattgcttgagccagggagatgtaggttgcagtaagccaagatcatgccactacactacagcctgggcaacagagtgagaacctatctcaaaaaaaaaaaaaaaagaaaaaaataagaaaatagtggctcatcatggtggctcatgcctgtaatcccagcactttgagaggctgagatgagaggattttttgagcacaggagttcaagaccagcttgggcaatttccttaaaaaagaaaaagaaacagtgactataaattttccaaatctgatgataaccataaactctcagatccaagaaactcagtgaactctaaatagaataaacaaatataatcatacctaggtatgtaataataaaattagtgccagtcatggtggctcatgcctgtaatcctaacactttgggatgctgaggcctggagtttgagaccagcctgggcaacatagtgatacccctatctttacaaagattaaaaaatagaaatataaaaagttagccaggcatggtggcacttgtctgtaatcccacttacttgggaggctgaggtgggaggattgtttgagctcaggaggtcaaggctgcggtaagccataattgtattccacccagggtgataaagcatgacgggagatcctgtctcaaaacaaaacaaaaccaaaaaaaggcgaggcacagtgactcacacttgtaatcccagcattttgggaggtcaaggtaggatgatcgcttgagcccagaaattggagacaagcctgggcaacatagtgagaccctgtctctcaaaaaaaaaaatttaaaaaggggggcatggtggcatgggcctgtagtcctatctactcaggtggctaaggtgggaggattgcttgagcttgggaggttgaggctgcagtgaactgtgttcgtgccactgcactccagcatgggagacagagcaagatcctttctcaataataacacataaaccaatgttacaattagaagaaataaattctggtgttcggtgtttttttttttttttttctgagatggagtttcgctcttgttgcccattgctggagtgcaatggcatagtctcggctcactgcaacctccacctcctggattcaagatgattcttttccctcagcctcccaagtagctgggattacaggcgcgtgccaccacacccagctaattttcatatttttagtccaccacgttagccaggctggtctcaaactcctgatctcaaattctggtgttctattgcacagtggggtgagtatagttaagagtaaaatattattacaaaatagctggaagaggggcttttgaatgttctttcacaagtgagaaatgcaggaggtgatggatacactaactgctctgattggatcattatgcaacatggatatgtatcaaaacattgaattgtggcccagcacggtggctcatgctggtaattccagcactttgtgagtctgaggtgggtggatcacctgaggtcaggagttcaagactagcctggccaacatggcgaaaccccgtctctactaaaaatacaaaaattagctgggtgtggtggtgcatgcctgtaattccagctactcgggagactgaggcgggagaattgcttgaacctgggaggcagaggttgcagtgagctgagattgcgccatcgcactccagcctgggcaacagagcaagactccatctcaaaaaaaaaaaaaatatatcaaattgtaccccataagtacgtacaattacaatatgacagtttaaaaaataaatttcaaaaaattctcttgtacttaccagctgaataaaaaataaatttttaaaaggagagaagtcttaaaaaccagttatttaccccatcattaagttataatgaactttcttatgggaattctttgataaggaagctcctttacgctgaagttttattcttttcatacctctttagataaatcagtgctttgggagcatatgtcatatgactcaatggcagtgttctaacttggattctagctccacattgtgcaaaggcaaaaaaccagagagtcagtgtggtagttaagaacttatgttttgctgtttgatttcctacatgccagtactccctccactacctgcagtcttcctgacctggggcaagttccttttgtaaactctgttttctagggggatggtggtggaagaaggatggtgatttgagccaggcagtagcaggtggaggtggagaaaagtggtcaaaccctgaatgaacgttaaagataggaccaaaaggatttgatgagaaattggaagtagagcacggggaaaaagaaagacatcagtgatgatgccaaggttttttggcctggggaattgggatagtggagttgttatttgctgagtatgacttttcacaaaggaatgtcaaggcgtaagtagcaaagttctttctttttttttttaatttttcttgattgtgtttgttttgtttttcatcttttgtgggaggtgggtggagatgaaagcaagcacaggggttggcaggcatacccctggcacctacctgtgagttcatgattactagtcttaaattcagtcctttttatttttacttttttttttttttttttttttttagagacagtgtctcactctgtcatccaggctggagtgcagtggcacaatcacggcttactgtagccttgacctcccaggctcaggtgatcctttcacttcagcctcctgagtagctgggactacaggcacataccaccctacccagcaatttttttttttaattttttgtagcgacatagtcttaccatgttgcctaggctggtctcgaactactgagctgaagcaacctgtctgcctcagcctcccaaagtaaagtactgtaattacaagcttgagccactatgcgtggccaaattctggcctcttgatgttgcatggcgtggatggggaggtgaagtgtgatattttaggaatttgaggatttcttcttcgaccttaggcgtgacattggacaaatgacatctgggctgagacattttctattaattctgaatccaaaaaactcttatcccattgtctcatagcttcattacacagacctggcagccatgatcctctttttttcccccttagttgtcaaacatgggttctctgtcttacctcatttgagtcttacctcagtcttgagagtctcaaatgtatatcatagtttttagacaaaattcaaccttatttcagttagtatttcattgttatttaaatattttaacaggaaaactgagcaatgtttccctttacctgttaatcctgttataatattttagataaagtgtattagaaggcacattcttcattaatagaatatttattcatgtgtttatatggttcttaactaggaataccatatagtctatctccaaccctttgagaaggaaaaaagatactgactaaacaggacaccagaagagcatgcctaaactaggactgttctgggcaaatcagaaggcatgttcaccttattctttttattctttctttttttttttttttttttgtgacggagtctcactctgtcgcccaggctggagtacagtgacgcgatcttggctcactgcaacctccacctcctgggttcaagcgattctcctgcctcagcctcctgagtagtgggactacaggcacatgccaccatgcctggctaattttttgtgtttttagtagagacgggggtttcgtcgtgttagccaggatggtcttgaactcctgacctcatgatctgcccacttcggcctcccaaagtgctgggattacaggcatgacccactgcacctggcctcaccctattcctaaggccagaaaaccagctagagtaaagttcactttctgtttgagtgcttggactttattgggagaaggcaaatgccctggaacaagagtgaaagggagaaattcccgttgtattgcaagccagaataagagaggctcacccgcactggcctaaggcatctcagttgttgatgagaatgtgattacagatgtctcacttgaataccaaagacaattgcaaaggaaattaaaagttatgcaaagagagttgagaagtcagttgtctgctcacaggttggctttagtggctattactttgagatactaaatgagcaatagctttaaacttcaactgcttttgtttctgaggaaaaaaatcatcttatatcctttcataagtcgcataaaatgtggacattttctattattttaaagagtaaatttaggtacaagcatttactaattttttttttttttttttttttttttttgagatggtgtctcgctttgttgcccaggctggaatgcagtggcgcaatcttggctcactgcaagctccgcctccctggttcacgccatgctcctgcctcagcctccagagtagctgggactacaggcgcccgccaccacgcccagctaattttttgtatttttagtagagacggggtttcaccatgttagccaggatggtctcgatctcctgacttcgtgatctgcccgcctcagcctcccaaagtgctgggattgattacaggcgtgagccactgctcccggcctgtaattctttttttttttttttttttttgagacggagccttgctctgttgcccaggctggagtgcagtggcgtgatcttggttcactgcaagctccgcctcccgggttcacgccattcttctgcctcagcctcccgagtagctgggactacaggggcccaccaccacgctcggctaattttttgtattttttagtggagacggggtttcaccgtgttagtcaggatggtctcgatctcctgacctcgtgatccgccctcctcagcctcccagcatttagtaattcttaaaagagttcggcatgaatatacacagtacgtgggttattagtactgtgttgttaacacaaatgaactatgatagcaaattgaatttggttcaatcaggtcaaagaataaaaggatgattttctttaaccaacaagggatagtataatgaaccccatgcaactatcacttaacttcaataatttcaagtttgagtaagttgcagagtagtaatttgaacccacatctctcttgttccaaatcccttgcttttaattacaatcccatgtggcttctttgtcatttgatgctattgagcaactttatgattttttttggtgtttttggtaaaatagacatgaaaaggcattactacagggagttttttcactccctggtaataagaggggaaaagcactctcttttaatgatacatgttttgtaataagcattttttttagttgcagtgttctgcaaagacaaaacctgctgatacagttcatcctgttttagaaatctttgacccattcatcagactctgaccactctaaagataaaggattatggttgtattggtttttccgactgaagcggctttctgcagattgagaaattgtataattattaactgcggtaatggagatgtacttgcaagtttcatctggtatcttaatgagctttaaccctctgaatacacctaaaacatatcctagaattattgaaattaatcagttgtccataacttttctgtctgtataatttggctatcatacatattttgtttccccctgcccttgccagtttccatcctcctactcacatactcacaactcctataaattggagtatttagtagcagtagcctttggtataaacactttttaaaaatttactattttttgatttaatagggccactttctagtcaaattttttttgggggtggtgaggagggtagggtaacagttccacacttacaagggtatttgtttagacgaagcttgttcaacccacagcctgtggggctgcatgtggtccaggacggctttaaatgcaacccaacatgagtttgtaaactttcttaaaacattatgagttctttttgagattttttttcgagacagagtctcgctctgttgtccaggctggagtgcagtggcccgatcttggctcactgcaacctccacctcctgggttcaagcgattctcctgcctcagcctctggtgtagctgggattacaggtgtgtgccatcactccaagctaatttttgtatttttagtagagacggggttttaccatgttgggcaggctggtctcaaactcctgacctcaagtgatctgcccaccttggcctcccaaagtgctgggattataagcttgagccaccgcgcccagcctgcgatttttttttttttaagctcattagctatcattagtgttaactgtattttatgtgtggcccaagacaattctccttcttccattgtggcccagggaagccaaaagattagacacccctgatttagacaaataagtgaaggcacactgaaataacaattatatataataaccttgtgccgcccagcgtggtggctcatgcctctaatctcagcactttgggaggccgaagcaggcggatcagctgaggttgggagttcgagaccagcctgacttacatggagaaaccccatctctactaaaaatacaaaattagctgggcatggtggtgcatgcctgtaatctcagctacttgggaggctgaggcaggagaatcgcttaaacccaggaggcagaggttgcagtgagctgagatcgtgccattgcactccagcctgggtgacaaaagcgagactctgtctcaaaaaaaaaaaaaaagaaaaaaaaaaaaaaaacaaaaaaaccttgtgttttatggatctcacattcatctcagatatttcttgccctgagagatcctctgaattctcaggattgcttcatgttgattctactgtgatcctatcaaatatagtaatgctagaaatataggtctgaagtttgggagagagattggctcagtatagatatgtaaagcacagttggatatgtggtagttatatgaatgggattggatgaaattctctagaggtgtgtggaatggaaagaggtggcccaaggaggaagagagagagagagaaattggagaggtagaacaatttaggaaagagtaatgttctagaaactaaggagagagtttcacaactgcagtggtgaagcactgtgagttcttatttggcaatttggacttcattattgtcttatcacagataggaaatgaaaggttgcagaacatttaggagaaaatattaagtgaggacacagaagcggtaaatgtcgtatacaccttttaaacattttggagattacccatagtaggcctgtcccttgggtaaggcaattagggcagctttcctgggccctattttggggtggggaatgactcggggactttattatatgactttttttctgaacattaataaaattcagttccaaaattttgtgattaactgtagtcctaagagcctacgaaaaatgcagataatgggcagttccacattggttgaactgccccaggcttctctcttctagagttgctgtcccttccttttaatcctgtagtagctcctatcactttttttttttttttgagacagagtcacccagactggagtgcagtggtgtgatctcagctcactgtaacttctgcctcctgggttcaagcgattctcatgcctcagcctcctgagtagctgggattacaggtgcgtgccaccacacctggctaattttcgtatttttacaggattttaccatgttgcctaggctagtcttgaactcctgacctcaggtgatccacttgcctcagcctcccgaagttctgggattacaggcgtgagccaaggctcctggcctcctgtcactttttataattgtcagtttgtttttcctctcagaaattaagctccttaaagctctctattattgttttgaattcccagggcctagcataatgcccagcacgtaatgttgaatgtttgttacgtaagtgattgaaggaataatccaatacatatctgtcttaagtacaaaagaattccaatatggtggtctcacagagtcaaaaaagcggaatgtttcagaaaagagggattgataaacagtttcaaatggtagtaaaagtattgaaaactgacctttggatttggcttctagaaggtcattggtttccatagtgaaaacttttatagcaaaatggttggagtagaagtggttgaagattaaaggagaaatgagatgtaagaaacaacaaacaagtttgtgggggggcgggggttggttttatttttaaagatttgtagctgagcgtgacagtatgtatctgtagtcccagctatttgggaggctgtggctggatgatagcttgagcccagcagcttgaggctgcagtgagccatgattgcaccattgcactccagcctgggtgacagagagagaccctaactcaaaaaataaaataaaataaagatttgaaactaaagggaagaaaccattggagaagaaagccaaagatctgacggaggagaattcattatcatggtaatgttatgcatttgatttgcatatatctaagtattcccaccaactttttttttttttttttttctgaggcagagtctcactctgtcacccaggctggagtgctggagtgcagtggcatgatcttggctcactgcaacctcccgggttcaagcgattctcctgcctcagcctccctagtagctgagactacaggcttgtgccatcatgccctggtaatttttgtgtttttagtagagatgaagtttcgccatgttggccaggctggtctcggactcctgacctcaggtgatcctcccacttcggcctctcaaagtgcggggattacaggcgtgagccaccatgccaggccccaaccaacatttcaagataatatatttctccttccacttgggtttgatatattaatgtattttgaacttgaaggcttttgctgtgctatttggggcccctagtggtaaatctaataatgacatgcaatagaacagctaatataccagttattccttatgaaggttattctttctatgaggattaaatgaggttggaatatgtagttatagcaatagtagtgattcttaatcatttttttaaagagagggtctcgccaggcacggtggctcacacctgtaatcccaacactttgggaggccaaggtgggtggatcacttgaggtcaggagtttgcgaccagcctggccaacatggtgacaccccatctctactaaaaaaactaaaattagctgggcgtggtggtagatggctgtaatctcagctactcggtaggttgagataggagaattgcttgaacctgggagacaggaggttgcagtgagctgagatcacgtcattgcactccagactgggtgacaagagcaaaactctgtctctaaataaataaataaataaataaataaaaggtctcactttgttactcagactgaagtgcagtggtgtgatcatggctcactgcaatgtccgcctctcaggctcaagtaatcctcccacctcagcctccctagtagctgggactataggtgttccactactatgtccagctaattttaagaaattttttagtttttaaatatttttgtagagatggtggtcttactatgttgtccaagctggcctcgaactcctggtctcaagtgatcctcccacctcggcctcccaaagtgctgggattaccggtgtgagccaccatggctggccaaaaatgagtaatttttttttttttttttttttgagatggagtctcgctttgtcgcccaggctggagtgcagtggcgagatcttggctcactgcaacctcctcctcctgagttcaagcgcttctcttgcctcagactcccaagtaactgagactttaggcacgggccatcacagctggctaatttttgtatttttagtagagatggggttttgccatcttggcctggctggtcttgaactcctgacctcaagtgatccacccccttggcctcccaaagtgctgcgattacaggcatgaaccactgtgctctgccccaaaatgagtaatttaaaggtgactgtaatatagttaaacaaatgcctcttttcccattctttactaacttgttatttaaatggggcaagtttttacaacataagaaataaacaggccaggcgcggtggctcacgcctgtaatcccagcactttgacaagcagaggcgagtggatttcttgaggtcaggagtttgagaccagcctggccgacatggtgaaaccccgtctctactaaaagtacaaaaattagccgggcgtggtggcacagactgtaatcccagctaatcagggggctgaagcaggagaattggttgaacctgggaggcggacgttgcagtgagcctagatggcaacactgcagtccagcctgggcaacagagcaagactccatctcaaatgaaacaaacatactaaaaacctatttacttgtttgatgtgagtgtgcttagctttattccccttaaagagagtctttttttgagatggagtctcactctgttgcccaggctagagtgcagtggtgcaatctaggctcactgcaacctccgcctcctgggttcaagcgattcttctgcctcagccttcaagtggctgggactacaggcgtgtgctaccacgcccagctaattttttgtttttagtatagacggcgtttcacgctgttaggcaggatggtctcaatctcctgacctcgtgatccacccgcctcggcctcccaaagagctgggattacaggtgtgagccactgcgcccggcctaaagtgagtctttaggtgaaaaatttttgtgaatattgtgatttctccttaataatttcttgtgtatttatgaattttatataattaaatggcatatcaaaaaaatcacctatgttaattatgtttttgactcagttatattttcttttggtacattattaagttaatatccatatgcaaaaatatgctgacaatatattaattttggatttttcatttttatcagaaatcatgagtggaggatctcaagtccacattttttggggtgctccaattgctccactgaaaatcacagtatcagaagacacagcttctttaatgtctgttgctgacccctggaaaaaaattcagcttttatacagtcaacattctttatatctgaaggatgaaaaacagcacaaaaatcttgaaaactataaagtcccagaatctattggttctccagatcttagtggtcatttcttagcaaactgtatgaatagacatgttcatgtgaaagatgactttgtacgttctgtttctgaaacacagaatatagaatcccagaagattcactcctctagactgagtgatataactagctctaatatgcaaatatgtggatttaaaagcacagttccgcatttcaccgaagaagaaaagtatcaaaagcttctcagtgaaaataaaattagagatgaacagcctaaacatcagccagatatatgtggtaagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaacgcagtagataagtcaaggtctgaagcagcagttaggaaggtctcagaccttaaaatatcaactgatacagaatttctcagtataattacctccagccaggttgcttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacgtattgagttgtgtagctcaggaatactgtgttcccaactaaataccttccacaaaagtgctattaaaagaagctgtacctctgaagataaagtgggccagtctgaagctctatctagagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacataaaattcggaccaaattctggctctaaagtgcctttagcaacagttacagtaattgatcaatcagaaactaagaagaaggtttttctgtggaggactgcagcattttgggcatttacagtgtttcttggagatataattttactcacaggtgaggtcattatggtatagtggtagcttattttataaagctaagttttgtttgtttttgtttttctcccacttagtctttgaagactctttagtcatttgcctcttctgagcgcagcataattgatccctttatcgcatctgcattgttctcctttccattgtccactctcctgcccattgccacttctgggcctctgttctatccttctcagctctgtcccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaaggtttgcgtgcctgtagtcccagctacccaggaggctgacgcgagaggattgcttgagcccaggaggttgaggctgcagtgagctttgattgggccactgcactccagcccgagcaacagagttagacctttctgcttctttacctaatgtctaataatgctgtgcacattgtatttttactgtgggaacagttattgatttctattgccttattatcaaaattatattaattacacttggaaatatggaaaggaaaaaactggtattataccaacttcatataaccaccaatagagttctagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccctacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattgctgatcagcatgagaatttttaaattgttatttttaattttttgtttgtttgtttaatagggacagggtctcactgcattacccaggctgatctccaactcctgggctcaattgatcctcctgccgcagcctcccgaagtgctaggattacaggcgtgagccaccgtgcccatggtatttttaacatgcccttgtttccaacctggaccagttcacccctccttagggaacctgtggtcctccactcccaggaggtcactatattgatggcaagcttagtgcagacacctgatcggctacaactctgaactcctgggctcaagtgagcctcctgcctcagtctcccaagtagccaggactacaggcacgcatgccgctgcacccagagagaatatttaatatttttttttttttttttgagacagtcttgctctgtcacccaggctggagcgcagtggcacaatcttgactcactgcaacctccgcctcctgggtgcaggtgattctcctgcctcagcctctcgagtagctgagattacaggtgtaagccaccatgcctggctaatttttgtatttttagtagagacggggtttcaccatgttggccgggctggtttcgaactcctgtcctcaggtgatccgcccaccttgtcctcccaaaatgctaggattacaagtgtgagccaccgtgcctggccagaatatgttttcaccgaacacatctaacattgtgttacatgttctttgttgatttaaaattgacacatggtgtattagagcaggaggaagttgattaagcttaataaaatatctaaagaaagaatgtgatacagaggaggtatttagaagaagaaaacttcgaagcaatattgataatcctaccaaatagtttacaggaggaatgagaaccttagctaatgtaccttggtgttcctgtaggattgtcaagtacaatcttttttgtttttttgagacggagtctggctctggcacccaggctggagtgcaggggcgcgatgtctgctcactgcaagctccgcctcccgggttcacgccattttcctgcctcagcctcctgaatagctgggactacaggcgcctgccaccgcgcgcggctaatttttttgtatttttagtagagacagggtttcactgtgttagccaggatggtctcgatatcctcacctcgtgatccgcccgcctcagcctcccaaagtgctgggattacaggcgtgagccaccgcacccggccgagtacaatcttttataaagaggtaaacacaagattgtaatgaacaggcttagcatagccacatcccactggcagtattagctaatattatttatatgtgattatattattggagattcaattcacctaactccctctgttctgattcagtgcttgctgaatacctctttgcttgtgatttggctttctagttgtagagctgcccacagcatgagaacaggctgaaatactgtttttttgggcaattaatgcctcattgtaaatgaaaaaaaaatttttttttctttaatttgtttcattagttgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacaacgaggtaacattctctctggtggctgaaatgcaatttacttaaccattttcctattataagacatttagatgatttctatgaacattttttttaaaaatcagatttttttgtctttttaagaaaaagaggacctagttcacttatttctgaataagtttcttttgtgtggaacagatggaaatgttgggaaaaaaaagaaatctacacttttctgttgtcctaatgaggcagtgaacttagttggatagcctgggtagttcatactacctattgatatatacccccaaacagaaatcttcctttttttttttttttttgagatggagtcttgctctgttgcccaggctggagtgcagtggcgcgatctcggctcactgcaacctctgcctcctgggttcaagtgattctcctgcctcagcctcccaagtagctgggactacaggagcccgccaccacgcctgactaatttttgtatttttagtagagacagggtttcaccatattggccgggctggtctcgaactcctgaccttgtgatctgcccacctcggcctcccaaagttctgggattacaggcgtgagccatcgcgcccggcccaaactgaaaaattttaagtaacagatgtattccagaccttgttgaataccaacacagcagacagtttgctattataacttctagcaatagaatgaagagatgccaaaaataaggattacctaagggagactactgactagaattagaagaagatgggaggcttaacattgggaaacaacagtgtttaaaggacaaacagaataaggactaggagctggggcatgtcagtgagagggtaggaaggagccaggaggccagggcgggctacccatcccctccatgcaccactagtgattaccatgtcactaatccaacatatgcttcacagtcctagctttcagaatgctctccttgaaatttctcgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattaatgctctgatgaatgactcattagcattgtaagaaatgggttgcaggcgggacaagcacctgttgggagggaaaggaatgtgtaatgtaaaacagtagtagtggtggggcatgggcacatttaagcagcagaggggtaggtgggggctggtggcaaggagtgggaagggagaggcaagatgacttcagatgttagtttacttgattagcagcatagcgtcaacaaatgagttgggcgctatgaaaggaaaagcaggtttggacattgctgagtttggggagccaatggaatatccaggtgggaatttccattaggcagttgtaggtaaaaggttcaaaagctgaggaaagggtctggaatctaaatctgtaagtaatcacttggaatttatacatccttggttttctttcctattatctctacattatttcactattgttaatatatgtttatacctctgacactgtatgctgattagatcctgccttagagatagctcccttcccctctttctctttacagctcacacgttttgctctacctacaattgtttctacctgttggtatgtttagttctacctgattctactctatccgtcttagatatacagctctctctttccaattggaaaatgttccctacctccaaagtctttcacttttaacttatgtggaagataattatagtgctatttagggaaaaataatcaagtgtgttaagaatgccttatattcagatatatttatagtagaagggaccagtgcatactgaatattattactctcctaggcactacggctttggaaccactactttgccttctggtcctaaaaaaaattatttttaatgtatcagaaatatacatgataacattttccttatgtaaataaaaactattaagccttttttatatagagcagtggacttccatactgctatcatttgaatataaagaagcaattttgttaatttacctagatttagattttagatttgctgttttcttatttcgtgcctttaggcaggttatttaacctatttgatctctacttgcttggtatatgggaggcatgcatagtattttgttgtgactagtaggttaaccacattgtgaaggaatttatggcatgatcagaacgttttttctctctctagatgttgttattcatgaggaccaatggattggcgagacagtactacaatcaacatttagcagtcagttattaaatcttgggagttattcatctattcagcctgaagaatgtaaggcacattttaaatgaagtaatgtagtagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggccatcagtatagtggtggttcttcaccttttagggagtcagagacctctttgagaatctatagaccatttctccagaaaactggacttatgtagataggcacaaaattttgcttataattctaaagcattccacggacctctgaagttcttctgtggaacttctgagcctctgattaagaatccttgaggtaataaaaatgtattggtctcgtattcagacagctgtggtttgaatccttattctcctgtctaccactgctaagaaaagctatctttcttctttaatgtccagttttctcttctttaaaagaagctgtttaatgaggaaactagcagctatctcctcctctaggaaataaaataacataaaaaaaagaaagaaaacaaagtaagggaaacagtataaacttgtggttatggtcactggactcagatagaccaggatttgaatactggccctcttacttccagtctttgtctttaggcaatgtatttcacttcactatacttttgtctccttttctgtgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatatatatatggaagatagagcatggaattccaatctttgaattcttaaagaaaggcagagcaagtagaagggaagagcaacaattagaataacaagaactgtgtttggaatgggcaaggtttcattatatactagggtggcccatcagcagaaaaccaactctgacatatttcatagacaactaaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatgtgcaggtgataatgagtgctatgaaggaaactaacaaagggttaagatacagaatgccgtggttctagttgagaaggattgatcatggagtagaatcagggttaggaagttgttacaatagctgcagttgagagataatgggaggccagtggagctaaagagctgagatatatttgtaaatagagttaataggattttctgatgatgtgggtctggggatcagggaagagggacaatctactgctactgaattactggtttaagtaactaggtagcctttattgggaaagactgagagggaactggtttgtggggaaaaggactatgtttcaaggcatgttaagttttagatatctttgagatattcaagtggaaatgtcatataagaactggaaacaaagttcaggactcagaagacaggtttaaaattaagaggcaaattttagagttattagcatacagataatatttcaaatttaaaagttttttaaataataaatatctgtataattatagaatcacaggggattgcaaaaataatacataaagtcccatgaactcttcttctagcttctcccaatggtgatatcttatataactttagtacaatatcaacaacaggaaatcaacgtttgtataatactgttaactagtaatatactaggatactttccctttcagtatcaataaatatagtatcagcctggcacagtggcttatgcctgtaatcccagcactttgggtggctgaggcaggaggattacttgggcccaggagctcgacaccagcctggatgatatggtgaaacctcatctctactaaaaatacggaaaaattagccaggtgtagtggtgcacacctgtagttacagctactagggaggcttaagtgggaaagaaagttgaggctgcagtgagccatgattgtaccacagcacttcagcctgggtgaccggagtcagaccttgtctcaaaaaaattttttttcttaaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgggaggccaaggtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctgggaggtggaggttgcagtgagcaccactacactgcactgcagcctgagcgacagagtgagattcggtctccaaaaaaaaaaaaagaaagaagaggcatttgaatggataaagaagaatgaaaattatttctatttacaaatgctctgataacatacctgaaaactccagggaatcaaagttaaaacaaatttaaataataagataattcagtgatataacagaatgcaaaattagtgttaaaaaatatcattaggctgagtgcagtggtttgcgtctgtaattctagccctttgggagatgaaagtgggtggacagcttgagcccaggaattcaagaccagcctgggctacaaaaaagaaaaagaaaaagaaaaaaaagctgggtgtggtggcacccacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaataataatagtaattagacttaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaagaaatggaaagacattccctgttcttggataggatgactcaacattataatgatgtcagttcttcctaagttaatatgtaaattcaatgtagttccaatgaaaatatatatgttatggcatataaaagttgatactaaagctcataggggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaagaaacctgaatgaatcctctgtaatcttggtgtagggaaaggctttttcttaatattactcagaatccaggggcagtagaagataaactgatacattttactatagaaaaataaattttgcataaccaaaacactataaacaaagtcaaaagacaactgacaaacttggagaaaatatttgtaacatacaacaaaaggctaatatccctaatatataaagaacttttaaaccctgagtgacaaaggctgggtgtggttgttcacactggtaatcatagcattttggaaagctgaggtgggagaatcacttgagctcaggagtttgagtccagcctgggcaacatagtgagaccctgtctctacaaaaagtcaaaaaatcagcccggtgtggtggtgcatgcctatggtcccagctacgttggaggctgaggcaggaggattgtttgagcccaggaggtcgaggctgcagtgagctgtattcatgccactgcactctagcctggcaaaagggaaaatgtgaaaaagagatgaacagtcagttttcaaaaaaagatataaaaatggctatcaaatataacttattagagaaattcaaattaaaactacatggagataccatttctcacctatcagattggcaaaattaaaaaaaagcacattctgttggcgcaactgtgaggtaatgtgccctcttaatacattggtggtaggaatgcaaattgctacaacccttgtgaagggatatttggcaatatctaacaaaattacatatgtacttagctttcaacctagcaatcccacttctaggaatctaccctgaagctacacctccaacaatatgaaaatacatatcacaaggttattcattgcagtattgtttataattgcaaaatatataggagaatgattcactaagttatgctacattcacatagtggaacactatgtactatgcagctgtacaaaaagaatgaaaaagatctctatgaactgatatggagtgattcccaggacatactgttatgtgaaaacataaaccccccaaaactgtatgtagtatgctgtccttcctgtacgaaggaatggaggtataagaaaatacctcggtttatttgtggaaagaaaatgcaggaaggataaaccagaaactaaagagattggtcacctacagggggcacataggagaggggtggaagaaagtggggaatgggaacaggatagcaggggtcaggaggaagtgacactaacaaatgaatgtaatattgttacaagtgaacctaatattgttacaaatgaataaaataactacacagaagcgggtggggaagaaaagaacaaacctaagtagctgtggaaaagagtatattgactggattctataaggctaatgacagaaaggactgtacataaatgctgcaatctagttagaaatatgtttctcaaaggggaatggcttagcaataaccttatgtacatactagaatgaacaaatgagtacatagattgtagataaggaaagctggatttctcactgttggagaaagaaattataaacaagggaaggttaaaacgaaccagaggtattgttataaactgaggatttttaatatagataaatggatacagaaatataggcatgtgtatatgggtgggatagtacacatacataaacatctcctagttctgtccattgagcgagcacagcacagatgcagttactccccagtaataatgagcatacctggtgcccagatcttcatctgtaaacattttcttttcttttcttttcttttcttttttttttttttgagatggactcttgttctgtcacccaggctggagtgcagtggcgtgatcttagctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctaacctcaggtgatctgcccactttggcctcccaaagtgctgagattgcaggtgtgagccactgtgcctggcctctctttttttttgagacagggtctggctctgttgcccagtctagagtacagtggtgtgatctcggcttactccaacttctgcctcctgggctcaagccagcctcccacttcagccttccaagtagccggtaccatagctgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaacagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttactgacataaagatatatgtatttcattaactaaccagaggggaagagagagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccgtctctacaaaaaatagaaaaattaaccaggtttggaggtgtgtccctatagtcccagctattcgggaggctgaggtgggaggatagattgatcccaggaggttgaggctgcagtgagctgtgatcatgccactgcacttcagcccgggcaacagagtgagactctgtctcaaggaaaaaaaaaaaaatacaaaacacaaaaatagagaattaccatcaggcagagatcacaataataaatactgcactgacacaaatgcactgatagatgctaaaattagtaggtgaaagtttgaggagagagagcattgcatagtctcaaagtatctccccaagataccagcatactagagggaaaataataaatttataagaaaactcttcagacaccaagttaactgagtgattgggataaatatcaccagtaataagatgtatggtatcataaatgctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatatgaggtgggatcttggatgaaatcctacatagaaaaaggatattaataggagaattgataaaatttaaataacatctacattttatttaacaatatttaattaacattagtttcctgtttaagataatttataatatgtgagatgcccacattagtcgacatagtgaggaatataaggtaactctgtactatttttgcaacttttttgtaagtcttacgttagttcaaaacagagtttttaaaaaagctgtatacgatcatctcaataggtacaaagaaagcttttgataaaattcaacacttgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccgtattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaaggagctggatataagattaacatacaaaagtcaatcacatttctagagtgactaacaataacaaaggaagctgccattgacaataatattattttgtactaatagtaataaatgtaacaaagtatgtgcaagacctaaaaaaggaaaaatttttaaatgaagaaaaactaacaaagaatgaaataaacatatactttattcattgattggaagatttaacattgtgaagatttcagttcttttcaagttgatttgtaaattcagtgcatgttcaataaaaatcctcgtaagatttcaagggctcagtggctcatgcctgtaatgccagcactttgggaggccaaggtaggaggatctcttgaggcaaagagttcaagaccaataagattttcatgtaatttgataagattatatgatatttatgtagaagagtaagtggttgaaaacagcagggcattttaagaagaaaagcagggaagaataatttgccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtgtgtgtgtgtgtgtgtgtgtgtataaatgatagctaaatggcttctaagtaaaattcagcatatcttgtatatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaattatgtgaaaaatcttgaactaattagataatctttagaagttacttcacaatctttgtttttacacatacacaggaatttatggtgctttattttttacaggttagtagctaaataaagtatattctaaagttttttattgatgtagggaaatggctaccagtggacattttgagaatattgcagttgtttttcttctgaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactctgttacccaggctggagtgcagtggcctgatcatggctcactgcagcctcagtctcccaggctcaagagattcttctacctcagcctcctgagtagctgggactacaggtgcatgcccccatgcccagctaatttttgtattttttgtagagaccaggttttgtcatgttgcccaagctggccttgaattcctgagctccagtgatcctcttgtcttagcctcccaaagtgctggaattacatgtgtgagccaccactcccagccccagaacaactattattaaaaagtcaaaaaacgacagatgttggtaggctgtgtagaaaaggaaatgctcatacactgttggtgcgaatgtaaattagttcagccgctgttgaaaacagtttggggttttctcaaagaagttaaaactgaactatgatttgacccagcaatcccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcagtggctcatgcctgtaattcccacactttgacaggctgaggcaggcagattgcttgagtccaggagtttgagaccagcctgagcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaatagagtgacaccttgtctcaaaaaaaataaataaataaataaataaattgcagcaacacagatgcagttggaggcaattatcctaagtgaattgagggaggaacaggaaaccaaataacatgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgttctttcatctttatagtgaggtgttacatgttttacaaacctagttctgataatgtgacaggaatataaatttatcttgaatattattaaatatataagtcaaagatcaacacaatgtttccatgaggtagactttttttggaatctaaataaccatgtgtttccatgtaaatttttatgaatcagggacaaatatataatttgatgttagagatgtttttgttccccaaaagctctatcttgttcatgaaaaacgaagcccagagaagttatgtacaagttcacagagcttattattgacaaaaccagaatttgaatacaactcttctgattccagatttgctggaaatactgtgaaagaagaactcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaaacacaaatcagtttatggagtctgctttctaaaaagtacttaagtgtttattgccaatatcttattttggtcagcaatcaatcacgtactcaagcatacttgtcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaggacatagtaactgaagaattaaataaccaatccaacacttgaaaaatattacaatgtagcacgtgctcaaaagctctctgagctcagggaacaaagcagcactgtgaatctatagtggtaatcattctatgtggtattgggtaggacaagacagccttgcagctggaaattggtgaggacggaggcctcgctgtggaaagagtaaggcacactcagggagagaaccagtgaggtggctctgagcctgtttcagaaggggcttgaggaagaacggcagaggataggatagttgggaaagcaggatcaaatcagactccagggactggggaaccaattggctgttacagggtggtggagtcaaaaaagaacagaaattttctgtttggttaattgatagaaaatgatattattaacaaagtaaagaagtatgggaacagcacaagttttttggggatagtaaataattccatttccattgattaaaaatatcaagtttgtttttacatctaaactgattcaagacttagctattgtacatgttttagagaaagcaaaactatattttatatctaatcatactttacaacataaaatacagttctaaaaaatattatttgtgaagaaaaatataatgttgccatcttttgtctgtctgtatgttttttttcccttagattccagtgtagttagtgaagttgtacttcaagacttactggcatatgtgtcctcaaaacattcctacctcagagatcttcctccgaggcagcctcagagggtgaacagtatagactttgtagaattggagcaccttcaacctgatgtattagtccacgcagtactaagagttgttgatttcactatactgacaggtaaatattttgactgcctccttaattttagattatgaaaaaattaagatacaagaccatcttagtgtaccatttggttatcactatatatgtatcatcagctattaaagtatggtatcacgtgtgatagagtaatgccaactaaggtactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaagtcttaaatttattcccaggtatactactttacccttttagtgaagatcttacctccttcaaataatgttctttaaacatttaattctggagaagcttctacaattttttttcagccagagtactctgataaatgctatggttataaggcagatgtcaagggagttaccttaactctttcaagtcacaattaatgttcaataaattactgtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaaagacagtttcatttgtggcttatgagttatttttccctgctaaattaatttagagattgattcagtatattattattttttacctgaaagagttaatgtctctccaaacttctgccttccaaatagttatttgtagataggagctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagccgtaacaaagcagattgctccatgtttaatgtgaatattcttttaaaattaatagttttttggttaatagaagagaaattacagttgtctctaggtgattctatggtgtttaggttagtattgaaaacatatgaatccaggaattaagatgttgttgttctttgtacattcattcatccagccccccttatttataaccatcattttaaagttttaacatctacttcaatacctcacatcagtctttttaagataaaaatcccaattttgaaggattacttaagtaattctattttcctgattttacttttcttttcaagagaccaaccccatttccaaattcccagcaaagagaatctgattgcccagagtaaatttgattcaaaaaactgtgatcaggaagacaaggtcacacaatacaaatatgagagcttgagcttatttcagtggatgggaaaacagttaagggagtcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagttcaagttctcatcttaaaaaaaataaaaaataaaaaaaaattggattgtaaaacttcacgtatagaaaatatgttatcatataataaatatttttatgtttatataagttaatacataaaaattttcaagaaaaccctttatatataatagtatctcattttaataaaaatgtatctataagtacatatgtgcatttgaaaacctggaaatatgcatgtatagcaaaatgctagcagtggttatttctgtatggtagtattatatgtgctttaattttttctttatacctttagtttgaatttcatatgtgtgtgagcatctgcatttacttttaaaaacttctattataaaagccttcaagcatatataaaagcagagagaatactaagcataaggcactttttttttttttttttgagacagagtttcattcttgtcacccaggctggaatgtagtggcatgatctctgctcactgcaacctcctcaagttattctcctgcctcagcctcccaagtaagtggaattacaggcatgtgccgtcatgcccagcttatttttgtatttttagtagagacgaggtttcaccatgttggccaggctggtctcgaactcctgatctcaggtgattcacccgcctcagcctcccaaagtgctgggattataggcatgagccagccaccgcacccggccagcataatgaacttaggtacctattagccagcttattaaaacatggtcagtcttgtttcacctgttacctcccttgtctttactgtttaaatatttcacaataaatatattttattttataattaaaaataaaattaaaaccttatgctttttaaaataaaagaatagttaatgtttggaaaatctagctaacaatgtgagaaaaaatagaattaaatttatactttatgtttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaaccaaaaaaaaacagaaaaaaaattacattgtcagaaaataatgcagtaagcaaaagacacatatctatagagataaatggggaaaggatatgagtaggcaagtccccaaagaagaaataaaaatggccaataaatatatggaaaaattgttcttacaagtaattgaaaacacacaaagtaatgatgatagatgatttttcttttaagaaattgatagagaagatatgggaaaacagctactgtcatcagctattggaaatgcaaactggcagaacctttcttgaggataactgacaattaatatgaacaaattgggggtacttttagcccaataattttagctataggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgctctgtctttacagatttactgagatgtttgatgattttccaccaaaaaaaaaaaaaaaaaatctctagtgaaagaaactaaggagatgagcaggtgtagtaaattagatttatggcctgaagtgagaaactaaaaagacagctgatgttatcagaaaaattagtgctaagaaaccctcttttgttttattatagttttgaagttgaatttactaatacagaatatgataatacagataagttgaatttactaatagagaatataacagtaataaggtctgtgttattgtggctttaagtattagaattgtggccggcgtggtggctcccgcctgtaatcccagcactttgggaaaccgaggcgggcggatcatgaggtcaggagatcgagaccatcctggctaacacggtgaaaccccgtctctactaaaaatgcaaaaaaatttagccgggcgtggtggcgggcgcctgtagtcccagctactccggaggctgaggcaggagaatggctagaacctgggacgtggagcttgcagtgagccgagattgcgccactgcgctccagcctgggcaacagagcgagactccatctcaaaaaaaaaaaaaaaaaaaaattgttactgagagttaaaaataagtacaattgtgtctaaatgctttttgttctagaaaagttaactaaaataactattgaaatatgagtgaaatattagacttgggttcatttcagtgtcctttctttaacaaaacaaaacacaactttgcctatagatagatacatgagaattttctttacagaaagcagttggttattataaatgatgaccgttcaggagggcaaggaatctttagaaaatattttattaaaattatctctggtggcccggcacggaggcttatgcctgtaatcccagcactgtgggaggccgaggtgggcggatcatgaggtcaggagttcaagaccagcctgaccaacatggtgaaaccctgtctctactaaaaatacaaaaattagccgggagtggtggcacgcacctgtaatcccagctactcaggaggccgaggcaggagaatcacttgaacctgggaggtggaggtttcagtgagccgagatcacatcactgctctccagcctgggcaacagagtgagactctgtcttggaaaataataataataataataataatctctagcatgcttctgttgtcttaatgcatcattcatattttgtctctgtttacccaaattctttagtgataaaagattagattcaactgacttaatcagatcaatctatttaatctgatactaagcctagatttttttcctttttggtgacttttgtttttactgttttttttaaggttatatttgggaatttaaatatctttttgttcagtgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatctttatatacataaattctgctatttttatttcttttgaaacagggtcttgctctgttgctcaggctggaatacagtggtgtgaacacagctcactgcagtctccacctcccaggtttaagtgattctccccgttcagcctttcgcgtagctcaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataattctatataaaagtgaaatataaatctttgcaaatatctgaactagattccagtagttttaggaactatgtgccaggaaccagggacaaagagcaaatacctattttttattatatgacaagtgggagcagaaattcagttccttactttatcttggccaaatgccagattaaaatgttactagttgggttaattcacatatatgtataaatatgttttccaatatatgattgaaggttagcattgttatatcataaaactatgctaaggagaatacaggcagaaaacaaagacaatacctctcaaaaaacccaacttttaattgaatacagagatttcattctcaaagaagagctccttattcctagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctacattactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccatgctgatgatgaaagattctgaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctctttcattctctttatgttcagctatgagggctgaattcatagtttctgtcatagtgtatgtgtttttaagacaaaaatggggagagaatatgaaaacacaaggaacttttccctaacctattttatagttaaacaaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcatgaccttttaattcttttcaagagttgtgtaaatttacaaaatgataggattatgtgaacattcttttaaaattattgaattattaagaattttttaggctgggcagggtggctcatgcctataattccagcactttgggaggccgaggtgggtggatcatttgaggtcaggagtttgagaccagcctggccaacgtggtgaaaccctgcctctactaaaaatacaaaaatcagccaggcatgatgtcgggtgcctgtagtcccagctacttgggaggctgaggcaggaaaattgcttgaacgcaggaggcagaggttgcagtgagccgagattgcaccactgcactgcagactgggtaacagagcaatactctgtctcaaaaaaaaaaaaaaaaaaaaaaaaaaagactttttgagtggagggaggagagcaagggtttaaaaactaactgttgggtactctgcctactacaggagactctacttgggtgatgatatgcccatgtaacaaacctgcacatctaccctctgaatctgaaataaaaatcgaaatttttttttttacataattttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaaaaaaaaataataataattttgtagtgatttgacatgtctttggaaagatgtggtattgaatcttctacagtttgttacatattcgatcgctacacactcctgctaactcatgtagggatatgtgacacaattggaagagatgatgaaaccatctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaggaaaactcatagacctcaccagtacacagtaagacgaaagtaaattaggaaaaaataatgtctgggagatagtagatattcagtatttgtttactggtgaatggatgagccattagcagtgaattatgaatatgcttgaggtttcttgtgagtcacctgagaaacgattaataaatgagaactttttataacccacacccagagtatatagatgataatggtgagcggaaagttggaaaaaagtttaaaagagaacaggctattgatatttttaggtagagagaagaagaaaagttcacctcctatttggcttttttttttttttgagacggagtcttgctctttcgcccaggccggagtgcagtggtgcgatctcggctcactataagctctgcctcccgggttcaagccattctcctgcctcagcctcccgagtagctaggactacaggcgccagccaccgcgcctggctaattttttgtatttttagtagagacagggtttcaccatgttagccaggatggtctcgatctcctgacctcgtgatctgcccgcgtcggcctcccaaagtgctgggattacaggcgtgagccactgcgcccggcccctatttggcttttcactatgatcagtttaagagaagacagggcaaggagagaggacatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacatccctgcccttagattctaggaaaatagtaaagaagacgaagaacaagacctcagtgtatccttttactacaagtgactgtaaatcaactataaaattagccatgtttgtaaattaaagttataattttggcccaataatttataatatatctgtttgttgtttgtaggagtggttctgattaaagcccagatttcagagctggcatttcctattacagcatctcagaagatagcgctaaatgctcacagttctctgaagagtattttttcttctcttcccaacatcgtatatactggttgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaattagtctgtaaacccttactttctaaaaataattaactagagctagtcgaagagaataaaattttccgagtgatagatagctatttatggaagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatagaatttaagggctaaaagtatcatatgatctcacctctgagttgttgtggaagctagtaagacatttaaggtgttttcccacctttaccttagaaattaaagctagcaaataaatgttgtatggtaaaactgctaatcagctcagtgaaaaacacattgttttttgaataataggtagtcaaaagctcagatatttttctctttacctcataaattacatgtgtttacaaaatagcactcagtgttttatgctccttatgattatttctaaatattgcggtatctaaaaaccaaattcagatatattccacatgttatcatggcatacttcaagaaaagttatagaagcttaatttgtaaaccttatttctctttacagatattatgtttgttataaataagtgaataaattttgctattactgtgaaagttgcttttgtggaaaagaagattgaattaagatgtatggtaggctgggtgtggtggctcacgcatgtaatcccagcactttgggaggccggggtggggggatcgcttgagcccaggggttcaagaccagcctgggaaacatagggaaaccccatctctaccaaaaaaaaaaaaaaaaaaaaagctgggcaggtgacataggcctgtagtcccagctacttgggaggctgaggcaggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatgtcattccaaatgtttctattcaatataagcatttattggacaaaaatgttgctcaatactattccttatggggaggagggcctttgaatctttagtttacaaaatgactgttcaagagaaggacttcacagatcagtatcacctgattatggcataactagtatgaggtatttaagatctcttcctaaactataccacattaaagatgtagtgctagtttgttgtcttactagaatgttgaatggtcatgttaaggcaagaattattattttttatttatttacaagccttttttttttattttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagtgcagcctaaaagcctttaaattgttattagagtccagattatatggtttccttgaaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatatgtactgtggatgttatactagttgacctaagtagacttattgtgcccaagaagcttggtagtccatttaagaaacacttaatgaacatttgtgtggcataacagtcccagactatgagtgggttgatcatattttacattggttgtaacttggagctgattttccaatggaagcaacattagatattgcattggagtctcatacgaggccacagacatttattaaattaacatgtagatagcatagttcctgttcttcaagctatcataaaactcaaataccatttttaacaatgtttctacagaatattcagatttacatttttggaatacaagaaatacatttatttttctgtactagaagcaaaaaaccccagcaggtcaaaccacaattaaggctcctatttaggcagcactaggaaatgtttgggtctctcaagaggttatagtcaaggtgtaggctggggctgcagtcatctgaaggcttgactggggctggaggattcatttccaaagtggctcattcgtatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagttagctgtgcgttggagagtggattagaatgaagctagtgcagagaagcggtaagaggctgttgccttattttggaggggagatgatggtggcttgactagagaggaagtggtaggaataaaaagaagtggacagatttgagaatggtcggaaaatagtttgcaagatgtagtgattggtaggtaaagagagagcacaggtacattgcaaatcattgacagttgggtgaacaataagattatttattaaaacaagtaaccttgggagaaatgttgatcatattgagcttgagttcctgagaggtaacaagttggaaagtggttagatgtaaagaaatgcaatttgcaagagaagtctgggctaggcttataaggttatttgtggtaattgaacttttgcttggtttctgcaccctgttttgtttttccttcttaatcttcagtgattacctctcataatggattattctcactagcctataaagacactcccatatttcttttattaaaaaacaaacaaaatcatccattaacattacatctccctcttgtcccttcgtttttctattctgttttatacccagccaaactttgttaaagagttttaaatatactctctctcccctattatgtcttcagtttcacttcagttattccattctactcctaccatgctgcagaagctgcttttgtcaaagttacacttttgatgttgcctgaggcatggatacttctttcctcactctaactgctctcagttatattcagcatgtcagtccacttcctccttcttgaaacagcctcctccttgctttctaacctgtctctcaggcccttctttctcagcctcttctaccccctctttaaatgctggggttaatcttgagctctcgtctgcgtccttcctcttattctttctgtacattctgcctggatgatcacagctgttttcgtatttgtacttaacatcttcaccctgattttctcctccaggctccagtagtcaggtatcaaattctttgcttgacgtccatctcacatttaaacatacccacaatagactcttgtttttcctaaccacactcaaatctagttctcttcatttttatactttctggaaaatggcacaccatctacccaattatttaggctggaaacctgggcacaatcgtcgcatcattttctcttccctacctcccctatctaatctattagcaagtcctaggaattttcattcagaactatatcacaaattcatccacttttttccatctccactgctaacatcttagtccagtgtatctcagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctacgacctgttgcgcaaaccagcacaccagcagtctcttggtggggctcctcctggccttgcctcctcccctttattctctacccattggcagtgtgattaccctttgcctttgcttcacccatcagtcgtctccttatgcttgtttcctctgcagtctcatctgctgccactcccctgtcgtccagcactctagccacgtggccttctttcagttcttcattttgatttttctccttaggatgttctcgaatgtcttccttctgtctgactccacaaggctggtttcttcatgtcttagattaaatgctgctttatcagagaggcctttcctaaccactcttctttattttctgttatagtagcctgggtgtgcttactgtaatttgtagttgcatactgtcttttctagaaaacatttttactgaagttaaaattcatataccatcaaattaatcttctgaaatgtacaattcaatggctgtagtatattcccagggctgtgtagctatcaccacaaccagttaggacattttcgtcacccagccctttacaaagcctcatactcattagcagtcactctccattccccatgcccctcaacctatggcaactacgaatctgctttcggtctctatagatttgcctgttctagatattttatataaatattatataatatgtgatcttttgtgactggcttcacttagcatgatgttttcaaggtccatccatgttgtagcatgtatcactacttcctttttattgcaaaataatattgtattgtatgcatataccacattttatttatccattcatcagttgatggacaattgggttgtttctactctttggctattatgaatgatgctgctgtgaacatttgtgtacaagtttttgtgtggatatgtgtgttcatttctcttgggtatatatttaggagtggtggaattgctgggtcatatggtaactgtctgtttaaccttttgaggactaccaggctgttttccaaaattgctgcacaattttacattctcatcagcaatatgagggttgtaatttccccatattcttgccagtacttcttattctgtatttctttttgttgcatgtgctttcgggtcgtatctaagaaaggtgtcatttctaagccaaggttatggagatttgctcccgtattttcttctaagagtttagtagttttacctcctacatttaggtttattatctactttgagttaagttttgtatgtgggataaggaaggggtgtaattttattttttggcatgtggatatctagttgtcccagcgtgaatttttgaaaagactgttccatccctgtttagtcatcttggcaccactgttgaaaagcttattttctttcttcttctttttgtagagatgaggtctcattgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttatatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgtcacattaaattcccccgctaatgagcctgtttctgaattctgttctcaatttattttttaaaaatcaatgtagttataaaataggtaccacatgccatgattaaaatgcacactacataggaggttacaaaacaaagagtgaaagtctccttcaccatccaaccctctctcaccagtgctgcttccattgctggtgagaaggttttttgtatgtccttccagtgatttattatgttcatcccagcacatgtgtatccctttctttagaagcatgtggacagaagaatattgttcatgttgttgttccctagagtctatcctggtgctccttccctaatagcacttgcaaatgttcttcattctttttatcagctacatagcattaagatgtaggatgcactgaaaattgttaatccagttccctgtttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaaaacctttttttccttctaggatgtcacagaacatcctagagttgttttaggcattcaaattaatcctgcataaaaaccaagtgctttttggaattatttttcatttaagcatttcttttatctgaaaatctttttgaaggtcgtgtgttgtttactcttttgtaggccagcgttaatgactgccattgatggaagacatgatgtttgtatccgtgtagaatcaaagctgatagagaagattcttctcaacatttctgcagactgcctcaacagagtgataggtaatatatcagtgtgccatcaagaagttgttttattcaggagtataaatggtatatcggaacagaaagagcactgtactttaaattaagagcttttctgtccatatgaaaaccgaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagagtgaagtcaatgagtgtgtgacataatatatatgaagatagtccactgtcagtggaatggatttgcaagatcttcaaccgtgatgtcttagttgtcagtggctaagaataaagcaaagataatatatttgtcaggtattcaaactccattcctgttctcattagcctcagatcctctaagctgatgagctaatctggttccgtgattgctttatctttcaatagtagattgtttttcgtgtatttttttagttgggggtgtctagtaattttgggttgaatgctgaacattgcatatattaagtagaacagtacaaactgaggtaaatagtatttgtacctggaaacaggcatgcctctcggtcctttactggaggtgaggggtgagcaggatggtcagtcttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccacgttcttgcacctccccaagttgcacaagcttttgttggttgttatttggtgcatcctaacctggtgggcgggagcagggttgttcctctttgattctggtccagccccagtcttatacaggatgttgaatatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggggttttttttcttttttctttcccccatctgtactggttcctcacctgtaccctggggcaacaggatttggtgtccctcctccagcagttgaaggcttttgttccttaaaggggaggccagatggtgctttgtgttttgtagttggaagctttctctgatgtcttgccctgcccccagtcttatgagcacctggtggaggtgagactactatgtggaagagcctgtgaggatgcagatgttccttatgttgctgacactggcagttcattggctttttgcaattaatttattaataaaaattaatcacattcttctttcctgcctgtatggaggacctgtcttcttcccaaggcctgccccaagggaaactgtgctcctgttccatctccctggaggcacctgtctccttatgtttcagtctttttggctgttttacaaccttggttctcatgtgtattcaagaaaatgatgatttgatatttattcaattttttccagtaactgttagggtaggagccactttttccagctttctacatcttaattagaagcctctctccgtttttttcccccattttctttatttcatttttattcttttggctattttcattccttttcttaatgttacttatatattttcagtgtaatctcttcttttttttttttttttgagatggagttttgctcttgttgcctagactggagtgctgtggtgcgatctcagttcaccataacctctgcctcctggattcaagcaagtctcctgcctcagtttcgcaagtagctgggattacaggcatgcgccaccatgcccggctaattttgtatttttagtagatatggggtttctctatgttagttaggctggtcttgaactcccaacctcaggtgatctgcctgccttggtctcccaaagtgctgggattacaggcgtgagccaccgtgtccggcctatctcttcttttttgcataatgtaaattagtctttatctcttagagaagcatcattctcatatcacatatacttcagtgttttgtccattcttgagacaattaaagttgtactacttggcattaattagattgtgatcataagtcaaaatgtcattggttataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggttgatggtgctctgtcattctggtattgaacaacctgccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcacttttctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagagacagagtcttgctctgttgcccaggctggagtgcagtggcacaatctcagctcattgcaatctctacctcctgggttcaagcaaatctcctgcctcagcttcccgagtagctgggattacaggcatgtgccaccactcccggctaatttttgtatttttagtagagacagggttttactgtgttggccaggcatgtctcgcactcctgacctcaagtaatccggctgcctccgtctcccagagtgctgggattacaggtgtgagccaccgctactggacgggaggagaaatttaaaatgggtttgagacttgaggaaccaaaagaaacaatgaaaccattcaatgtgtgtgctcctgtcaagctagcagcgatcttgggagctctgtgtttttgtcttttgcagttccttcctcagagatcacctatgggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagatatataaattaaaacttttttctaagaaaatcctgtgaggtttaaaaagattgtttttgtcttttggtttcttactttctcctggagaaatgatctaccagtcaaggcaatatgtagcagatccctgggaattaaaggtttgcccatttgttcactgtatttagtccctgctacattccaggcattgtactaagtatggggaaccacagagaagacattccctcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaaatgaaggaaatgagatcatgtttcaatttattaaagcagggaagagcgttctgtgcttagttcgtgtctaggatttgagtgccttactgaatgcatttaccagcaaacatgtagcaatctgttctctcattgtgattgtggaagaagctcatgtaaaatgatagtcattaatgaggaagtatggcgtggtacttattctgtaagttcagagtatgctgagtgttaatagattatcatattgcctgaaaataaattcatgatgacatg

SEQ ID NO: 38609 - DNA, 2357 bp, Homo sapiens
agacacctcctgcttccctgaccacaccccctctggagaacctaccttctctagccccgcctcctctgcagacagcttctgctcccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagacgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgctggctttccgcggagccccaggtaaggggcaccccagacccggcctggctgtgggcggggtcggaggcgaggcttcgcagctcaggggcgggacagctgggtccggggcggagcttagacaaggaggcgggaccttgaggcaggggcggggcttatcacccccacggcccacctggcgtctctccccgcaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccacagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgc

SEQ ID NO: 38610 - DNA, 3919 bp, Homo sapiens
gtgcggagccgcccgtaaggtacggaggccgcgagccaggggccgggaaccggctgctgggtggctgggagagcacggccaggggaagccggccagcaggacggagcaagggcggtcaccggaggaaaggggagctcgggggtccagccagactgcgccctttcccatcagggcctgccgctggcctgctacgcatgcgcagccgcagcgctcggctttccccggcccatccgccgccttgcgcacgcgcagcccgcccctgcggcagagtggcgcccgcgcgtgactcccccctgccggctgcggaggtgggggggggacggcgcccccgccgtgtgcgtggggcggggatggagcacgcgccctggagccccggagccaggtatcacgcgtgtgacgcgtgtccctgaacctacctgcgcttcttgtcccaactctaaaatgggaatgataagcgccattcggcagcgccttgtgggtctataatctacttagcacagagagtgtcttctaagtacttcacatccttctctgcagatgctctgacctttgacccctgccgttcagctctagggcccgtgcaggccacaccatgaacacctccccaggcacggtgggcagtgacccggtcatcctggccactgcaggctacgaccacaccgtgcgcttctggcaggcccacagcggcatctgcacccggacggtgcagcaccaggactccgtatcctccacccggggcgggcagggcggcgctggggggatgcctcgtgtggggaccacagcctgtgtgaaggccagatggtggaggcctggggggccctggcctcagggctaccttcccgtcatcctccttaacagtcccagcaggtgaatgccttggaggtcacaccggaccgcagcatgattgctgctgcaggtatctgtgatccttgatctctaaactcctgagctctggtgggtcgacctcagcacagccaagcttcagttcagcctgtgtccctaggttaccagcacatccgcatgtatgatctcaactccaataaccctaaccccatcatcagctacgacggcgtcaacaagaacatcgcgtctgtgggcttccacgaagacggccgctggatgtacacgggcggcgaggactgcacagccaggatctgggacctcaggtgcggtggggagggggcgtgctgcccggggctggggtgggctgctctgggagaccgttttaggttgggttctcttcaagcagaggctgagacagggagcttcctgtgggcgacttactgagagaagtgaggacaggaggagagtgaattgcatcagagcgcgagtcctgccttgagcccggagccagcttgttattccccttccaccagccactggcttaggctccctgctggagcagagggccctgcgtcccaagtatttcccaagaggcaggtccttcagcagagggaggggaggaatggccaggccgaggccatctgggtagggcaccaacaagcccagatggacagcatgtgccccggcccggcccgcaggtcccggaacctgcagtgccagcggatcttccaggtgaacgcacccattaactgcgtgtgcctgcaccccaaccaggtgaggggtgctcatggggccaggcaccctgggactttggagggctgggcttgggccctgcctcaccacccctgcaccccaggcagagctcatcgtgggtgaccagagcggggctatccacatctgggacttgaaaacagaccacaacgagcagctgatccctgagcccgaggtctccatcacgtccgcccacatcgatcccgacgccagctacatggcagctgtcaatagcaccgtgagtcctggtggcaggtgctgggtgcgggcagcttggcactcagccctcagcctctgcaggtgggcttattcctggatgtcccttagcggccccctcctgctttccccatcccgggcactaacacccaccttgccagcaaagccagaagccttagtgtcgctcccgatggcttagtcctgtctgcaggtcggtcactccgctttctggagtctctcccaagtcgatccacttccctcttttcactctgttgcctcctggtcccagtcacccttgtttctggtgacggctgacacactctctgaggcttcctttccccctccctgacctcccctggcccctgacacgttctctcttggatgcttctagtggtgcctggtcagtatcagccaggtggcgtcattcccctgaggagacccggggctgctggcctcgcccgtaggctgctgtggcgtggcccctgctcttctctccagcctcattttttttcattaacttcatttaatcccagtgcatcacttgtacctcttgcccccggatttcccttctgctggcctttgtcatgctgtctctctagctggtgcccttctcctgtctacttccgttggccatcggcatcctccaggaaggagaatttgagtccttggccaggcgtggcctcctgttcttggcttgccaggtgtggcccttgcttggggccaggcttcccaggtgccttctgcaggcaggaccagaggggcctgcctgcccctcacccggggtccccatgcacagttggcccccagtgttggcccccagggcatccttccctgtgtctcagacctgaggccttgggccctccgtgacggtcctcctgacctctagggaaactgctatgtctggaatctgacggggggcattggtgacgaggtgacccagctcatccccaagactaagatccctgcccacacgcgctacgccctgcagtgtcgcttcagccccgactccacgtgcgtgcagggcctgctggcccgggaggggacctgcctgggctgggggctggagaggggaggggctgctggatggagtggctgctgctggacacgccccatgcccacccactaggctcctcgccacctgctcggctgatcagacgtgcaagatctggaggacgtccaacttctccctgatgacggagctgagcatcaagagcggcaaccccggggagtcctcccgcggctggatgtggggctgcgccttctcgggggactcccagtacatcgtcactggtgagccccgccctggcctcccccatccctggcccccggcgctggcctccagagccagcccacctcggctgcagcttcccctctgctggggccgcctgcttggcctgcacctgcgctcttagccctgcacaatctccccctccagcttcctcggacaacctggcccggctctggtgtgtggagactggagagatcaagagagagtatggcggccaccagaaggctgttgtctgcctggccttcaatgacagtgtgctgggctagcctgtgacccctcgggactgcctggtgcaggtggtggcagctggagggacccatgcagcacccaggtcagagcagaccctcccctgccggcctgcgccagctggacctgatggccccctgtggcgccttgacctgctgggccaggctgccctgggactctcagcccccagttgcttatccagatgtgacagagctcgacccaagccaggctgcacactcctggactgggctagcctgcactgcctgggaaagtcggccgagggcccaaagctgctgaggggtctgaggctggtgcccacccccaagctagtgtgttctctgcccctccctgcccgcgtttcagggcctcggtccatagagaacaccaccaccatggccaggtggaagggtttattagtccctgccagcagctgtcctccctggtgcaggtggcctggccagcccactggattggggacgggccaggctgggccaggtcgggggctcagtctgggaggtaataaaagcagaccgacacgcagatgttgctcgggaa

SEQ ID NO: 38611 - DNA, 2581 bp, Homo sapiens; identical to SEQ ID NO: 38320

SEQ ID NO: 38612 - DNA, 13876 bp, Homo sapiens
atgcgccgcgctcgctcgcgggagggcatggcgggggccgtgccgggcgccatcatggacgaggactactacgggagcgcggccgagtggggcgacgaggctgacggcggccaggtgaggcggggcactgggcgcaccctagagagaatcgttcgtctccgccgccggcgggccggccccactcccggagaggccgcgcggcgcgaggctgcgggcgtgcggggggtgtgcgcgcgcacggcccgcgcggtcaccgtgtggttcaagcacagcccgccccgcccccgcccgcccggggtcccgcggcgcggccgccggggtccccgcctcctcgcctgcaggaccttggggtgggggtgaggcgccggaggctctggcgcggggcggcccgaggcccccagtaccccctcgctccggccaggcccggcgccggccctgcgacccccgcggcgggcgggacaccaacgctaaggtggagggttgggtccggagctcacagacttttaaacaaaaataaagtggaaaaacttcacagcagcatcatgaggaaaaagtagaacttagggcattcctacatgtgctttactgttttataaactgtactcttcagcaccttgggctgatttcatctgtttttgggcaaactgatggaaaggattttcgggccttgaccttccagggtttggggtggaagcccaggagggatcactgttccaccctgaggacagggactgcagagccagggcaggtagctctagtctggacagtgtgtccccaccttactctaaagacccaactgaggcgcatgattgaaatgtagcttctcacgtccctcccctggagacggcccaacagttggtctggacgggagcctgggaacttgcatttttttttttttttttttttttttttttttttgtggtggagtttcgctcttgttgcccaggctggagtgtaatggcgccatcgcggctcactgcaacgtctgcctctcggattcaagcgattctcctgcctcagcctcccgaatagctgggattacaggcacccaccaccatgcccagctaatttttaaaattttgagtagagagggggtttcaccttgttggccaggctggtctcaaactcttgacctcaggtgatccacccacctctgcctcccaaagtactgggattacaggcgtgagccactgctcgtggcccaggaacttgcatttttaacaacaatcaagattggggatgtctggtgcattttgaagtggtattataagggaataaaggatgaagtggggcttacgttgataaacatgggtggtggtgtgatggcggcttcggagccatggtctaaaatgccaaggcgggcgatgtgtttctggaactgaaagaagccctgtgatgttagctgcctggtggaagcagtggcaggaggtcagtagggagcaggttctgaagatccttggagagctgctgaatggtatggcttgttcaggagtttggggcagggagtgacacgagtagatttgcatgttggatcatttcacagtgttggaggcttagggtggagtggatagagtcagacttagctaactgagagcttgggccatgtgtgtcatgcgttatccccttccacacacaggattttgagttgggtgttaccctacttatctggtaagtgtagaaaatgagacgaaaagacttactgacctgcccaaggtcatgaaactaataaaggaaggagaggggacccaaacccacatcctttgcctccgttgccacttcgtcaaattgctgactaccaaagtggtccagatgagaaggtgtgaattagcttagtggtaggttggtgtttggggcatctagtatatcaccttgagcctttttttctttttttttttttttgagacagagtctcgcttagctgctcaggctggagtgcagtggcttgatctcagctcgctgcaactgccatctcctgggttcaagcaattctcccgtctcagcctcctgagtagctgggattacaggcatccgccatcatgtccggctaatttttgtattttagtagagacagtgtttcaccacgttggccaggctagtcttgaactcctgacctcaggtgatccgcctgccccggcctcccaaaatgctaggattacaggcgtgagccaccgcacccggccttttttttttttttttttctttgagacggagtctcactctgtcacccaggctggagtgcagtggtgccatcttggctcactgcaacctccacctcctgggttcaagtgattctccaagtagctggaattacaggccggtgccaccacacccggctaatttttgtatttttagtagagatgtggtttcaccatgttggccaggctggtctcgaactcctggcctcaagtaatctgcccgcctccgcctctcaaagtgctgagattacaggtgtgagctaccgtgcccggcctcaccttgaggctttgagtcataaagtgttagaactggggcatataagggccatctaatcagtaccttcactttatagaccaagcacgtgagttatttgcccaagtttgtgcagtcagacctagaccccactgatgggagattggggagtctcatgtttggggaattttaatcatgatcctaatttggcccactgacaccagtgggctctcatggatgaggggggtggaccagacgttcatttcatgtttattctgtgactctgcttggaagaggtacagaaagttaggaaaggtgttaggagggtggcaagaactggattttaaaagatagttggtgacccaaattctgttcgcctgatgccatgttacatagtgggaggtaggaagatgtgtaaggaggccaccgtgatgttcagtctggatggtggaaactaagagctgcagacatgcaaatagatgagtcctgctacagattgcaaatggggagtggtgagaggtcagaacggacaggggaagtgggaagggcacgctcttgctagagctggggcgttttttcctgaaggagatgggaatctttaagcaggagagagacgtcagttttgtggcttacaaagatcactgtggccacggtgtgaaagatgattgaaaggaaggaataagactgagacttcaggggaatgttgctactgcaagcatacaaaaaataaggaagagcagaggcaaatgtggaaagaaggaccaccttggatagacagatgggagatggaactgatgagtctttgtgacaggatgtgggggtggggtgagggagagaagctgaggatgattttcaggtttggggggtaacaagtagatatatgaaggatacctttacggaaatatgggttgtaggaagaagatctgtttctagggaagagatgtcagttttggacctaaagagtttggatacttgtgagacatctgactggaaatgagaatggaatgttggatacctgagtctggagcttaagagaggaaagacggagagagagatccaggctaattctagattggtgagcaggtagatagcatgacccaagaggtggtggaagaggcaggtaggtgagtgcccagggtggaagcccaagagaacagacaacgtgggaatgaagctcggggtgaagtccggcctctgtcatgcccttaggggctcagcgttccccatgcaaatctggtctgagagaagactccacagcttttactgggaagtcatcgggttctgtctgctcccaaagcactgcttttaggatcttagtccagatcaggagtgagcaaacttttctgaaaaaggctagatagcaaatattttaggttgtgcctgtctctgtcttaactacttacctctgcccttacagggggaaagcaatcatagacagtccttaaaagaatgggtgtgctgtgttccgtaaaagtttatttgcaaaaataggagagggctggattcggctctgggtcatagtttgctgacccctggcccagctcttgccccattatgttagagtaggttgcatggaggtctgtctctcctattagtttgtgaacttctttgatggaaaaagccttgtcttgtcttacattttcttaggttccttggttgatgagcatagtgcagactgaatgttcaaaaagcatctgcttgttagttagggtggcagtgttaaagttggacagggtttgggatcacagtccatcctcacatggtcattagcaggtgaagaagcctgctttgcccttagatggagtgacaggcctgaagttgcttccacatagaattgggactggagtccagccagaagtgtggatgcaaggcgagttagtggtctttactttctaatggtaagtgatggctcacgctttcaagaatcaggttgttactcttcagtggcatgtatgaaataagaatagtgaaaacaataataataatagtttactatttattgcactgttacgaaatgtcagggattatgctgggttcttccaaaaattagctcatggaatcctcacaacagccaaatgggaataggcgttattattatcttcacttaacagaggaggaaatggacactcagagaggttgggtaacttgtgtgagcatggaacgcggtttgccagggaggagttgtacacacccactcagtgtgatcctggatcccattttcctagccactcactatctgtccagcccatttcatgaaattgtcatgaaagtcaaatgaaataatgtgtgtagaatactttcaaaatgggcagcattatacgatttaaggtgagattagggtatttgtattaatgaaaaaaatatcctggctcttcgcatttaccaacagcaggaggatgattctggagaaggagaggatgatgcggaggttcagcaagaatgcctgcataaattttccacccgggattatatcatggaaccctccatcttcaacactctgaagaggtatgtgagaaaggtgtctgtattgggaggaggctgggggtaatttagagaaagttttgtaatacacccagaaggtgctatgtaaagcaagagtaacgcgaactgaactaaaggcttcaagggggggtcccctctgccactttttttttttttttaaatttttttaagacagagtcttgctctgttgcagtggcacaatcaccgctcactgcagcttcagcctcctggaatcaagcagttctcccacctcagccttgcaaggtggccaccacaggcgtctgccatcatgcctggctatttttgtttttgttttttgggagagacagggctccttacgttgccctggctgctcttgaactcctaggctcaagtgattctcccacctctgcctcccaaagtgctgggattacaggtgtgcaccactgcacccagccccctccgctgctttaaaaattttgaaacctgattctcttcctccttccttaccttcctgttgtccatcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgctttgtgggtgtcccctgtcctggctagttacccccacttttttaaaaatagacttttgggtccttataacactgatacaatgccttctttgatttcctggtttctgagacttgtgtaagaaagagctgaacttcttactcatttttatctttatcttactcatttgtatctgcttgcctcttatctttgattcagtaattgaggtttactggtagcctgcaaacgtgattctcattgagctgttttccctaccatgttgtagaattataggattatacagtgtgtgttcagtgtgtcattttcaagacgtctattacagcaagcagtaaatgacggataatttaggactggctgtgattatggcttttagttaatatgatcaaagtagagtcttactgtaaatccacggagccgggtgcagatgacatcactgaagtgcgtgctgtccggaagcttgtggacacactgctgtcccggtgattagatacaagtgtgtctcttttggctgccatctgctccctcctcactgggcagggatgtttttccatccccctacctgttgctggggccatttgtctttatcctcagtgaggctctgcagatggtgctgtcctttccatgaagttaggggtggaccagacttgtgtgttctgttctgtgctgctttttggtcttatcattgataactactttgaagagttccaaaaccttacatgtataagtggtcagaagcaattctttggtatttgattcacatagagacttttgaccatttgctttctaaagccacacagtgaatggacagcttgccattgtctagttgcttttattctctttcaggtgttgagccagtgcaggttcaggaaactgtggaaaatcacttgaagagtttgctgatcaaacattttgacccccgcaaagcagattctatttttactgaagaaggagaggtgagaaattatttttctttgcctagtaccaggccctagggtcttttgcaaattccctgtgtacagtggagcgtggcatatcatgtaagtaatggcagagttgaggactaaaatcagagtgtgagacagaagttgcatctagtcagaattgccctttaaactctgtacccagggtcgtgacatgcttgcacgcaagaggcacacaggtgctgagatcaagagaatgaacagcaagttcccaccatttcccctctcaggctgactccagggcacagcccttggagtgttgtggtggattcgtttggttcctccaagaagcagctgccaagacagggctaggcctgcaggagatgatggggaagcgactatgagggaagatggggtagggctggaggaggctggggtagctgtgatgcagtctgacccttgagggcaagagaaaaggaatgagggttagtaggaagaatgttaggctgcagtgcagtttccagaacgttccagccatatcagtggggaatctttaagccacaggtgcccattctgggagcccacgtctcctggacaggcctgcttttgaggccctgctgcattccatctgtggctgggagcagcctcggggagctggccttggcacaaacaggatggcaggttcagagcacagtccttgaggacatccgtcacataggagagctgagagaaatgtttttctggctactccatgtggtgatgggccagaacacctgtgccatttaaatggcctctttctcttttgctaagggcatacaagctggggcagcatgagctccctgtgtgtgcaaggcagctctatgcggttctcggtgtctcctaggaagcaactttcagtaccctcctgtgttgagtccgattttctaaaagctgagcgggcatctagggacctttctgtcactcagccgactgtgtggctgtggccagctctgggtctgcctcccccagaactagatgcccatggggagtccatcagcaccaatctcctgtgatcgtttatacaacagaatctccactcaagtaaaagtggggcctcctcctatcttgctgtttgtgtgtgtgttggcagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccgtaagttctttctttatgaacctcagattagaaggaggctgctttgggtcttggttttcaagcatgagatgctccttccctggagagaatctccatttctgagggcaccttccaggatgctcactcccgggcccgagcacggtggaggcttggctctcgtccgcccgtctgtgctacagtagtaaaccctgccccctctctccctgcaatcttgcagaagatggtgtgccacggggagcacacgtacctgtttgcccaggccatgatgtccgtgctggcccaggaggagcaggggggctccgctgtgcgcaggatcgcccaggaagtgcagcgctttgcccaggagaagtgagaggccctgtttctgctcagcccttccttcctagtgctccccacaaaacccttcccatggcccgtgttccacagccaaagctgctagctccttctgttcaacgtagaggtaaacttgcttttggctgggcgtggtggctcacgcctgtaatcccagcactttgggaggccgaggcggatggatcacctaaggtcaggagtttgagaccagcttgaccaacatggagaaaccccatctctggtaaacaaaaatacaaaattagccgggtgtggcggcacatgcctgtaatcccagctacttgggaggctgaggcaggagaatcgcttgaacctgggaggtggaggttgtggtcagccaagattgcaccattgcactccagcctgggcaacaagagcaaaactctgtctcaaaaaaaaaaaaaaaaattaaaaacttccttttatccagcagagctggaaaagttggagttgtttttggtatacttggagagctggctttctaaagtgctgctttgaggactgttgtgtaaagcacttgattcgtcttccctttgctggagttatgggcctgggcttttacactggggttctgaagtaacaaacaaagtcagtccagaaatagttgctcagcaatctcattgttacagtgtcgcaaaatgagctcatattagctttattttctgctaccaatagagtgttcctaagtatttaaagtgtgtgactcctttcttatagagccagcaagctgtattggaatcacttttccagtgttgtaaatgttatttttgtgggtcagtcagtatactcgtgaatgacagaaaaacagatcccaacaatgcaaagtattatatgtgtaaaaaagaacagaaaaaagaagctgccttgttagtaacggggtctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttgtaagttgcttctcaagaatccccaatgtcagctggtaaggtgactttggaaagtctgtgcttgtctgattgtctgaaggctgtgaatgcaaatccatcattgtcctggtccttcctcagtcacactctctgcctggagcctgttgggcccctgctgtgtagggaaccctgaggggaggtgggtgagcagtgccctcacgcctgccatcccgaactgggcatatgcttctcctcagatccgcgttccagccttcctggacctgttcatgcagtcactctttaaaccaggggctcggatcaaccaggaccacaagcacaaatacatccacatcttggcgtacgcagcaagcgtggttgagacctggaagaaggtaccatcggttctgggaatttgtggattttttaggagacaaatatcctcctctgctttgatattattttggaattttggctgcaagaaatcttgaccctccctagtatcaggcatgtgttttcttgtgtttctgcgtagagaaagcactaaacgtctccagaaaatgtgcgtaatgtctccaatgctctgcaaaccgtaaattgaaatgtgactaaagaaatgaaactgatttccgtaagacatggacaaacactagtctcattgcttttcagtttctgtacactgtgtgactgtgaagtttgacagctgaattgactcccaacttaagtagaaatagggaaagtgctttgcaagaagtggccgacaccagaacaccccgacagcagggatatctgccctgtcaggctcaccagcttgtgtgtgtgttttcagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtaagcaaaacgaaactcagttcttaaatcagtcctttggggaggaggtcgtttgagttttcatattgaaagctcaaataacaaaagcttcagcgatacttgttcattttatttattttttcatttttaaacagtatgtagggaactttaaacagctttagcagcatgagtaattttcagatgtttatttgccagaagtctgttgagtacaaattaggctaagtaaaagatagccagagttaacaaaaattgatttgaagggtctatttataggtaaagttatgcccacaaagtattgcttacatagaaatgatttgtgattatgccaatcatataaatagacgtgtcctagaaatagtgtgtcctcttaggcatgtctttcccctaataatttatactagggatgaagaaagagtttgctaaataaaggtaaacttcaacccagtccaccaaactcactgagtatcactcattaatgatcttttcctttcgataagtggtttaaagtgagcagagaattgaactctgcttcttgcaccgcatgttgagtggctgctgatccattcacactatttactaataagcagagcttacgccaggcacagtggctctggcctggaatcccagcaatctgggaggccaaggcaagaaaatagtttgagcccaggagtttgagaccagtctgagcaacatggtggaccctctctctacaaaaaattagctagacatggtggcactcacctgtagtcccaggtactcgggaggctgcagtgagccatgattgtgtcattgtactccagcctggaagacagagtgagaccctgtctcaaaaaaaaaaaaaaaaaagggttggggggcgtattgaagggtgaatgatggagtcatttgagtttgtttttaactttcctttaatgcttttctagcatattttgtgttttaaattgttttttaaaggaagcattctgccttaactgtaggtttccagtggtagcaatgggtgtgctgaagtgggtggattggactgtatcagaaccaaggtactttcagctgcagactgaccatacccctgtccacctggcgttgctggatgaggtaagagggcggagagctgttcacagcctacacagtgtctgtctcatgctgtttacgttggcattaacattgcatctattcagtgagtttagaggatactcttctcaaaaatagttatttctgtcctgaggattttcctcttaaggacctagcttcattgactgcagaaatttcttaacctcagtcaagtgttactggaagctgatggccctggcttaggtgtcaggaccttcttccacagtgataagctctttggtggctgtgacagtgcccagtttctctgtgtgctgagcgtgaccacactgctcagcgaagctccctctggcctgtttgtagatcagcacctgccaccagctcctgcacccccaggtcctgcagctgcttgttaagctttttgagactgagcactcccagctggacgtgatggagcaggtgagcagtgcccgtggggcttgccagagggctgaggaggaccctctctaaccagctccctgtcccccttcttctgtagcttgagttgaagaagacactgctggacaggatggttcacctgctgagtcgaggttatgtacttcctgttgtcagttacatccgaaagtgtctggagaagctggacactgacatttcactcattcgctattttgtcactgaggtcagcaatgcaccgttggtttcatgtttcatactgtttacactagcactgccctttttggcttaatttagttcattttgtacctaactgagaactgtgctttctgatgtagtgatgacaatgacagatactcgtttaccaaaaagcaccttctgcctgcagcagctgtatgacacactttacctccattaccaccctgggcatctgaatgttggagatgggtggtgtcaccggccggtgggggtggggagggattttttccaaactgatggccatttcacccggatgtcggtggatgccccgcactagtgtgcggaagaagtcaccctgtgctcccccacgcaggtgctggacgtcattgctcctccttatacctctgacttcgtgcaacttttcctccccatcctggagaatgacagcatcgcaggtaccatcaaaacggaaggcgagcatgaccctgtgacggagtttataggtgaggccgactgcctagccctttactacaatagaaaatgtcagctgggcgcggtggctcatgcctgtaatcccagcactttgggaggccaaggtgggtggatcacctgaggttgggagttcaagaccagcccgaccaacatggagaaaccccatctctactaaaaatacagcattagctgggcatggtggcacgtgcctgtaatcctagctactcgggaggctgaggcaggagaatcgcttaacctgggaggcagaggttgcagtgagccaagatcgcgccattgcactctatcctgggcaacaagagcaaaactgcatctcaaaaaaaaaaaaaaaaaagaaagaaaatgtcatgttctacttcctgtttctaacacagtcactgttttcctcgttaaagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggatt

SEQ ID NO: 38613 - DNA, 123366 bp, Homo sapiens
tctcgcccttgcacgggtcacgattatacaccttcgtgacctttagcgggcttacatatgtatctttttgtgttccgcaggctatgaccacctgctgtatgtacaatatgtgcttgttacatttgtacaccatctcccttctagaatttaaagacctagctattacatcttgtttactcaatatcattcccccattaaggaaaaaaaaaaacctacatgaactgaacatgccatgtttcaatctggccccagtggctttttctctgaaagcaaacgtgtgtcttttacaccagggctttctccccaccccagggggtgtcttccatccttttgtggctcagttgaaggcgaaaagggctccaaaccactaactaaccagaggagagccccttcttccacctccagggagaatttcagatttaatttgtccgaagatagcgtgctctcttcttactcatttgccatcattacgaggaaaacaaaccaccaccttggcttcaagatcctgggtagaggctcacggtcttttcaaccatctttggcgaggccttgcttccttccactcgagtaagtcgcggcttggggccacggaaaggactgggtgagagcccgcaatgtcgttggaaaaaagcagccctccctgcgccccctcaccagccccaccaccccgctccactcccggggcgaagccgcgagccagcggccccgtatgggcgagacttggcaggtccgcggggcgccttctcgccgccgccggactcggggctccgcagcggccgggcgtcggcgcccgccggccgcggggcttcgcgctgccgccgcccggtcccggagctcccttcccccaccggccgccccctccccctcgcccgcgctcccttttgttcgctcgccgcccgggccgagccgccgccgccgccgccgcccggcccggcggcgaggccgctccaccgcacacgcacacacagaccccggcagcgggaacgcagatgacacgcccgtaacatggaagccgccgccgccgccgctccgacgacagcagcagcagccacagcagcagccgccggcggcgccgcgctgaacaaaggtcatccgagctgcggcccagacgcccgggcttgaccgccgcgaaggccaaccccgggaagggggtgggtgtgcgcctctgggggtgcggggcggcgggaggcggccggggcgaacgaggggcgcagggcagccggacccaggggcgcgggtgggcgccgggcagaggcggggtgcggcccctcgtgcccactcctgcgggccggggtgagcgcgtgaggctcaggcccctgggcctgcccgcagtggcctgtcccaccctggccttggggacagccggccttcgcgccccgccagctggcttggggggccgaggaggaaccgcccgggctaggccccgcaggttacgagacgggggccacgtgagcgcggctctcctactccccccgccggcgccggccgggcacagatgcgtttccagaggcctccgtgccccctctcccactggccctgccttcgccccccgccccctccccagacagccccagttttcttcccccgaggtgaagggatttggacttctccccccaggtgcttgaaagaagagaaggttggaggaggaggaggagactggggggctgctggtggtggtgacagggctgggagagagaggagagggacggaagggaggagggggctgggtggggtgggggtgacagcagagaggagcctggtcaacaagccagcaccactgtgctaggaggccaggccggctctgcagccgacgcatcccgtgtgagcagacacacatagctcgctttcttgggggctctttgtcagccaccaacacagagagcacacactgacacacacgtacacaaagatctgagccaggttgtgggaggtaagtgggggaaggagaaggagggggaaacagtgtctgcggtgggctgtggggtggaggggaggggggatgggccctgaggggctctggggtgcttgcgaggtgagcatttccaaggctgtgtgctcgtggggtggggggacacacgatgaccttctcctcctcaggaagacctaagagggaagagcaaaccccagcgagatcccccctgtgctgatgattttcagggacttgttggcaactcagcgagggttgccatagcttttttatgtagggtgaccagaaccggctgaaactggtttgaggcagatcagctcctgaacacaatgcagtcactgagctactacagtaggatagcagcttcctcccttcatggcagccaaaagcagaggagcttgcaggaaggtaccatccctacacagtatgtgaatgcacacttagacaccacacagcactggtacgtgactaatggagccctaaaagattctgggtagagaagatggaaaaaaaggtgcaggtttgcagggtctgagattacttgggcttttcctgcctttttcttttgcttaagggatggacaaggagctgagatttatgacccttattagagaaaaaaatgtgccttgctagggtggggacacttggttgatgcagtctctctctctctttctcggtgtttataacaaaacaaaaccaaaatgaactgaggggtttgtaatggtagtttgtttgttgctggagaatgctactttgcatgctttttttctcttgcagggtatgttctgtcttgtgctttttcttttagaagctactaaagggtgttggggatgcttctgactattatgaaggccaaaaggtaacaatatcgttctaggaaatgaacataaatgcattccagtgatgctgttagccatacatgctgtcttttttttccttgtaggcctgttgactggggctgcttttaaccctttcctatttgctgagaatgcagccgtgtgacagtaactgaacattggtctaaagtctttccaaaaggtcaaggttcacaaggtgagatacgctgttttgagcatgaatttaaatatttatttgcagatccatttagacacagacggaccgtggattgctacccaggagataaaattgggttcagagtggagaagaaatgctcttaatgttatcccagtttaatgggattagagtgactttatgatggtattgcgatcaaggcgaaatctgaatgccttcattaaatcgcatgtgtctgggcaattgggagagtcaggcctggaaggaagcgagtgtggagaatggtaggcgtcagggccttgtggagaatgtgctgttttgcataagacgaaagcagtacacatgtggcattttcccgatgattataagaaaaggaagggcttcaccaaatcgaggcagcctagccacctttttaggatttgaggagtctgaaggtagatttgccttttgttcattcatcacctttcttttaccttgctctcttgtgttaacctgaaaggtttttcactccgactcaagtggtggaatgtcttttattgattttgggggctgttgacggtgagttcgccattggattctttgtggcatatgtttaatgtggaatactaatgcaataccagggggaagccgggtagtctggcttcatctgtgaaaagatgcctgttaactcaaagctgtactggaatgggtggtagaaaatgtctgatgcctttaaagatcgcagttaggtttgagcaggcattttaatgcaccttccaaaaccagaggttggagaggagaggagagaaggaaggagtgaggagagtagcaaagtgaagaacaaaggctgagggggcttgcaggagaacactcaacattttgccttgggttccttgtgaaaagaactgcaacttccccaaacaggaaaccagcagctccagaatgggatccagtgtgatctcaacaacagatagaactggtcctgcctttctgctggtttttggtaaaagtacagtcaagaggagcccatagaagacatgactgaaaataaaattttcccctacttcgaagtgggcattttgttcctctccgtgttcagcagaataggggcttttcagcagtgccgaggatcttggaattggttaagttgtgtgctggcagttggtgggcaggatatctgcagtgaaggacgtcaagtatgcaagggttttattgttaaaatgtttttcatttggctacagaacatccactatgtgataaaactggcaaaagggaaacaagagtgcatggttagctcaggatactttatggagtatttaatagagataaatgtaatcttggacggatataccagtaaatagcttacatgatggaacaaaattctttacaaatcactgtgctaaaattggttttcaattctccatcatttctgactgccagaggttctgtgtatgagtgtggcaggaatatgcttgcaaagcagatccgaatccacgctgcgcgtggtgtgctgcttctgcgtttctgatgtcaactaaaactcagatggctaatatgataaaccttaattagcttaatacaataagctgttttattatttagtccttcattcttgtcttttgagagtcagtgatttttgtttaactttgacagctaaccccttgccacggctatacagtgcgaatatgttttaaaaaacctcttcgtagggcattgcatgtcatggaatgttctggttttctgtcttggtggtttttagctttgttcctctccctcccccttgaagtctcctgaagatagcatttgttttgcatttagaccaatctttccagctgcaaatgctgctgagggttggagagctggttctctggggcgggagtcatgagctcatcttggattggagcttgtctcaggtgttgatctcatgctgaggtataacaatgtagcaggcccaggcctccctggagtggggagagtcttctgggctggggaatgtggatgtgagtgtgcaggatgagctagggcatgttccttcctgggagagccaggggggacccggtgcctgcagttcctgtcaccgtggagcccagagcccagcccctggtcggcagtgcctgtagcaggctctaaagacgacctgcggtccatcccctccggagcaggaatgtgtgggtttggctgaggagagcacactggaaagaaagtgtaactgggtgttgaacccttcttgtttttatcctttgcctattcaatcattttttccatgttaaagaacactggagccagggtgtttggaactctcagcgcaacctggttcaggagcacacacgctctctttttcttctgttcttttctctcagcgattccctgcccccacccaccttgactcattttaaggaaggtctaggaaggaggttgccaacttgtcagtagaatcttctgatgcctttgactgtgagttagaattttagggtttgtgttctcccatctcccatttatttcttctcttgaaatgttctcttggacttttccgtgcaatacagtcgctctccagttggctttgaacaacctttaccgtatccttggtagaactccagctggctgttaacaggtgaagcagaggttgccaacacaagggaaactgactccattccccatcatgtactcctaatcccaggaccatcagaacaagaactacagacttgataaacattatggaaacacacaccttcgtgttcattttattttagggctgatctttaactaagtcatggttaaagaattagcttaaaaaaatttaaaatttgtgtacaggaaaatttactctgtggtgtaccgttctgtgggttttggcatatgtgtagagtcacttatccaccaccacgggcgaagcagaacaggcccatcacaccagagcatttcctcttgccgcccctctgtagtcagcctctcctacccctggcatccactgtctcactatagggacatggttctctcgtcctagagtttgggctttctagaatgtcagatagcaagatgcgtttcagattcatccatgtttctctgtgtttcgatacttggttctttgtcattgctgagtagtattctgctgtatggatgtaccacagtttattcatttgctgggtgaaggacattagggttgtttccagtttttgctaattgtgagtaaagttgctgtaagcatttgtgtgaaacaggtttttgtgtgaacataagtttttatttctttttgctaaatgcagtcacgtgtcgattaatgcaggggtacattctgagaaatgtatcattagacagtcttgtcattgtgcaaagatagaatgtacttacacaaacctagatggtgtagcctactatagcctactatatacctaggctatatggtgtagcccattgctcctaggttgtaaacctatacagcatcttactgtactgcatactgtaggcagttttaatacagtggtaactatttgtgtttctgaccaatctaaacacataaaaggtacgggaaaaatatggtattataatcttatgggatcactgtgtgtacgtgggccattgttgaccaaaatgttggtttgcgttgcatgactgttcctagaattggggtggctggatcacatggtacatacataagagttagaagtttgaatgaaaataaatccaacttgtaactcacaaaaaagatctagcgttgacagctgcagttaagactcgccgagaaagagatcgtagtgaacattgtctgaagacacacgagagatgatcatgataatagaacactctctaatgggatgacatgctttgtaaccctgaactaatcagaattagccaaaagtggaaacagaaaactgcaagtggtaaaatatcctttatttcctgcagcaattatttttaatctcttcggaaacatttggcagtctaatttttacattcaggttcaataaaacacaaaacaacaatagaatagaaattttggaaagtgataccacagatcattgttgaaatcttagttgtgtgttattaacttctgaattataatttgatttatggactgccaaagtattggggtcattttattaataatatttgaagttattcagcttttatgtatttttaggaactgaaaatgtttaagcaatattcagtgaaagcagtgaagaggggagattttggaagatttgtttggaagattttggaagatctgtttttttttttttttttttttggagttggagtctcgctttgttgtccaggctggagttcagtggcgtgatctcggctcactgcaacctctgtctcccaggttcaagcgattctcctgcctcagcctcctgagtagctgggattacaggtgcgtgccaccatgcctggctaattttttgtatttttagtagagatggggcttcaccatgttggtcaggctggtctcgaactcctgaccttgtgatccgcccgcctcaacctcccagagtgctgggattacaggtgtgagccactgtgcccagcccaggttgttttttttttttttttttttttaaggataaaatagctttcaggattgggaagaacagacaaaggtaatggtggtacagatggaggggagcccaagaagtgggacatgatgttaacctggggattgccttgtcatttaacagatgcttactgagtgtttaagcactgggcattgtgctaagcacaggagtgcagagggaaaagggccccagggagaaaaatctagtggaaggagcccccagaagctatgataggaatgtgaataggccgcctcatgccaagcgtccacagaggagctgtgaaagactggtaagaatatgtgaggcagtcagagcctgggagagcatctaagtccatgcagcacacgtggaaaggtctggggagagcttggtgtttcgagtggggtgtgggtgtgcgaggggatggagctggaaggcagttgagggtcacctgatgaggccttttggtgcagtgccttgaggatggacttctgtgtaggcagaaaagacggacctttcgttacaaaggtcctgtggcagccccatggaggttggaatagaggctgtacaggctggaggtagggaggccaaagagggaaccggcaatccaggagagaaaggatgagggtctttcatcccaggtgttgtttgtggggatggagtggtaggtgggggctgcttcaggggccaggtagtgcctgattggaggagtaaggctgcttcttaggtggctgtctgggggttgcttggagactgggtgttctgtctttgagatagcaaattccgaaggcagaatagatttggaagagtggaggtggagggacttgatacagtgagttcagttttgggctccaattgcctctggctctgtgagtctggaatttaggagggttgcttgggctggaggtcaagattggtagtaatgaacataaaacagagaggatagaagaaaggtgttttaaaaggggttgggtttgggtcccctaagatagtggcttacgtagtaaaaaccataaacgaagcggcaggggtggctgaagaacttagaacctgtgctttagcaagttggagggcagaagattcccaggaaggtagaaaatgtagctaaaacctgcagatgctgcagtaggtgatggcactttacgtctgttatcccatttttctgatttttaaaccttttcttagaggtggggtcctgctatgttgcccagactggactcaaactagctggacttgaactccttggctcaagggatcctcctgcctcggcttcccaagcagccaagtagctggcactataggcatgcaccaccgcagcagctattatgttacctcatttgataccgaaatgatgagaggagctgtacatgtttttccctgtggtaccagtggggaaacagacagagaccctcccagctcgtaagtggaagtggaaacaggatttgaaacatgctccttctcactgtgctgttctgccttgggggagcacagttggtggactgaggggtgagcatggaagctgtttcagggtgtggaggtgcccagagagggcacagcaggtgctaaacagcaaagacactggcgccgttcacgttggaggtgatagctgatgactgccagcgtgagaatatgcagtggagaagtttgaggtacactcagggcctttgtatttagccagattttcctgattgtagtcagcacagagagcagggcatctgtatttgcaccagagacatctctagaaatagcatgttgaaaagacttattttattgggcactggggtgaggatacagattggaggggagaagggctagaaagatgtatttgttttatgtattctttgaaaaggctgagaaaatcaaagcaaattgaaagtggtgccgagaagaatcttttgttccaacaataaataaacacagtttaaagaattctttgaatcatcttctacggcaggaagttctatattctggctgttttataatgagggagagcaaattctgtttaatctaaatctggagactgaaataagtaatttttagacagacgcagagcggcttttttagctgtctcacatattccttatgaaggatcactctttaaggatggtcttcaggggccccaaatgcagattttgtattcttctgttttcagtcagttattattacagctttacataattagagcttttagacatcttgagtgatccgtagagacctaaagataaaatcagggtgttgtggttcttgaactgttttcttaccatcagcctttgcattttgggacacaaactcctcctttccccaaggctgactcccggggctagtaatgggtattgattttatcattttcttttgtgaggaacaaattctttctagggatttcaatagtaagaattagatagttgaaaaacctaaaaaggttagaaaattcaaagccctctgttttaaaggaccccatagctggaagtacttcacacatttgtagttatctcattttctacagtgagcccacattggagggtggggccatcaggtaaccaatagcaggtttagaactggaacccagcactatagtcctagcccaagaccgcattcatcattaccttctctctgccttccaacatttatctttttttttttttttttttgagaccgagttttgctgtgtcgctcaggctggagtacagtggcgtgatctcggctcactgcaacctccgccttccgggttcaagcgatcctcctgcctcagcctcctgagtagctgggattacaggcatgtgccaccacgcccggctaatttttgtatttttagtagagatggggtttcaccatgttagccaggatggtctcaatctcctgaccctgtggtctgcccaccttggcctcccaaagtgttgggattacaggcgtgagccaacacacccggcctaaaatttatcttatgttttatttttttgaggcagggtctcactgtgtcacccagactggagtgcagtgctgcgatctttgctcactgcagccttaacccccagggctcaagtgatcctcctaccttggcctcccacctcagcctcctgagtaggtgggaccacaggcacatgccaccacgcccggctaattttgtttattttttgtagagaagggatctctctatgttgcccaggctggtctcaaacacctgtgctcaagtgatctgccttccttgacctcccaaagtgctgagatcagaggcatgagccactgcacccaactatgttttgatggtatttaatcctcctcctatttataatctttatgtgaacctgaaaacacgatttgattaagttaagctttaccgaggtacttgttgagaagctggtctttgatgattttgctgatttttttttttgttttttctgggatgaagtcttgctctgtcgcccatactggagtgcaatggcgcaatcttggctcactgcaacctctgcctcctgggttcaagcagttctcctgcctcagcctcccaaatagctggtattaaaggcgcctgccaccatgcctggctcattaattttttgtagttttagtagagacggggtaacaccatgtctctatctcctgacctcaggtgatccacccacctcggcctcctaaattacaggggtgagccactgcacctggccagttttgctgatttaacctagcaagaatgggagaggtaatttgaaaactgattttactttgtgttctggtgaaatctgagtgataaaggccacggagattttcacttgcctttgcccagctctcaatgatataaacctgattgcctgtcagtgatgtaaacctgtgttttgccacttactagctgcgggaccttgaacaggttatgtaaattctaaaccatacgtttcctgagggttgttaggaggattaaatgcatatataaagtgtttagcagaatatgtggtgagcccttcctacaatcttagctgttgttttgtggtctttggtctctgttttgggagagtagccttagtcccaggactttttttttctttcttggagggtattgtctcctgtcctgccttacctcattggcaagtatatttgtttttgaccatgaaaacagactgtgtgtctcctccttgtcgctagagttttagttacagctgccctatatcaggttaaaagtgggtgaagtagacacaagggtagtgtatttgttcctacttggctctactttcatttgtggttggagaatcttgtctgaattttgtatttatttatttatattttattctattattttttttgagagatagttttgctcttgttgcccaggttggagtgcaatggcgcgatctcgcctcatcgcaacccctgcctcccaggttcaagcgattcttctgcctcagcctcctgtgtagctggggttacaggcgcccaccaccatgcacaactaatttttgtttttttagtagagactgggtttcaccatgtcaggctggtcttgaactcctgacctcaggcgatccacccgccttggcctcctacagtgctgggattacaggcgtgagccactgcgtctggcctgaattttgtatttgtaatctagtacttgaacatttttttgcttctggaaaaattttccactgagtggctgtactttaggttgtctgtgggtgcaatttacgttgaccaaagtttaaaacaaaacaaaacttgatggtgaaaatatgccaggttagcaaaagcctatattctgaccctttcccccggcacttcgcttcccatgtttgtttgaccatgcctagatacttatattctgcacactgggatttgggggtgatagaagggtgagtggagaaggatctatgaataattattttatttctggaactactctgttcagtagtgtggtagccactagccacatatgactactgagcacttgaaatatggcaaatcctaattgaaataagctgtaagtataagatacatatcaggttttgaagatgtaatgaaaaaaaacagaatatcttgttttttatattgattacatgttgaattcataacattttggctatttcacctttcccccccctttttttctctttttcaaaaaattaaaacttttttttcctggagatgagtgtcttgctgtgttgcccaggctggtctcaaacttctggactcaagtgatctttcccactcaggctcccaaagtgttgggattatgggcatgagccactgtgccaagtcctttttttcctatttttaaaatatgactgctagaaaatgtaaaactagatatgtggcttttgttatacttcccttggacaatgctgttctggaatggtgggtggacattcaaataaatttagcaatgaaatttttctggtgccctgcagtattcatatttgttgataacattgagtctctccttctgttaacaaagatagtgctagtttggcccctttttctctctcaggtgttcctaattcacctgtctccatcacaggtctacacagccacactgggttggtgtttgcttcattatggaaagggaaccagtattaatcacaggtttgctgtgtgctggatgccttatacttactgtcccctgtaaggttatacttcacattcctgttgagactcacagcttgagtgaccagctgaagaatgctccactagtaggtgatcgaccctagatttgaaccagggtctggccagctttgaaattcttttctgtttctaccactttgtacatcttttccgtgtaaaagctccagtttgctgctggtgttccgtacctctcgggagcccttgtcgtctagagtgtatttctcacactttagtttgcatacaaatcacttggggatctttttttttttttttttttgagacagagtctcgctctgtcgcccaggctggagtgcagtggcgcgatctcgactcactgcaagctctgcctcccgggttcatgccattctcctgcctcagcctcccgagtagctgggactacaggcccccgccaccatgcccggctattttttttgtattttttagtagagacggggtttcaccgtgttagccaggatggtctcgatctcctgacctcgtgatccgcctgcctcggcctcccaaagtgctgggattacaggcgtgagccaccgcgcccagcctcacttggggatcttgttaaaatacagataatgattctgtagggctgggatgggcccaagactgcatttctaagtagcctcctggtgccattgaccctgctggttcatggcctgtcacgctctgagtagcaaggctctctgctcctcccttggtctcggacctgcttcctctctgcttccaaagcgataagattctccaggccttccctgacaccacagggacttaccctctagcttggcatgtgatgctagcagggagcagacatgggggccaggactgttttttttgatcacagatgcccagttctggcatgaatgctaatttctgagtactcaggatctgaatggatccggggtttattcctctccctacatttctgcattactccacctttgatattgtgatccctttgacacttgtagtcggatcagatggaaaagaattttaatattgtgattgcatccaggagatggggcaaaggtgcctgttatgacttcatgaagactgtcaggccttaggtcagcacagacaagtgactttgggcctagtgcaatggctcacgcctgtaatcccagcacttcgggaggctgaggctgaggtgggaagatcacttgaggccaagagtttgagaccagcctgggcaacatggtaaaccccgtctctacaagaaataaaattagctggctgtggtggtgtgcacccgtagtcctagctacttaggagactgaggcaagaggatcacttgagcccaggagttagaggctgcagtgagctaggatcacactactgcacttcagcctgggcaacagagtgagaccttgtctcgagaaaaaaaaaaagcagaaaagaaaagtgactgtgtttggttcacggattcagtatccagtgagagatgcggactgaaggcagttagcttgccaccgtttctgcccccttgcctgatgaggaatagaggtgacttgggagttttccttagaatgggggttagaagagccacttcatgtagcagtgttggaaaacggctagtcacatcacctctccagcacgtgatggagacagcctccattgggtccttgggtgaagctgtcctggggaaggttgccttggggcctggaccaaacaggagattgagttgcaggaaggagttcactgtgttatatgtttaaactcttatgtaagagactggagaattttacttagtgggtttattttactttgggaaggcacattgattaaatcagctatagcaataaataaatgtctgttgcatgagttcagttttaacttccccatctctctacaagaaagtctgccatttcacagaaattctagttgaaatttagatcttactggacatctgggcactgagagttctgtgttatatgaatctggcacattgaattggatttattaatcgttggctaagtctgtcaactccctgtgctgtgcagaatcctgtgcctggcatggtgacagtatcggctctgggcctgtgagtgtggcccttatggaatcacagattgttggaaggggagtggagtggggtttggaagaatagggacaaggttgggtgtgtcctaaggatggtcaaggctgtggggccagccctggattaaggaagtggaactatggaagttagtcacagttggggggtgagtttagaatgtagctagggcagaatgttgccatagcatgccaagagtcagggtaagttaaagagtcagagactgggcaggttggctgggcatggtggctcacacctgtaatcccagcactttgggaggctgaggtgggcagatcaatagaggtcaggagttcgagaccagtctggccaacatggtgaaacccagtctctactaaaatgacaaaaagtagctaggtgtggtggcatgcacctgtattcccagctactcgggaggctgagtcaggagaatcacttgaacctgggaggcaggagttgcagtgagctgagattgagccactgcactccagcctgggcgacagagcaagactccatctcaaaaaacaaaaaaaacaaaacgaaaaaaaaccactgggcaggtagaccttcagaggacatcagaaggccaaagatgatgggcacaagtccggtgaaataggcaaggacgggaacacatacagatgcaggacagatggccatgcacaagtgcatgatggcaggagtcggcagtccgaaagatctgtgatctgtggtgctgataggagaggcccccctgaaggactaccatggaatgaatgagtgagttggtgaatgaatgaagaccatatgagctaccagttccagtgatcactggataactgcagcctgaagtggagccaacttcacccagccttcacgtggagtggtgactaagggcccccgtggcccaggtggctgaggtgaggggtgtgcattgggagaggcagtagctccttgcctggcaaagttcatacgagaaggctctgaaagactagattgtttagagtttgcatgatttgtaggacatgatcaagctatgcagtaagaaaggcagctcattctgaggcccagggttagcagctgtcaggaggacctgacatcaagaactcaagcgtcatcttgcactaagcttactccgcattcttttgaggaccacatgcccttggttgtctcttttgcttcccccttagtagaacttctttcctatacacatgggcaaacaatgctgttccacagctcctgtgtctccatgtcctcattttaaatactagtggacatcacctgtagtcctctgtcctacttgcagttctcaaggccaaaaatctcactgggcctggtctaatcagctgtggagggcaggttgttcttgttcttagccctaaataggtgacagtagcctttagtgaaggtggccagtggggttgtgaggcacgcccggcggggcctgctacagtaggagccatagaggcaaatctgatacattagcgtctcttgtgtctggccaaggcgttcctcattgtaaaatgcgatgctttctagagaatgtcattgtgagaaaaaaatctttgttcagacattggcaaaacaattaattaaatgagtagagtcaatgagaagtgagctatgcatgtttattgggtaagtgtaaaagctggcggcaaaaagacaatgcaagtggcgactgcctttttcattttttttgagagggagtctcgctctgttgcccaggctggagtgcagtggcacagtctcggctcgctgcagcctccgcctcccggattctcttgcctcagcctcccaagtagctgagattacaggtgcttgccaccacgcccggctaatatttttgtatttttagtagagacagggtttcatcatgttggctgggctggtctcgaactcctgacattgtgagccacctgccccagcctcccaaagcgctgggattacaggagtgagccaccatgcccggctgttggcagctgcctttttctatagcatgtactcttgttcatacattaaaaacaacactgttggccaacgattgtttttttcagtggtaggggtggattttccttcgttcattccgtctttcgtctgttctccttacagccttgagcacagagttgttacttgactgtactgttttgggggtgtagtttgtagctttgccttaattcattattgtgagaaaggaacttacctgtaagtaaattggatttgtgtccttaacttttaacactgttttctgacatgcttacgtggattctaggggcaaggacaggatgaatacaaaaaagggaaggattggatccaaatagaggttctgaaaaagatgttttggtggaagtgtgaaaaaagagagggatggagttggacaaaaaagaaaggtgatccagagagggaatggtgggaacacttaccaggagaagaaagtgtgcagaggccgctgagcatagctgtctggctcgatagacacttgtttgttaagaaatgatgaaaagcaagagttgcagtgaagatgagctaacgggtgacttggtcaccttggtagaatgcagctagggaaactctgtttatttggagccattttgagatctaagtcgttaggcctcagagcagtgccgaaaagtgggtcatcttattatcccactttattcctgaggaacttgaggctcagagaggttaatggatatgccaaggctaagttggagttggcatttgtacccggatctttctcaccctgaagtctgtaacctttaccgttctttaatacaattgccagagtggatgagctcttttgagtgtggaaagtgaatcttttttctgttttctctttactcagaaattgcaaaaacagtatgtctagcttgcagtattagctccataaatgcatagcaaatgcttgttgtctgaataattgttggactgagacactgaaggtaggaaatttggccaaatgactggtggaattgttcaaacctaaagttcagggtcttttataggtacatagatgtatatttgagccctctcataggcgcgcgcgcacgcgcgcgcgtctgtgtgtgtgtgtgtatgtttggggcccctcagaggtatatatctggcaaaatgcaagtctggtttatctggccaatgttaattttggaaaagattaagcacatagtttagcacttgatgtaatactgtgattaggctttactgcttttgatttagatggctcagaattttaaaaaaattctcttctaatcttgaatgttaggatattactgacttcacttgaagtttcaaattgagctataacatatttggttacacagtggtctaatttcaggtcactgaagataggaagaatctgttctgcatctgttttgcttcttttttctttttttcttttttttttttgagacagagtctcgctctgtcgcccgggctggagtgcagtggcgtgatctcggttcactgcagcctctgcctccttcaagtgattcactgcaacctctgcctcctgggttcaagtgattctcctgcctcagccttccaagtagctgggattacaggggcctgccaccaagcccagctaattttttgtatttttagtagagacgacggggtttcaccatgttggccaggctggtcttgaactcctgacctcagctgatcctgcctcggcctcccaaagtgctgggattacacgcatgagccactgcacccagcctgttttacttcttaaaagaccttgctgggttgtgtgtctgcaaggggcacgcaagttgaggatgctgtttatcatattgcatgtggttgttgtaagttttgaggacatctgtcttgttatcacctatggaagttaagtcacttggttagaattttgtaacttctaaaaggcagagctcacctcagtttgtcttatagaaagcccatgctttaaatcacctacagtgtcctgtggtttataggtgtcatttttatagctaattggtgtcaggctcagatatctttgacgttcaaagccactgctaggtcaaccagtatttctcctattgtcaagagccatgaggcatttcttgcttcaggagactgatgtggctgtagctactcaatgtccataaacattaagagatcttgtgctgcttttattcattgtttttcctttacagtatctatgtgtgcctacttgtgtgcattttacaatacaaatagcttctttttggaaatacttccagaaccatcaaacaaggttttttattttttattttttgagacagggtcttgctccgtctcttaggctggggtacagtggtgcaatctcagcttactgcaacctctgcctcccgggctcaggtgatcctcccacctcagcctcctgcgtagcttgggactattaggtgcacgctgccatgtgtggctgatttttcagtttttagtagagacggggtttcacaatgttgcccaagctgggaacatagtttttataatcatttctatggcatgaaactttaggtggagtctctttagaaatacttcattcttgctctccctccatatttggagatttgttaacttgttctttccttaagtcatcttgggttgatgcagaggtgtgtctggagaggaagtactgccaagaaaagcatggagttagagttgtcaggaaaatgggctggaagcacctccctcacatgataactataggatgcatgcctgtttcctaaaaccagttcctaaagagaatatatttttaagaggcagggtcttgctctgttgcctaggctggagtgcagtgatctgatctccgctcatggcagccttgaacctgtaggctcaagcaatcctcctgtctcaacctcccaagtagctgagactgcaggtgtgcaacaccattcctggctaattattatttttattttttgtagagatggggtcttgctttgttgcttgggctggtctcaaactcctggcctcaagtgatcctcccatcttgacctcttaaagtgttgtgattagaggtgtgagacaccatccccagtctccaaagagaataatttcttaaacccagctttacgtttgtcccagagatatctcatcctgaaagattccagcatcagataagcttgggtaatgctaaagccctggattcccactttgaagattcacattggaggttcatgttagctctggaaagttctgagaagccttgagaaaagaaatcaggctgtgtgtgtgtgtatttaatctaacatttctcaaattcctagactgtagaaccccttcttcccctttcttgggtggaaagtttagtaacaggaggaacattcctgggtaaatattcttccaagctgttggtgtctttgatgaaattaatgaaaactgagagagggccttgtgaggaagactcagagggtttcatccatcctcttctcaatataacataatgattgatatactgatgtaattaattctctttctctgtgtttttttcctgttttctgtttactccaggaagagaacttttaaatgaattgatttttaaagtcaatgatggtgggcattctgtgagtgatcactgtgggggatactttcagacatattttttagataaaaggactgtgtttcagaattccaaaagtgttttaagtgaatttggtatctagtgagaattgtttcatgattagccagtggcatcattttggaggatgagaacagctgtgatacctgtgcagggagcctatttgtccactccctcaattaatgggagagggccagggtcagggtcggctggaacagagaattgctactgtctgtatactaggacatggctctggcatggatgacctaagcaagcaggtttattatgattccagtaggattaagtattggtgggaggaggatagggtgatatagggaaggcatccctgctcacataaagcagagttttttaacctcagcaccgttagcatttggggctggataattcttggttgtggggagggctgtcctgtgcgtcttaggatgtttagcagcatccttgacctctacccactatatgccaatagcatgcctcctcccccaagttagaacaaccaaaatgtctctggacattgctaaatataattggtgataggtcatcccagtggagagccactgacttgaagccttgtagtaagaacaatacttcaaaacttcaggggatgaaaattgcaaaagaaagacctctgttgagggaagcaagccagtcagcctcgtggacctgtgaaatccccagagaagtaggttaccttcagctactagttttctcttccatgttttctaatgctggaagtctcaaaaagtgtttgcaaatattaatattttaaatttagtgcttaaaatttaaaaacttggccgggcacagtggcttacgcctgtaatcccagcactttgggaggccaaggcaggcagatcacctgaggtcaggagttcaagaccagcctggccaatatggtgaaaccctgtctctactaaaaaatacaaaaattagctgggtgcgctgggcgcgctcctgtaatcccagctacttggagggctgaggcaggagaagcgcttgaacctggaaggtggaggttgcagtgagccaagattgtaccactgtactctagcctgggtgacaaagtgagactccgtctcaaaattttttttaattgacaaagtaaatgagaagaagcagcgactattgctgatagttcggagcatttcagggacaaaagcttctgtgcaggatttaggacctaacgcacaaaaatgtggaaggcttattcaggtgacaaaggaaaattgctttgaagttattctttttctatactcaaaacatcacttctaatgtaggaaatcaatattttgaagctacagtttttagagatgctactaaaaagcatggtacttacaaaatgccaaaggaatgcttctaaagttggtatgagttttcctcccaaaccaggaatcccttgttactagtattcacacagataagtaacttcttagttttgaaatattaaaattcatcaaacatgcttcattaagggaaaaaaaggcagtttgtatctaaacagtaaagaaatttataaattttttcttgttttctcattgtgaagctatttgaataacccgtttcaagcaaaagttatcatggattttcctgaggtttattaaaagtgacaggtttagcctagaccgtttcagtatttctataaactcactgatgaatcagtaagctaccagtacaagggtttttttttttttttcttttttttttgagatggagtttcactcttgttacctaggttagagttcagtggcatgatcacggctcaccgcagcctccgcctcctgggttcaagcgattctcttgcctcagccttccgagtagctgggattgcaggcatgtgccaccacgcctggctaatttttatatttttagtagagacggagtttctgcatgttggtcaggctggtctcgaactcccgacctcaggtgatctgcccgcttcagcctcccaaagtgctggaattacaggcatgagccacagcgctcagctgggtgtttttttgtttttgttttttttagttaaaagaacgtatagccagtggaaaacagagcttgtacaaaagtacctttgacagaattgccaggattgatgattgtaggaaatttattattatcttcatttacagatatacattatgaccttcaaagtttgtaggaaatttaaatttccacctcctgccttttgtgcacataatgagattttgaaaatgcaaacctacacttatgtggatgaattttgaaaaaattctttttagtgttagaagaatacagttggactgggcatggtggctcatgcctgtaatcccagcattttgggaggccgaggagggtgaattacttgaggtcagtagattgagagcagcctggccaacatggtgaaactccgtttctacaaaaacacaaaaattagctgggtgtggtggcaggcacctgtaatcccagctactcaggaggctgaggcaggagaatcactggaacccgggaggcggaggttgcagtgagccgaaatcgcatcatcgtactccagcctgggtcgagacaatgtctcaaaaaaaaaaaaaagttggaagtagagagtaaaagctcaaaatttccctcaccccgtttcatagccttttaaagctgggggtcaggatctgtggtggcatccttctgagcctttctatgaattttactttatttctttatttttttttgagacggagtctcgttctgtcatcgcagctggtgtgtagtggcgccatctcagctctctgcagcctccgcctcccaggttcaagcaattctcctgcctcagcctcctgagtagctgggactacaggtgtgtgccaccatgcccagctaatttttgtatttttttttagtagagacagggtttcaccacattggccaggctggtctcgaactcctggcctcaagtgatcctcctgccttggcctcccaaagtgctgagattacaggcgtgagccactgcacctggtcctttcattcaattttatgtatctaggaattttacgtgtctatatgcttaaatataaaaacgtatgcttattttattttaaggtagtgtatgtattgttttgtgacctgatttttttttttaacttaatgttcaatcttgattgttccacttcagtacttacagtgactctaacctcacttttaatcagggcatggtactccataaaaaaggaatgtgccaaaaacgatgtgaatgcacttaacactgttgaactgtgcatttagatatggttaccatggtaaattttatgctatgtgtatttttaccacaatctgaaaaataaaggatgtaccatgattgttacataatcgtttatgtaccattgtcatggatatgtacatgatttctagtgctttgctatgttacaaataactgtgcaccaaacgtttttgtacatgtgatcctcaatttgggagattttatttctgtggtttaaaacattgcctctatgccctgagatcaatgacatgtcatccagatatagcacatagaggccttgcccatttttcttcaggaataactaggggaagagtaggtttttttctatatggatttttagaatttattggttgtgggtatgctattagagagagactatcctgtagtaatctccttagttggagatgttctttcattagcttgtaatctcagtaggttcctgggcaagccctgcccagagctcattttcacttgtcctttaccagatacctgcagggatggtcagctctggtaaattacctggttcctaaggcttttctggcggtgaaatgaagaacaccctgagggaacacaggcagatgatggagttctgatagctttgttaggtggcttattccgcaacacagttgcgtaggggcccgaggggccctgggcagaacccaggccttctggtctcctgcagtggtttggtatttagtaaactcttctgtgtttgaatttttctgtgcagaaccacggttttgaaatgctaacctgagggcagtcttgccctttaaatgtacattttgttttctgaagagaaacatggggcaggtatttttggaggctttatatattcagtaagtagatattccactgttcaagaaccttcacgctcacagcaagtcagcacaattctgtttttgacttttgagcaagaaaaggaaaacactggtcatgtgaattggctggagttgcttaatttggttattgttcgatgcatatttatttccggggtgatgcagccctctgcctctcatgtgtttggggtcagttgggtggtctggtgggagaagaggggaagaaagaaaatgggtagtctgctgcatcattgtgtgacctgtcatcttccacctgggcttaacacaaaaccacaaaccaaaacagaacccccacgctcacaggagggaccgtcatgcaggactaggcagtattgctggttgtggttagtgtcctcttcccaatcctagggcctatctgaaggctggagaccacaccgagtcggggcgagctgcggtcagtgccacttcctgaggaagtgactgaggcagccgggctttgtgaaagctgctttatccctgcgtcccccggggcagaggggagcagaaataatatgccaatggcttttcctgcggaattaaaggagccctccccaaacatctttttattagattagagctttgcgttcataaattatttctaactactctcctattctagttctcagaaaatggaaggagcagaacttcatatctttaaggattttctgggattatgctctaatctaaattatgaaaacttgatatattttaaaggaatttactcagttgaataataaaccacaatcatcatgagtattttattttatataggcagacagtataaaacttttagatagttcattaataaaggaaaattgaacattttggaactttcatgtgattttagcaaactgcaaatcagtcaaatattaaatccgttaactccatgtgaaagtaaagaatcacttagaatgtacaatgtcacgttttctaattttataaatataaaatcagatatttttcttgtaagttttcttttcagaaatgaaaatatggccgggtgcagtggctcacgcctgtaatcccaacattttgggaggccaaggtgggtggatcacctgaggtcaggaggtcaagagcagcctggccaacatggtgaaaccctgtctctacaaaaatacaaaaaattagctgggtgtggtgacgcacgcctgtaaccccagctacttgggaggctgaggcaggagaatcgcttcaacctgggaggcggaggttgcagtgagccaagatcacaccattgcactccagcctgagcgacaagagcgaaactctgtctccaaggaaggcaaaaaaaaaattatatatatatatatatatatatatataaattatatatatatattttatatatatataaaattaatatatataatttatatatatataaaatatatataatttatatatataaaaaattatatatataaattatatatataatttatatatatataatttatatatatataatatatattatatatatatattttatatatatatatatatatataattcatacaggctgagtatcccttatccgtaatgcttgggaccagcatttaggtttttttgttccagattttggaatatttacattatactcaccagttgaacatctcaaatctaaaaatccaaaatttgaaagttccaaatgagcatttgagtgttaatttggcactcaaaaagtttaggattttggagcatttcagatttagaatattcagtgtacttctcccccagacctcttacaaatcatgttttctctttccgtgattttctttctctctcttttccaagcattttagatatatatgcctaagtagttaacacatagagttaaaaagctctgaagttagctagatagaggtgaataaaccctccctgggcacttcctgtttccaggtaactgccacaaataaagagggatgcttgttccaggtgtacctgaaatttatcaggttgtctttcttgagccatataacacatatccatgtacttgtactttttctgtaaaatacagttagtaagaaaacagcacttatattaacttgtactttctacttaaaaggatatttttccagaagtggagtgggtgtttaagaaatacaaactcttggccgggtgtggtggctcatgcctgtaatcccagcactttgggaggctgagacaggcggatcacttgatgtcaggagtttgagaccagcctggccaatatggtgaaaccccctctctactaaaaatacaaaaattatcccagctactcgggaggctgaggcagaagactctcttgaacccagggggtggaggttgcggtgagccgaggtcacgccactgcactccagcctgggtgacagactgtgattccatctcaaaacaaaaaacaaaaaaaccccaaaatttggctaggcgcggtggctcacgcctgtaatcccagcactttgggaggccaaggcaggatcacctgaggtcaggagtttgagaccaacctggccaacatggtgaaaccctgcctctactaaaaataaaaaattagccaggtgtggtggcatgcacctgtatagtcccagctactcaggaggctgaggcaggagaatcgtttgaacccgggaggtggaggttgtggtaagccaagatcgcgccactgcactccagcctaggagatggtgagactgtgtttaaaaaagaaaaaaaaaaattagctgggcatggtggcacacacttgtaatcccagctacttgggaggctgaggcaggagaatcacttgaactcaggaggtgggggttgcagtgagccgagattttgacactgcactccagcctggggaggaaaaatatatatatatatgagttatatatatatacacacacatacatatatatatatacacgtatatatataactcttaagtaaaattaagtaccctggttagtacttaactgttacaactgggtttatctaaatatttgctcttcttctacccagagggccattattgtgtctttgactccagtttgatccttattctttttttgatataaaggtggttccatcattatctccttaatgacttctgggtttcttttttttaaaccttaaactgtacctggtatctccttgccaaaatcccaatgaccccgcattgctctgttacaggaattcttttccctctgtccttgcactaactgccgcccatttttttttttttttgagaaatttaaaaagtaaggaaggatatgtgaattacttattaagtactacctgtattctcaccagtcactgtaatatgactgtatgcccagtctgttccctctccccttctttttctccatcctgccctctagcttcttcttcctcctcccccactccacctcttcctcttcctcagacctctttacctcttcttcccggtaggtaaatggttcctctccttcctttttttttttccttcttaaactatttttttagatatggggcctctgtcatccaggctggggtgcagtgatgctatcatagctcactgcagccttgacctcccgggttcaagtgatcctcccacctcagcctcctgagtagcaggaactacacgcatgccaccgtatcgggctaactgggttcaagcgattctcctgcctcagcctcccgagtagctaggactacacacgtgcgccaccatgcctggctaattttttgtaatttttagtagagacgggatttcaccatgttagccaggatggtctcgatcccttgatcttgtgatctgcctgcctcggcctcccaaagtgctgggatcacaggcatgagccactgcgcccggcctctctctttcctcttaaaaggaacctggaggcctggcctggtggctcacgcctgtaatcccagcactttcggaggctgaggtgggtagatcacttgaggccaggagtttgagacaagcttggccaacatggcgaaaccctatctctactaaaaatacaaaaattagctgggcatcatggcgcatgcctgtcatcccagctacttgggtggctgaggcatgagaatcacctgaacccaggaggcagaggttgcagtgagccgagatcatgtcactgcactccagtctgggtgacacagagaaactgtctcaaaaatgaatgaatgaaacctgggacgcttgtacttacgaacatttaaaaaaatcaggtaaaatggatcatgctttgtaagtgtgattaaaaagactttttactgttagtgttggtctgtgttcttgcatgtgttttaagctttttacctaaaataggaatttatttataatgagtttgactgaggatctcttagaaagttggttaaccttctctgttctgaccagtcctcgttttgttgttgaacgtgccatcctctttcccaccctggtgtgatactaagtgccagcctatgccagtctgccctccctcctaaagctggataaactcctgggttcacatttaccttgagttgggggaagtagtttattatttggaatagaacatttccttcaggccaagatcctttaggaaaatgaaagtaaaagtgctaaaataccagcccccactcacccataagcaaggctggtttactgtgaaatcaagaatatatagtatcttgatggatagagtgacagaaggtattcttggagacattttaaacataaaaattatgatttaagcgcatgagtaaattattttaatgtctccatttctctcatctttcattttatcgtgagttaaacatatatcttcaggattttaaagcaaaagagtgaaacacaacactgtgtctcaaagggttttttcttttttgtttaagagttatttttgtaagaatttatgaagaaaggttgttcttgtggttacttgctttggctttaaactctctttggagaatatcacaatctaaatttaaagggtactcttgaaaacactgttgaattgacatggagtgtctgatttgatggaagccccgtagacctggaacggtatctgggatatgttactgagtgtgaaaatgcctatatatgtgtatgtatatttatgcttatgtatgcatttagaaatctgtatcccaaatgttaccagttgatctctggtgaggaggcctcccagaggcctttggtttctgttgcttatacttctgggtgttagagcattggcaaagagcacgtaatacccataataaattccaggaatgaaagaggtacatttgaacaaagggcagcctgtcgtctaaataaagcgcttcacaacgatgctactttggcattcaagtttgagcaattgtgatgcagaagcaatgttcgtgtagagattttgaatctaagaggttctgttggctgaaggttccccaagtgggggcgtggcagagacaggaggggaacattactgcagtagaactcatacaagagaattcagttttctgctgctggtgggtgaaatgatgagatctgtgactgctgtttctgtagtactctgcaaagaaagtcccaaggaatgcttgtcaattaactgagagcaagtcagttactccagattatcaactcagcaatttctgatttgtactttctttttttttttttttttgagatggagtcttgctctgtcacccaggctggagtgcaatggcgcgatttcagctcactgcagcctcaccctcccaggaccaagcgattctgcctcagcctcccgagtagctgggattacaggcgtgtgccaccgcacccagctaatttttgcatttttagcagaggcggggtttcatgtgttggccaggctggtcttgaactcctgacctcaggtgatctgcctgcctcggcctgccaaagtgctgggattaagggcgttatgtactttaaagaataaaaaaagaataattagaagtgtctgtgagttgatttagaaatcaatgaatctcttgctattattatgttaatagtttgctttagaaatgagataactagttgcctggtgcctggcgtggcggctcacacctgtaatcccagcactttgggaggctgagatgggtggatcgcttgcccagcctgggcaacatggctgtggcgaaaccctgtcactacaaaataccaaatattagccgggtgtggtggctcgtgcctgtaatcccagctcttgggaaggctgaggtggggaggatcgcttgagcctgggaggttgagaccacagtgactcgttatcatgtcactgcacttcaatctgggcgacaaagcaagactctgtctcaaaaaaaaaaaaaaagaaagaaatgagataattgggaagctatgtgaattttggacccacatgcttattatattgatctgttaggactgcttaagagctaacttgtcacctgtgaaatggttggcttgatattttgatatttaaaggtttgccttttgcttctcgtgggtacaagccagagagagcagtggttacatgggggtagaatggtgactcgtttttacctgactgtggatcagctgggtggttcctgaatctcactgggctcattgtggctctttgcttgtcctgtatttactgtctgtggtagtgagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagcatttatgcacaggagcataaatatatgattttcatcttgccattgaaagtagactttccggccgggcgtggtggctcatgcctgtaatcctagcactttgggaggccaaggtgagcagataacttgaggtcaggagtttgagaccagcccggctaacatggtgaaaccccatctctactgaaaatacaaaaaagttagccgggtgtggtggtatgcacctgcaatcccagctactcagtaagctgaggcaggagaatcgcttgaacctgaggggtggaggttgctgtgagctgagattgcaccactgcactccagcctgggtgataacagcgagactccatctcaaaaaaaaaaaaaaaaaagaaaatagactttccttggtctaggaagagtttaaataatggaataagtgaaaaggatgttcttactaatcaaatccagtaaaccatggctcgttgtgggtattaatttgctaggctttatgaatattgacctccttattcttccctaaggaagtaattaatcatttgccttttgtgtggtcttgatcttccttttatgcaccttgttttcattagacttgaagccatcctcgattttcaggcactacttggcattttacgaacaaactaccctgtcaatttttctagatattttagcatattttctaggttaatgttgttgtctacttggaatatttagagattaatgtacatgaacattttgggagctggacatggtggcctgtagtcccagcacatgggaggctaaggcaggaggatcatgtgagcccaggagtttaagaccagcctgggcaacataggccttgtctctgtagtttagaagaaaaagcattgtggaactcagagaaaagttactatcccacaggaagagccaaaagaaattgtgcctgagccattctccttcttttccccttatccctgtggcacagagccattggcagaggctctaattgggcttttctgtgtaaattgttgctaaagtttgacctaaatcggcttgcccaacttcaattttctgccagggtgccagtcacagatggtattggtggccctccactgagcagtagctgcgtcgtcttctagatgcttgcagcctctgtctcacgtttggctgcaaaggaacagacgcatgtctttaaggcagtatttcccaaaagggcacgtacacctcccagatgctgttagggaaaagagagtccagaggtcagatagatttgataagtattttatgctctagcccttcttggcgattcaaaatgtgctttaatatattaaagctctcaaaatgggttggggataaagatttggggaactcttgtggcaaagaaaccagtttaaactttgtttaaccatttgaccctaagatctcctttgttcctaatgtctacaaacattctgggagacagtgacggacgggcctgcctgttggagctggctgaggctggctgccagtctatatcgtacgtgtctcttcccagctccaccaggacatcttgttagtagcttgaaatgtatcccagtgggaggatctaagtcacagaaatgggcaaaggctaaaaatcggggctccccacccctcacactccttgttgctaaaggttgctagcctgttgctggtatttatcagcccatttccctaaaggtgtcataaggggtgccagacattagaatacagtgcatttctcaaatcttcactttctttctttctttctttttttttttttgagatggtctcactctgtcgacgaggctgtactgcagtggcatgatcatagctcactggcagccttgagctcctggcctcaaacggtcctcctaccttagcctcccaagtagctgagaccacaggtacatgccaccacacctcactaactttaaatttttaaaatagaaatgaggtctcactctgttgcccaggctggtcttaaactcttggcctcaagcgatcttcccacctcagcctcccaaagtgttgaaattatgggcgtcacccagccagatccttgcttttcagtgcagtgtaactttcttccctgttaaatctagcagtgtttgttttttgttgttgttgtttgttttttaagtaaaatatacataatatttgtcatcttaaccataagtgtacagttcagtgagatgaaatatgttacccatggtaaaagttttccatcaccttcaaaaaaagctctgaaccaaataaataactctcccttctcaccttcctcctgcttgtggtaacttctcttctacttcctgtctcttaatttgcctattctaggcacttcaagtaagtgcagcagtttttatctggccaatctactgtgacccagtcaagccaccacccatgtctgggctgggaaggtggggaaagaggctgctgcacatgcttgggatgtcttcagccatatgcatctgtccatctgttcatccacccatccgtctgtccatccgcccactcagctatctgtttatcaaggtataacaatacagcttttttattcctctccctctgtaacctatttgggccttatttatgtttctcttcttataaaccacctcagatctttctgtagaggtatttattaagtaaaacaacaccaccacatgacggacataaatattgaaaagaccaatcgattggaaggattaatcagtagagggaggtgttttcaggggatttagacaggaggaagatagcctaggctgacaaatggagcagatgaagataaatcggcaaaataagtagggagacaagatccctgtcccatgtgaccatgcatttgaaagcaggcagcccagcgaggtagaggcatgaaaggctgtatggactgcgctcttcaaagggctgtggttttgttctggggtctagtcttaggttgtaagcttttttctcttctctttctgttttttcccccggggcttgaacagactcaaaatactcttagggttggaatttctctttgattctggtcttggttagcaggggtgggggggattgttatgaacatttcattagatgtgtgtgctcttagatatggtcagtttgactgaacagttgctctgtttctgcattaagcacgtaattttgtaagttttgtagctttttggaatataaagtagttgaatacttaaagctccccctgctgccttccctttatttttaacttggactgagcaaggttcttctaaatgcattgaggttggggggaaaaagacctaaaaaagaaaaatacactgaataatactttcacatatacacgaaacctgattttgcaatctaaaatgactgtttttgggttttcaattatggaacattttctgacaaataatagaatttgctgtatttcactgtaaacagttttgagaatgcactaaatgcaacaacaaccttaggattagttatcatgacagattggcattaggaaaaatgatgagtatattttatgttctggaggaatgagacttgaagagcagagcaatttttaagttgtttacatcgagggaagagatgtaaagttaagattggctgggcgcggtggctcacacctgtaatcccagcacttagggagcccgaggcaggcagatcacctgagatcaggagtttgagaccagcctggccaacatggcgaatccccatctttactaaaaatatgaaaattagccaggagtagtggcaggtgcctgtaatcccagctacttaggaggctgaggcaggagaattgcttgaattcagaggcggaggttgcagtgagccgagaccatgctactgcactccaccctgggtgacaaagcagtgggactctgtctcaaaaataaataagtaagtaaataaataaatgaataaagattattacttaactcctttcaacaatttaaaattttttgtcaaagtaatacatgtacatagatcaaaaaaatagtactttacatcataattcccttaggcagtgaatttgaattttttggtttgttctgttatttctaaataatgtgcttacattgctaaacttggacttgttcatttgagatagtacctgctgactgtgtgtggtcagagagaaggtgacagacctggactgtggaggcagaatcctcttgctcactagccacgtgtccttgagcaagacacttaaacttctctgtcttatagaataggaataatcaccaccatcatcataatggctccgaggcctacctttaatgtatgtagggcctggggcaagagtactaatggagaccagatggctaaatatttaaaaggtatatttaaatatttacaaggtatatatgatatgcctaaatatttaaagggttcaaatctacctctgtctatggcctggcccctgtgttcacccaggtccttgcagcctactctccctgaagaccagagtctaacagacagcctcacacttggaccagccctgagccaggccccggagtctgccccggcagcccagcgtgaatgccgcgctagacccgctgatcccaggtgtagtcttggcagctcaagcttcccaggagcctgtctccatctagggtgattttatcgtattccctcacaccttgattctctgatttccaggcacttctaagcacctccccaaaactgtaccatctgtgctggggaaatcagggagcctgtcctgcctagacacccactttttctctggtaccccagggcaggggctgtgacctgcacatacatgccccctgcttccccactgacctgtctttcccagaattcctccttgtttggccagtttccaaaattaaaagggaatgaaacaaaagtttcccatgagactgagaagcatagtctctggctttcagcgctggagagaaatgggttgtctaccacgcaggccggggcagagccccctttgtctggaagcacaggtgctgagtgcgcgtagattgctgtggggatccatgcgttcacagcggcaagcctcttaaaatagagtccggacacagcgagtccgtgtgattgttggttctgctgcttcgctttttggagctctgtaatttcactccagcgtggacttctttccacctcttgtattgggccagcagaggtagagagttgtcagacttagcaaataaaaaatacaagatgctcagataaacagtggaacatccttacactacaagatgatttgtttatctgaaattcagatttaacttggcatcctttatttttctggcagcctaatgaggccctttcaattggattgtctccttttgtcttgggagatgttcctgtattatttctgtaataatgtcctctctgcatttcctctttctgaaacacttaattttatttatttatttattttttttgagatggagtcttgctctgtcacccaggctggagtgcagtggcgcgatcttgactcactgcaacctctgcctcccgggttcaagcgattctcctgcctcagcctcctgagtagctgagactacaggtgcgagccaccacgcccagcttatttttgtatttttagtagagacagggttccaccatgttgaccagggtggtctcaatctctcgacttcatgatctgcctgcctcggcctcccaatatgctgggatgacaggcgtgagccactgtgcccagcctgaaacactctttttagtcagatgttggaccagctgtattgaacttttaattttcataccttttctcttctatcgtctgtctttattttctagttatactcttggggagagatcttgatttccttgactctgttgtttcacctattttatcttttatttcagttattaatatttataatttccaaaagttccttcataacttcctgtccatttttctctgaggatactaattgtacatatattcttttcttcctctccttgtagcatctctgtcctctttatttttgatttttgttttgattcagatctctttgtctagaggctttcccatgcatctggtgattgtttagggatgaggctgtggagagctgcccgggaggtctgtctgcgcagctgcggcctgtcctccaggggcttctctgtgattcctcgtggagctggactcatcggaggatcgcagcagtcagcatccggaatcttttcactggtgcttttgttttcctaggagacttgtccatgcttctgcctgggggataaacttggctttaggctgtagggctggaggaaatggaggtcaggctctctgttctggtttctgtctcatgctcaccctgtggccctgaaccctgagcttccacggctttgatagcccagagattctcctctccctcctccctagcttccccagctgatgaagggtcgggggctccctgtttctagccctgccctgctccctgctttctttgctggctccagggcctggctgtctctgcagctgtaggactgaccgtccccacctccatggcagcctcctaccagaccttaggacggagcttcatgatctggtggtcacctgcccctccctgtcctcctcctcttccccaaactttgttgatgcctcaccttggctttgactccattctcacagcatattgtttttggcaaccgttattgacatacaattcacataccatgccacctgcctctttaaagcacacaggtcagtcatttttaacatgttcacagagttgtacagtcaccaccagtcaattttaggacattttcatcacctcagaaagaaaccctgtatcctttagccatgatgcccagttcccaacccccaagctctaagcaaccacttacttcctgtctctatttgcctatttaaattaaaaaaaaaatacttttaatgccatctttgtagggtttcaggagggaagggaaagaaactcgtgaattcactcagccttgtttcatgggcagtccttgccatgtataaaatattaaaattcaaaaaccatctgcctgtttctatttctaccttcatagtattgacccatggccgagatgggacctttcctctgggtctctttcttttccttcttatgcccttgtttaatgtctctgtttgacctgaacttctcttttctggagctgggcgttgtgaagcccacatcagtggccttcgtctcctcttggcttctagcacttttctttttttcttttttagagatggagtctagctatgttggccaggttggtcctgaacggctgacctcagtcctcccgcctcagccttccaaagtgggattacaggcgtgagccactgcgctcggcctctggcagttttcaagtgtctgtagagccattgtgcagaggagtcgccttggggagctgagtccacgcccctccgatatcttcttggttcagaagtagaggctgtgggctgtgtgaaaatacataggacttttaggcgcttaatatattttactatgatgcatttgctctttagccagcacctgctctttggagagcactggtgtgggtaattttgcaaagtggaatctggaactttaaaccagtgagggagagaagacaaatacacaagcagacaacagtacctattacaagtgacgatgagtccacctgcaggggtggagtcaccagttagcatggcctaaggattgccctgaatgggtactggcctcttatcatcctggctgcttctggagaaccctgtccccatctcctctggagctccaggatttctctgttggcttcgcaccccaccctgctctcacagcctgcctggctagtgctgacttgctggtcgcctggccagtgggtgcccactggcttccctccctgaggctgcctcccttccagagaactggacagctaggagtagacaccttaacagcatggtgaggacttcttagcccacttcctctttgtcttctctctaacagcggtttctccatgcctgttctcctccagcttctcttagagtgtttgtttcggggcatgggtaccactgctatggtttggggttcctggcccatgtcacattgtggctgcgcatcccagtgctctgctctctgtggggcctggtctgtgagcccggccctgtgcagcggtgttgtctgtgtcagcatggtgtggaggtgtggggtgggcagggttagacgggggcggttaagatcatagcccatctttggttagtgcttgatggggaagacacaagtctcaaagtcaaaagcaagagtcacaggggacccagaaatgctgagatgttttgtggattgatgaaattttgttgccctttttttgagatagggtctccctctgttgccccagactggcgtgcagtggcgtgatcattttgctgccttttaagagaaacctgtgtattctttttcgtttctgactccaggtgacccttctccttcttttttttttttttgagatggagttttgctcttgttgcccaggctggagtgcaatggtgtgatctcgactcactgcagcctccacctcccgggttcaagcgattctcctgcctcagcctctcgagtagctgggattacagtcatgtgccaccacacccagctaattttgtatttttagtagagacagggtttctccatgttggtcagggtggtctcgaactcccaacctcaggtgatccacctgcctcggcttcccaaagtgctgggattataggggtgagccaccacacctggccccaggtgatccttctagtggccgatacctagagtaggactggaggcacatccacattaggagaaaggctgtgcttttgaaagtgaatgaaatgcagtagggaaccggtgccagcactctgcgaagtacccaagaatcccctcgtttttctttttcctctgatcataccatcatcacctcacaacttcttcactttctcttctcaagaatattaatttagtttttcccatttaatttttagaaaaaataaaggaagaaaatagccttttaatgtctgtgtgcttggcactttccatgttacttgtttccatttgtagaataaccctgtgatacggctgttaactattagttccccttttggaagatgaggaaattgaggctcttccttcagtagaacctgaagaatgagttcttcatacttggctaatggagataagtgtgtgttgggggaggcattccaggtcagaggctatccagaagggcaaactaagaaggaaagctgggcctgcgaaaaacacacgcggaaccgcagcagctcatggttgggggcagattgtattgggaatttggtgtgaggccaagaagtttggacttaatttggaaggtgattccaggatttttaataggaggagtgatagctataattaaaaggaattttagaaaaatttatctggaaattctgaacaagaggctggagacagggagaacagagcattggtctcggtgtgaggtgagatggtcaaaatagaggaccgacagcgattataaagagaatgagggcgcatctgcaaaatagcgccagggaagtgggcagggcccagggagaagaattggaggtgaaattcttagtttgagaaaataatggtattgaaagagaggagtctgatattgagtaagagatgacgaagttagtttaagaaagctgaaatggttgtgggatatctgattgtacatacccgcaaggcacttgaactagatatctcaagaaaaacaaaaaccagatttgaacctctctgaagtgaagtgactgtggtttgatgtgggggtgtttagtgaatacagttttaaaaaatcagaagtctgaagtttaaaccgtggacaatgtgtgcatttatagattgccctttagagatttaagaaatttaagaaaatttcagcatacattgggaacagttgaactaattttttaaaacttcccctgcatgctctcccttagtaataataggtggcctttttgcttttatcgttcaatatgttcttcatataaaaattaaatgcagctggccatggtggttcatgcctgtaatcacggcactttgggaggccgaggcaggcgaattgcttcagctcaggggtttgggaccagcctgggcaacatagtgagaccttgtatctacaaaaaatataaaaattagtcaggtgtggtggtgtgcacctgtagtcccagctacttgggagtctgaggtgagaggaatggtttgagcctgggagggggaggctgcagtgagccgagatcacgccactgcatgccagcctaggcaacctagtgagaccttgtctcaaaaaaaaaaaaaataatgtatatggttaagatggtaaattttatgttttgtgtgttttaccatgattaaaaaaagctaaatgtacacctggctatattttaaagggaaacggtagttcctatttatcggtgttaatttttagaattgaaaccccagttatattgctgttgtggaaggaaaggctggcattgttagacgatacctgaaggatggagagagagagagaaataatttctttccttgtgatccctataaccaaattcttaggagggacctattgttttttaataagctgttatttcatatattaagtgatcagtgatccagttgttgtgttgcgtaccattggccaaaaagataaaccaaataaatcatttatcatctccggccacagactggggctggctgtagtcgtggaagataatctgaatgattttgtgtgcagaaatcatagagaatgcaaacttttgaaattctatttctttcttttttttttttttttggttgagactgggtctcactcttgtcacccaggctggagtgtagtggcacgatcttcgctcactgcaacctccgactccagagttctagcagttctcgtgcctcagcctcccgagtagctgagactacaggtgcgtgacaccatggccggccaatttttgtatttttagtatagacagggtttcaccatgttggccagtgtggtcttgaactcctggcctcaagtggtctacctgcctcggcctctggaagtgctgggactacaggtgtgagctgccaaacccggcctgaaaattgtgtttctaataacctatggtttaaaagttgctacatcattttgattagtcgctgaccttgaggcagtttactggtgagaggagaaaatggaaagccaatatccagagctgttaaacactgtacgaattacttctttttttaggttgcttttcgccaatattctttggaagtaaaaggattatagtatacaacgtctcatcccggctctcccctgcattttcacattcccaggttctccatttttttttctttctttttttttttttttaagacaaggtctggctctgttgcccaggctgaagtgcaatggcacaaacatactcactgcagcctctgcctccagggctcaagctatccttccactccagcatctggagtagctgggactataggtgtgctccaccacgcccatctaaattttgtattttttgtagagatggagttttgccatgttgtccaggctggtctcaaacttgtgagctcttggcctcccaacatgctgggattataggtgtgagccaccatgcttggccggttctctttaactattcactatttctatcttactttaaaagcaaccaaccaccaacaactaaagtctgtgccttatttggatttccttagtttttacctattgtcctttttctgttccaggagtccgtctaggatatcacattacatttagtcttcagactttacttggccatgaccatttctcagacttcccttgttttcgatgaccttgacagttgtaaggaatactggtcagggatgttgtaggaggtcccaccattgggatttgtctgatgtgtctcctgtggtcaggctggggtagtgtgtctctgggaagaaggtctcggaggcagtgtgccattctcatcacagcccggggacatactgtccgtgtaacttaccacagttgatgctgaccttgaccacctggctgaggttgtgttcatcaggtttctttctccgtggtaaagttgcttttttctcccctttccgtactgtcctcggaagaaagtcattgaaggggcagggagttcttcactgcataagggtggggcatctacataaattactttggaacttctgcacaggggatggtttgcatatcctgtttagttattccatcatttatatcagtatgcattcatggatatttatttaatattttgggttgtaacacaacactactttattttgttgctcggattgttccagttttccatgggcttctatgtccctttgacacgccccatcagtgtagtttttttgttttttttggaggcagggggacattcagctctttcttaccttctgacactataagattcattggtaggtgcatttcctgcccattcctagatcggtcatttctccgaggagccctggcttcgttcagtggagaatggtgtgggaaatgcagctccgggcaggttgtcttcctcacttttggttgttgtcaggcacctgcaccggtgctgggttcaccttctcccatgacctcactttcttctttttcctatctaattttgccatagattgcccagctctgatttttacagctgtcagatttttagaagaccaagctaatacaaaattattattacttgaaagagaaattggctgcttctttatgtgatctgaattccagtattaatactatgtaggaatctggctgtaaagattgaatttggattgatagtgtttttggactgtgatttgtcttttattacagcatccaggaactttacagatttatgaaccatagtgaaatagttaaaaacttattaatgttaaattttaacaaagacccaaatgtcagagttttgcatttctgtataattcttggggttcccttgagaaaactcacttgcgaggttcctgaggacctggaaaagatggctcacaggtctcacctcctcctccacctatctacagaggagacagcctcatgttttgcagggtgcagagaagcaggggtcctttcagatatgaccattaaggctgctgctgctgcttatgagttttttgtttgtttgtttttttaaagacggagtctcgctctgttgcccaggctagggtgcagtggcatgatctcggctcactgcaacctccgcctcctgggctcaagcgattctcttgcctgagcctcctgagtagctgggattacagacgcgtgccaccacgcctggctaatttttgtatttttagtagagatggggttttaccatgtcagccaggctggtcttgaactcctgacctcgtgatcccccctgcccaccttggcctcccaaagtgctgggattagaggtgtgagccactgcacccagccgagaagttttttgttttttttttgagatggagtttcactcttgttgccccaggctggagtgcagtggtgcgatcccggcggagaagttttatacccagtgaagtgttgtgtctgtgtatattcataattttgtggtcatttgggggttgcaaagatcaggagggttcaggagaggatggtcaggtagctgtgcttccggtcagcatgtcttccgtctgcctcccaggtcctgacgtggtagatttctcatttgtgcctcatcctctaattctgatctctcccaaggctcactcccagccagtgagttctgtttttgacaaggtgagcccctgagcttcccacaagacttctagcaccagtccttccccataaagatgatgcccacttaccttctttccttcttttgctgaaagccgcagtctgactaggaaggttaataaatgagatgaccacagactgttttcctgaatgtgatactggccaaataggtctcctgcctggttgtaggtctcttttctgtgattcttaaatgaaaagggtaggagtattctttgacattctctaaccactggtcactcattgtttgaatgttatgctgttttgtgctgtgtgtttaattatgacaaggctccctctaaatatcagtagcccctttccatatccctggggttgagtgtatgctgttatcctcattttttaggtggaaaatttttggacacaagccaggaacaaagggaatgctggtgctggaatggaatcatgttgccacgggtgttgtgctctcccacttattgtttgtgtgttgtgtagctgggatgttaaatgctctttttcttcatgaaagtttgtccatagacaatttatttcagggaactgtatggataggctttgtatgtccttgcttattaataaatgacgagagtgtagatcggtaagttgtttcatagagctgaagaaagaaataaacaggaaattcatcagctccctgcatccattcattcatcattcattgatttataactagcaaaaacataagagaaaaaaataaacattcaaataataggaaaagtgaaatacagtaaggcatctttttgttgcctttgatattagctaataatgacattagcttatgaagttgagggacaagatgcagtaaaagtaactctaatgcataatttgcaacaataaaagtttctgcagccttttgggaaatcattttggcatttgtattcatggatcagaaaaaatgacctgcagttagatcaaaatttggtgactactgacatccgtgtttttggagatttgtaatactcattagcataatagtggctcttgcctgaaagaaatctgtttaacttcagaaaatccagcatttgctatgtgcatttcagtcttgtctttgtgaaagacctaataacatcctacagaactagtatctgtgttttatggtttgtgaaatgctgcctgaagatgttttttttggagatggagtttcgctcttgtcccccaggctggagtgcagtggtgcgatctcggctcactgcaacctctgcctcctgggttcaagcaattctcctgcatcagcctcctgagtagctgggattacaggcatgcactaccacgcctggctaattttgtatttttagtagagacagggtttctccatgttggtcaggctggtctcaaactcccaacctcaggtgatccgcccacctcagcctcccaaagtgttgggattataggcgtgagccaccgcgcccagcctgcctgaagatttttaatgttttcctagagcaggtgaaggtcattgacaaaacataggatttagaggaacatgttgggagggaatatgagggctttagttttaagtttgacctcgtgtagggagagccaagcagaatatcatcccagcaatggaaagacgactcttaaggcagaattaggactaaagatagaaacccgtttgttctgactgttgtgaccatgggagttgctgaggttgcctttcaacaaaggtagataacaaaagagaatctgaagggactcatgaaaggagagaagaggaagagccagtgagtcaggaaaagccaggtgagcttgaggcagtgctgtggggtccacgagaggaaaggatgaccagaaaatgaaattctgcagaggtcacaggcaacatgaaagatgattagcagcaaaaacaggcacgcgggaacacggattgggaatggatcgttgctggagtgttttctggctgtgagactacactattcagcgacggcatgcactttcatttggacccaggaggaagggccactcagggaggcgctatggccacctcaggtcactagctaatagtagtaaatagggcagcaaggatttcatctccaaagctgtctcctttgtattatgtcacatagcctgggttttccctttttaacttttaggttgaaataattttaacttaaagttttggctgggtacagtggctcacatgtttgtaatccctgtgttttgggaggccaaggtggaaggatcactggagcccaggagtaaccagcctagacaacatagcaagaccctgtctctacaaaaaaaagaaaaaataaatgttgcaaaaataggacagagaatttctgtgtactcatttacccaactttacttaaaggtcacatcttgtaattctaacacacttgtgaaaactaaaaaattatcattcgtacaatactactaactagatttcagcagttttttactagaggatggtgtttgtgcacggtcctttttcattagccttacaatgtacagtcataattttgttttctgagttgtttaggttagttttttgttccctgaacccttcagtgtagtcatgttattcatttgtatgaatgaccaaaattacagttggtcttaattttggacgccccctcccattcctggtttttatttttaaatttaatatttacacacagtgaaattctctagtttattttttttttgagaaagagtctcgcttcatcactcaggctggagtacagtggcgtgatctcagctcagtgcaacctctgccttccaggttcaaacgattttgccgcttcagcctcccgagtagctgggattacaggcatgcaccaccaagcccagctaatttttgtatttgtagtagagagagagagagggggtttcatcatgttggccaggctggtctcaaactcctggtctcaagtgatccacccgcctcagcctcccaaagtgctgggattacgagcatgagccgccgcacctggcctgaaattctcaagggtttgacagatgcacagaaacatgtctccactaccacatttgtgatacagaactattccatgagccctaaaattctctccttcagcctggtttgttttttttttttaagagacagggtcttactctgttgcctaagctagattgcagtggcgtgattgtagctcactgtagcctcgacttactgggctcaaccaatcatcctgccttggcctcccaaagtgttggaatcacagtcatgagctaccacgcccagccctgcctggatttcaatggtggttttgagagagtggattgtcagagtgctggggagatactgggaggagcaggatatgtcccagtactggagaacttgagccatgaaggctgcgtggcaagaggacagagcaccaagggttccagggtaaggctggaggagatctctctatgccactaggcaaatgggataggaattacccaaaatagaagggacagaccaagctcactgtggaggatcggcttggcaaagccagcatgaaggtacaggcaagatttgaaggaatgaagctgtgggagacctcttgactggtgactatgattttttaagttaacctcagaaagaaaaggggggatggagtttagaagagggagagattagtaacatctgcaggccacagccttaggccaggcagggttgctcaagcctttaatcccagcacttgggaggggaggctggaggatcactcgaggccagtttgagaccagtctgggtgagagcaagaccccatttctacagcaaataagaattagctgagtgtggcggtgcttgtaaggatcacttgagcccagaagttcgaggctgcagtgagctatgatcatggcactgcactccagcctggacagcagagccaggtcctgtgtcaaaggaaagaaaagaagcagcccttgtctcttggcaggatgggagttaataaggaaaaacaaaattgcagtgctaaatgacgctgaggacctgctgtggagggctacaggcacgccctcaatttccctggagcttctctcctggaaaaagcaaaggagctctcactgtagctgagctttcgttttgacccagaagagtttggagttggggagtgagctttcttagagagctgtgatgtgagaagtaggccgagtgggggaggttgagctttcagagaaggctgaggtttgtagggacagggactttcccttagttgctcctgatgtgcgaggtggggaatggatgggggcggggagcctacttttataaccttgagggaggagtgtggaataactgcagcaaagggctggggctggcttcactcctctatttcccaaggtcgtgacctggttcgtggcattagtatgtgactcctgtgttgatatttccagaagcagtttgaatttcagatcaggaaatctgttatatttcagatcaggaatatcaagtgttagctgaagaagaaaacatactaccttgagcaaagtatttgtatatccatgattggtatcatcaggtttaaggaaaccagtaaataactattttggatagtagcaactatatttgctaatttcttgttaactcatacagaattaacaaaacatacatttgttctttgactgtgcgtataaactgtatttgtacgctatgtgttaccctggtgtaggctgcttagaaaatgaagctcttgtgctgagagggggcagagtgtgatcagggtgcccagcagtgctgacaggtcagagggtccaggcgacttgttggtgtcccattgtgtcagctttcttccctgtggccggggaggaacctttagacctgcaaggtgctctgggctggctgtctcgacttaatcagggtctgattagtgtgaaggctaaaggtaaaatgaaacttttctgtggcatttgtcactggcatgggaccttcagatggcaagtaattaagagattccatagcttttttcataactgcttatttttcttttccacattttttcatgtgtgtgtctgcgtgtatgctatttttttgaaatctgagaatctgccatttttggggcccagtctctcccacccctgcctgcacttcctagagagaggcagtgaaccatggcagctgctccagaggcgcggctgatcaaattttttaaaaaaacttggcccccaaactgacccatgtccccagctggtttaggaagagtgaagaagcatgaggtcgacctgcgtagctgaaccgatttggtgtttggaatggaaatgcagtgagaaaataggtttccctgatatgcagtcgagattgaagtgggataaaagcggcagaagatcagttggaagagaagagagaaggttttttttcttttctttggtggaagagatacaatgtgcagagccttggaaattctaaagatgtaagagattggtgatggaggcagagctaaggtttgcataatgataatgggaagagcaagaatttgaatgtaggcagccaagagaagtcaatccctgtgtttcttgaagatgtataaaaactggggatgctagctagattcattttctaagaggaggaaattaaatttgaaacattacgtaatataaacataagttataagaacattttatatttgaaggaaagataggaaagatgaaaacatgctagatccattcatttattgaattatttttttggggccaggcacagtggctcacacctgtaatcctggcactttgggaggctgaggcaggaggattgtttgagctcaggagttcgagaccagcttggacaacatagtgagaccccatcctaaaagaaagggaaaggaaaaaatatatatatataaaagaattatttttttaaaaattcagcggaataaaaaagatacaatgaagggtctcagtggccagatagtgctagaaaataagactgggaatcccaaagcagaccttgtattattacagttgttttatgggaagcctttataatactgccaagatggtcagtagactttgatttgtttttctctaagtaggactgttatgatttagagggtattgattttcattaagggaaatgttagtttctgtattaaatagggaaccagcgttttcacaggtcagaggaggcagaccttggctggatttaggcgtgcatctttctgtttcaggattaaagttgggatttaatggttaggctgtgcctatgcctttaatactgacattctctaattggaaattgggaaaccaacaatttttttattgcaaaggaagaagaattttgttacaaagtatgagaagtatgattaaggggtgaataggtttttcttacgtttttcttttgacttcataacttttgacttctgccaacaaagatgaaatagcttttcataattctcagaggctttgagtaggaaaggaaatgttttgtctctgtgtcatacgagaaaataaagtgatcatgtgacagacctgagttctttcaatttccttttttgtaaacaggtctgattccctcagatattgttgatgtctttgggtgaaagaacattatacattaagcacaaatgctattagtgaattataggtcatttatatagggtttacttttaaattaaaagaccattggccaggcgtggtggctcacatctgtaatcccagcactctgggaggccgcggcgggcggatcacgaggtcaggagcttgagaccagcctggccaacatggtgaaaccccgtctctactaaaaatacaaaaattagccagatgtggtggcaggtgcctgtaatcccggctactcgggaggctgaggcaggagaattgcttgaacccaggaggcggaggttgcagtgagccgagatcacactgctgtactccagcctgggtgacagagcaagactccgtctcggaaaaaataaataaataaaataaaagactattattgcctttgaagggagatgtattttatagggcataagtgaaagacattgttaaaataactaaagctaattctgtttgaaaatcaaactgttgagggaaagggaagctaaaatgagatcgttctattttatcttttaaaagagaggactgagatttatttttgtaatgtttttaagcaaaagaatctatttttaagacagtagtacttaggaattggggtggaaagcgaagaaaactttcagacataaacattcctctttgtattcagtataactgagaaatgaagtgggagttatacatttttttcccctccaagtggaatggaacacttgctcttgccttccagaatgtgggaagggaaagggtaataggacaatgtgattgtgggtatgaaaaacattcctataaaccaaaaaagaagtgtgaagttacagagtggtatccattccattagttatacaaccccagagaggggagtccaggcaccacagtgatctcgggtttcagacgacacgatgcgctttcggttggccactgcactcagaaatgcccattatgcattttcagcttctagtcggccttcctgcaggtgaactaggatgactgactcactttttaaaactaccatcagttcactctgacctcttaccacgtcccactgcttcacgctggactcccccacgtcccccatgagaagagtataaaccttaggtggagtagagggatggggacagggtgaggctggatcactgtggagaaagagttgcttctcaaccccttgaggggtttgcaggcatgggagttcctctctggggccttctagatcctaactctgctttagctgggcaggtaggaaaagatggggtgatgtggaggtcaacaagtttagcattaactcagtgattcagtacggctgctgtgcatgcgtttataaatcaggaggttcctgtacgtgcaacagcagaaaaaggtgagaagagccatattaaccttcccagggttcataagaatgtcagacagtcgcactgccgaccactcaagtttggtttcatggggtgacctttcctcattcatgtggttgtatgttctgggcctcccacccactgagtatttgaattatctcttatcttctttttgttcctgaactgactgccctctgggatgaacagtgtgaaactgtataaagtcttttgctcaccaaagtcataaagagagggcaaatgacattaaaatcctgtgaagctcgaaagaaagagttgggggactagggcagagccccactaccatggggacttccagagcctgagcccaagctttgcatcagttaaaaatctacttttcagtccctttcaaccctggtggggcagggggtggtgtcttgagttttctaatcacagtgacctccaactttagatcaacatggttggtaaggatagatcacagggatactctgctaatggcagctttattgtgagtattccatttacaacaccaggatgatgaatagaaagaagagtggtgacattcagggattatttgtaagtgggtggattcttttgtggatatagtgcctgacagatggctttttcattccccacgttttgcagtttaaatgttcaatttcatttaaaaaacaaaaccataatcacagactttccactgaatctgacttctcatagatatttgtacgtcagtatccctttagagatgttaatgttttatttcctgtgtactttttgcatcggtggtagcttggtgctgggggtatgttattccccctctgtttccgcaggcgcccctctgagagaagagtggtcacagaatgttttctctatgctgagtaagccatcgaaagaaaagcacatgtgacttcttcagctcggtattaaccgagacaggtgtgaatagaagcggatttattcttcagctcccatcgaaccctaagtgttgatttcgccttcaacagtagttttttctaaccaaattcttcagtgtgtttggatgtgtccccagagtgagttaatatactgagggtcttagcagctgttgatagatttgtggtgtatatgagttttctcaggcatgtgtattctcactgagtagaaattctctcttgaccctggaatagttacttttattaggaatgtgtgatgttttctagattgtacaagaaaaaaaaaatcaagtgcttcagtaagatgtggaaggaggcaacgtgtcagggaccactaaagcagattcgaaggaaggataatgacacagcaaataccgaagggcagagtctgtctaggaacacgcatctaaattggctaggtgaattcttccactgaaagttgcctgaagtcagctgctaccctcttcccttccgactgactgctgcttgcttcattcccctttctcttctctcactctcttctcttccctctttcctttccttctcttcctggctgtttgcctccactgcagaaggaacagatccaagagatcccctcacttgctgagggccccagagctagtgagtgacagagctgggtccagccctgttcttctgttataaacccagtgcctgtcttggtgttgcgttatttgacatttatgctagaaagatgagtgacactttgcctgtcctcaggcagcttacaggccagtatgtaagaggagacaagtacacacagactggagtagagaccaggaaacagtagagtctcaggatggaaggctggggttccagggagcagaacatgccccctgcagtggaggctttatctcccctgacaatcacttgtcctctgcgggtcgggggaagagccccttttaaagatccctcaagcactgcatgtattcatatatccttcatgtttagtaatggctgtgaccatccatttttctaaaactctccatcctcctatcatctgggaatgtttcttttttaacaaacataatagggaaaattagggttaaataaaaatggacagaatcagctccttagggttttttttttttaaaaagtcccaaatggaatttattagcagatatcctgcagtagctgtggatgctgatttctttcttctgtggatgaatattgaaatctgtacttgccttttttgattgtggtatgtttcttttaataaggtatcccaaatctgatggtgacgatgatagtgataattttgccagcagaattaaatactgtcaagatcaaaatatgttggaagtagctttttatgaaagggacacattttctagttgctacaccagaacctgtttttctaggctacagcagtttcaatcaacttcattcttgttagctgggagccacgctggtaacaccgtatagcagtgtggagggcttacttttgaagctaaaattatctaggtcttacatgtattttctcgatgtttgtccacttggactcagagtttcgtagttaccgtaaatgcagttacctccttgctctttcttagtaatcgttatgttagtgtgaattgtataggggttttatctcatcgtgagga[450 bp omitted]cgatctccagtgctgaagagtttgatgacgacgagaagattgaggtggatgacccccctgacaaggaggacatgcgatcaagcttcaggtcgaatgtgttgacggggtcggctccccagcaggactacgataagctgaaggcactcggaggggaaaactccagcaaaactggactctctacgtcaggcaatgtggagaaaaacaaagctgttaagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaagtagagtatcatttaaatttttgtgtttcagtgatgagtctgtaggcatgagtgcttgataagatgcccttgattttagggtgggaatgcagtgaaatggacgtgtgtgtgtgtgtgtgtgtgtgtgtgtgtgtgtgtgtgtgtgtgtgtgtgtgtgtttggggaggggagggggaatgcctgtgcagccgggcacatgatccagtaaggattgttttcatagaatagaaacaattagctggggatgtggtggtggcagtggtgttggaggtggtagcaggagtggtagtggcagtggtggttgtggttgtggcagcagtggcgtgtgcctgttgcgccagctatattcgggaggctgaggtgggaagattgcttgagcccaggagtttgaagctgcagtgagctgtgattgagccactgcactgtagcctagcattggggcgagatcatatctctttaaaaaaaaaagaacagaaacaatgttgaaacatgaatcttattttagtaaaacgagttttttgaggggaggataatatatatatactagttgagttgtggaactttagattttggtaatcgtttggtcattggaatgtatattgaaagtctgagatttagcggattatagtgtcatcccattgtattaagtatttgagcccggcttcatcatcagagctcctgagttagtgacaattttgatatttagaaaaatacttactgttatttatttatctatctgctggcagctctactgagcttactgttgttatttataatgctgatcttacttttacagttaaatgcatttatcagtacccatttctgtggcatgtctgcttacttaagatggtggtccagaagtgtgttcagtaatatccttcactgcaatgaatttaagccacaaatggcaaacccatctccaattaaacagaatacctttgtgtgtgtttgcagcttttgttttgtagtgaagtgcaggtcaatgttggtgaattacatttcacagtgggcatcaatcagccttttatctccatcatttgctacttcatgaggcaacttttagctaatagataaatgtgtttatcataaatatataatctattatttggaagtaattagacatgttgaatgaaataaattcgagttagaccatgtgacatattgtccaaactagaaagcttgtgaaatttcactgggcacagtggcttatgcctgtaatcccagcactttaggaggccgagacaggtgaattgcctgagctcaggagttcgagaccagcctgggcaacatggtgaaacctcatctctaacaaaaataccaaacattagccgggcttggtggtgcatgctgttggtcccagctacttgggaggctgaggtgggaagatcagttgagcctgagaggtggaggttgcagtgagctgagatcataccacggcactccagcctcaggtgacagagcaagaccctgtctccaaaaaaaaaaaggaaaaaacttgtgaaattcaaagggagcactagtttgagctaatatactctgctcctcaaacatctctataaagatttaacagtaaactgggctttcctttttttctccctccaatattttgttaattaattaggatgtttatgccgcaattcagaagtttggtgctatcttggtgattagttcctcagggtaattactggtttaagttctttgtagcattttcagtttggggaacaaaagatcaagaataccccggtaatttttttatctggtttttcagttcagtggaaatggaagcaataaagagttttgacagcattcttgcaggtttgaatgttaaatgtttcattggctctggcagtaaaatgctcaaaaaataggaaagcagcaacttagttcaagaaggctatgatggctccagctgttaacctagcccggtgacaatgcctgggttctgtctacatggatgtcctcccatcttgacaccgcttcatcaaaggataatatttcttttcatcctaacaggatgcagtaaaaaaggggaaaaagccaaaaagctctttcttcatttctgttgtcttcgtgtctgtgtctgctggtgggctgtgtagagcggtcgactgtgtcctggcttaggagggttctcactatgagctgtgtgctctgtatctggcctttggagctaccctcagatgtgtctgtctgagacctccttctctgagagcaaggaagggcatgagcaggcgggtaggaatgtccttattccctgcgtttccctagtttttgttctttattaaccttttaggctcaacagccaaactagggtgaaacgggtgaaactctgtccccaggaggagagatgaacatcttttcttttgtgtgtggttgctttggcatcacttttgtatcttgctgggacgagtacgcaggtcacccgtttgacgcggaatcccaaggagtgaatcagggcagaatgtatatttaactctcagaccagatacacacaagcaaaacactcacctcctgatctgtttccgttttgcagccatccactcacctatgtaggccactcagctcaccagcgaagggcgttggtttgtagtgagcttcaacccactgcatagccaagcactgcaggaccagcagtgtgaaaaggccccatagcacgctctcctcctgttcctcgtctcccctttctcactggatctagaatgcttcttcacagcttcccattttcccagactcagccagactgtgtcactcagacccaagaggggagtgtggcttctgcctcagtaggaatagctgctgtgtcttcagcattcatggtttaacccaacctggagtctcttccttggttctaggggctcagtaggatgcctgtggctgttgccatcctagcctccacatgtggccatgggggttctcgaccattactgttgcctggggtgctatccagcagccatgggagtgggaggtgggggctgcagtaagacagggagaaaagaaaagagaaaatagcctttgtttcatccttctcgtttgccagtcacatgactgttggccagtttacagtttgttcaactggaatgggaaaaaattacacagaacttggtttctgtctgaggatggcacttaaaacacacatgactgcttacaaatctagaaatggacacgggagcctgaagtaccggcaactgtgccaagcccctcctttcctctgttgtacaacatattccatatttttttttttgagatggagtctcactctgtcgcccaggctggagtgcagtggcatgatctcggctcatggcaacctctgcctcctgggttcaagtgattcccctgcctcagcctccagagcagctgggattacaggcacacatcaccgcatccagctaatttttgtatttttagtagagacggggtttcaccatgttggccgggctggtcttgaactcctaacctcaagtgatccacccgccttggcctcccaaagtgctgggattataggtgtgatccacccccgcccggctagcattccatgtattttaacactttaactccatttccccattgacctccacattcttggtagctcatgggtgaattggaagagtataccagtctacactgtaacttttttctggtgctcacaccctgacctgtgctttctggggtaggaacccagtgcagtttaagcctgtgcctgtggctctggggcaggatgccctgggtctgcacattagtgtctagttagtctagtctcatcacccgaagtggattcctgaaccaaccttgctgccactgttcatggttcagaaggtgtaaagggtatggcctctggggtccttgctagactggcaggtccatcgccctttactcagtgcctttcagctccttggtttactgggtctggagaaaggtatgacttcattagcggagggacctccttccctttttcttttgagataattgtagattcatgtaacaaataatacagagagaacttgtatacccttcatccagttccccacaatggtaacatctcacaaaactatagaacagtatcacagctgggacatgagcgttgactcagtcaagatacagagcttttccagcactacaaagatctcatattgctcatttatagccacccacagcctctcctcactccttaacccctggcaaccactaagctgtttttcatttctataattttttcatttcaggaatgttacatagatggaatcatatagtgtataactccttaggattggctttttttcactcagcataattccctggttgttgcgtatatcaatagtatattcctttttattgctgagtagattccattgtatggttatactatagttcatttaaccattcacttgttgaaagacatctgcattggatccagttgggggctatgatggataaagctattattaacattgtgtataggtttttttgtggacataagtttttatttctctgggataaatgcctatttatcatcagagtataactgctgttttacatggtatttgcacgtttagactcttaaactgtttttcagagtggctgtatcattctatattcccaggagcaacacacgagggatccagtttctctgcatcctccagcatttggtgctgttaccatattttattttagccattttgatagatgtgtggtattattttattgtggtttcaattcatgtttccctagtggctaatgatgttgaacaccttttcatgggtttaatttgccatctgtttttcctttttggtgaaatgtctcttcatatcttttgcccatttctaattaggttgtttgcttttacaacagatcaattgggtttcacaagttcttgatagagcctagatactagtcttttgttggctatgtggctgcaagtgttttcgcccagtctatagcttgtcttttcatcctcttctttagcagagcaaaagtttgtaattttcgtgaagtcaagtatatcagttttccatcttatgacctctgcttttggtgtcaagtctaaggcatagctctagatcctaaacattttcttctgtgtttttttcctcaacgttttataattctgtgatttacatttaagtctgtgactcattttgagttgatgtttgtatcaggtgtgagatttaggtggagggtcattttttcccccaatacttggccatttgttgaagatgctgtcatcctccaatgaactgcttttgcccctttgtcaagtatcagttaggcatttgtgtggggctatttctggattctttattctgttccattgatctgtgtgtctgtccctctaccagtatctacagtctgagtactgtaattaggtagtcttcaagtctggtagatggatgcttccaatttatttttcttttccaaaattgttttcactcatctagttcttttgccttttcatataaattttagaataatgttgtgtgtttctgtaaaacaacttgctgggattttgataggaattgcattaaacctgcatatcagtttgggggagaattgacatctttactatattgagcgtttcagtccatgaacatgggcatagattcatcatttatttatactgataagaacagatactacacttgttcttagccaaaaggccgataaatgattcttcatttatttatatctttgattctttgttttgtagttttcttttctttttgttttgagatggcgtttcgctcttgttgcccaggctggagtgcaatggcgcgatctcaggtcacggcaacctccatctcctgggttcaagagattctcctgccttagcctcccgagtagctgggattacaggcatgcgccaccatgcccggctaattttatatttttagtagagacagggttgagatggggtttctccatgttggtcaggctggtctcgaactcctgagctcaggtgatccgcctgcctcagcctcccaaagtgctgggattataggcgtgagccactgtacccggccttgtagttttcatcatataagtcctgtgcatgttttgttagatttcttttttcaaacaatcataagtggtatatatttttggtgaggacacgttcatcactaataatttttatatattttttgtgtatcctttgactctgttgaactcagttattggtttcagggcttttttttggatagattatactgatttttcagatatcaaaatagccttgcatttctggaatgaatcccacttggtcaagctgcatatttctttttatatgttttgaattataattgctgctattttgttaaggagttttgcatctatatgcatgtagatatccttttttgttctgttcttgtttggtttgagataggttgatactcactttttaaagaattgagaagtattccctccttcaatttttctggaagagagtgtgtataattggtgttagtttttctttggtagaattctccaatgaaaccatctgggcctagagatttcttttctagggtttaaaaaaatacctgttgggctggtggtgggggaattggcagagatcaaaatttacctttgctactgggcttctctgacacccaccatctgggtagggacgttgggacagacagctcattacagtctcaagagggctgaagtcttggctgcacctctactttgcacaggttggggtggggccgtagtgttttctgtgggatttggctggagtagacagtgttcctttaaaagttttctgttttcctaggcactcgtttcttggtggtcggctacagagcacaggcttttcttgggaatttttttttgtctctacccattggcattttgggttgctagcttcttcagctccaaatctgggatatatgaggcgaagagaaacccagggaactgactaccctgtcattcctagggtcttgagatccctagctaacctttcactccacctttcagagtccttttatgtttgttttatatataatgttcagggttttgacttgtacttaatgggaagaatagggaaagttactcttattccattttcctcaaagtggacgttttactccatgtttaaaaaagatcctaatatacctgtcctgtcttcaaggagagattgtgtaattgcattattgtgctctgccggagactttcagaccccaatctctgtttttgcaattaggcttcctgggagggtcactttccatttgacttcctgggatttctgttgtctctgaatggaagacattttctccacccagtgtaaacttcctttcttagccccgtctttaaaagcagttaggagtgagaattgcgtcttttacctttcacatctggtgggctgagcctcttttaagaccttaagaacgtacttttcttgatttagctcagtcactatccccttttttatctttctttttatattttatttttcccttgttatcattttctattttgacctctgtttatgttttgaacagagcctgtctcagtttccccagggtgcttctctgcacccagcagagggtctgtctgcctgtgagcaccagctggggctgttcctcccacgcctctcaccacctccccttacgcatgcctttagccttctgagactgccagtatgccatgggttaaaggaaggtttgggtggcatttggtgcattctctctgccagttgctgctgcccctccaagtgttctgtagacaatctatgcagaagtaacaattgccagagagactcagaagcaccacttccttatgaactggtctatgctcagtgacccccaagagcaggtctctggtaagagctgtgttggaatatatggttttagctcgaggctctctgccatacattcccaaagctgtcttgggatttgatcacactctggtacacgatctgggccaggaaccgaaagcctgctaggctgaggttagactgcctgcgtgcatctgcttaccccttggaggagacagtggcagagggagagagcctagaggactgaggaccttgtggggatcactaccttccagggagcatggaatcaagcagtaaataaaaacagttctgagcagttgactctttagccattaaatctgccccagttaggggtttgtattctgatctatctgcttaataatctctgctttgggttacgttgagaaaagggagtgggcaagagaccagaggagctttccttttctccatgaagtatttaagagctgaggactgtcgtttgaataattgatattttaatgtgttgggatgtcattgcttcacctcctcttaaaaccatgtctaaatttaaccaactacagactggaaatgctttctgtaaccccttaattttaaaaacctgttttcttcttgtggcatttatatcagctgtagaatcacagaatgctataggtcttttggccagcccttttattttacaattgaaaaaacaaatgcccaattggtggcagagctgggactcaaggcaaaatttctgtattgctggttcattctttctgcttctctaagatgttgaagcataggctcttacagccggagggaccttaggaatcacataaggatggattcttggggttacttccgagtcaccttcaagagtgtggataaaggtgacatttgcagtggtcctcatttttggggattgctggttcactttagtttcaggaactttctgggcatcgttaatacaacatactaactgtattctcgtgagcagcctctgctggttctcatttctagatcccgctctgctcagacagcttcctctggaaaccagggagctcatctgaattcctcccctccgccgtctcccaaaatacccttattagctgaagacttgtgacccttggcttttggtcctgctcttctaagtgtttaatttaaattttggtcaagactagtcctgtcctagtttatattttagtgttaccaaccttcagtttacccgtattcttcagtaataagcatgtaagtagatgatatgtgttggccatatagctttctgtaaatttgttcatttaactgtcaactcttattagggatttttttgcgtagcagaatgatttgaggacaaaaccagcacaaccaactagctctgtgagcaaaaggcatataaagccatttctgctgtatttgcttggtatgacttccatttaagtgagatctgaaatgaaatgctttctttgtgttctcagtgtgaaattggacaaaagtgaaagccacaaaacaaactggtatactttattatttttgtataattatactttaggcagaagattgtggaacttcttttaatgaggtgagagtaatttgcttagcatctgggctgactgttaagctggtattgtttctgcctttagctccaatgtttcatgttggtgtaggcttttggtctgtttgaaatttaaacataaatatacagccatacgtttctctagcctctctcactctcatgtacctctcccaggctacttttctgcctaaaatatgagcaaaaacacgtagaattatttttcttattactcagctaattcctcatctatagaaagaggatgtcaagcttgaacactctctgattccttaactggccagaatgtacctggttcccccttccctgtagcctgcatttgcatgctattgatcaatttcagtgacaggattggatagaaaaggctcagtaagagtaccgggcgcagtggctcacgcctctaatcctagcactttgggaggccaaagtgggcggattgcctgagctcaggagttcgagaccagcctgggcaacatagtgaaaccctgtctctactaaaatacaaaaaaattagccaggcatggcggtgcgtgcctgcagtcccagctacttgggaggctgaggcaggagaattgcttgaacctgggaggcagaggttgcagtgagctgagattatgctgttacactccagtctgggcaacagagtgagactccatctcaaaaaaaaaaaaaaaaaaaaagtacagtcatcttttagtttcctcaggtgttggttctaggacccccttcagataccaacatctgagaatgctcaagcccctgttataaaatggcatagtatttgcatataacctaagcatataacctgcctgtgtcctttaaatcatctcaagattacttataatacctaatagtgtaaatataaatagttgttatactggattttttattgttgtattgttattttttatttttttcccaaatatttttgatctgtggttgattgaatacatagatgcagaacctcaggatacagagagttgattgtaattgcaaagcgtggaatgtgggtacttttcggctttattttcctatagctttctagtattacctattgaaaagtaatgtttactttaaaaagtaacagtttaaccgagcaaataaggctgccctagaatagaaattaactttattacctaagtaccgaaaacatttatccatttttagatgacataagtaaaatgtcaagacacacataaaaccacttaggtgccctttattatgcttttttctattgaaaaggcagttactgtcacattaaactgctttatcctctactaagtagcttcagcttgtgtagtagagtgttagaattttaagatatattttaatttacttgattaaaaaaagtaaggaaagtcagtcattacaggccacaaagagatccttgtgtgccctcatgctcaaatacatcccccaaacccagaggatgttcattattttcatgaattcaaagcattagaaaagctaatggaagatactcctttgtgctgtgaaaatgcatcaccactatcatgggaaacaggggatgacaagttttctgtaacaggaacagtgaatacaacttgagggagtacagctaagcaaatgatgtcatgtgagtttaaaactattgataccatgcaagcatcaaggaggaggatgtctccaaccaaaacagcgtgttttttttctcagaatggaatggagccagcacggtggctcacacctgtagtcccagcactttgagaggccaaggcaggaggatggcttgaggccaggagtttgagagcagccttgacaatatggtgagaccctgtctgtacaaaaaaaaaaaagaacattggctgagtgtggtggcgtgtgcctgtggtctcagttattggggaggctgaggagtgaggattgcttgaggccaggaggtggagtctgcagtgagctgtgatcacgccactgtactccagcctgggcaacaaagtgagacactatctcaaaacaacaacaataataaaaaacccaaaccaaatggagtcaaggagtagaggaggcaggtgaataaagatagaaatgtgggagtaactaagtgtctgtacgtggatatgcatgcatctacagaaactaaaggcaaggtctctagtgtccagcgtgattccccagtgaccattttctcccacttcaggaattgcaaagtatgaaagcattttgatttgaggctgtagtccctatgcctccctctttctccttgtgcttctgtatcgaaagtgggtgaggagcctcagctgatgggaacgagtgagtgcagagtcctacagttggggtggggagacatgatgatgatacattccaatgaatttaagtaattccttgtgcatcttatatgtattgtgaaggataaccatttgtagtatatcttgatgaaaatgtgcaaatttttttcaggaacactgtctgctttttagattttctttccattttctaccgttctaaagtagtgcaatcacattactttagataaaagagaagcagcaggggaggggactcacctctactctgacatgccgtggtcattgttggcattcaggtatatttgctaatggttttccctgtgtgtttttgtttattcattcattatatccccaccccactcctcgattccagttcaaatcctggttcttccacttaataggtatggagccttgggcgagtttcttaactttactgagccttcgtttccttatctgtaaagtggagatgttatctgcttcataggttatgagaattaaatgagatgatgtacttcaatttacttaatgtatttaaaatacctagcttaccatttgactcatggtaggatgggaccaatctatatattttaatataatatgtatatacacacacatgcatgtacgtgtgtatgtatatatgtatgtatgtatataaatgtgtgtgtgtatatatatatataaatgttttttgacttcttttagtatagaaaatgctaactttattcccaagtaagtgcaagacattttaagatgcctgtggaagttcagacatcataattccctgcctgggactgtgtgaaggtagatagaagactttagttcacagaaacaaatggttacctgtggtaatgtagatgttaacaggatctgttattaatgaatctgttgactggttttccttgctgtggcttgttctaacctttgaaatatgtgttatgagaaaaggggtgctatttttttaatgatgctaacttcattaaagctacctgtaatgttcttattttgtgattataataaacattttttgggataaaatttgtattttagtcctttcaggagaaaatcaagaaagaattttcaagtgagtttcctatttttcttagtctaagtcactcggaagtttaaaccttaatttttgggcgtgcttcaaaaacaagaagaataaaaaaagtctttttaaaatttcttaactgttgtcaatataaacaaatgctttaaatcttagcaagaatctatattttgagactttctttggctttaatacaaattgtacattttagaagatggtagataatttgtgtttgcacgaatgtctgaaagtatttaaacacagtttatgtcatatgctatgtgaggtttatttttggggtggaagtaataagtcctcagtttatgtttactttaagtttttttggttttgtgtttttaaaaatataccatgtttagtgcctatatcttaagaggatgaaaaacagtgttttgggttttcctggatagttactgatatagagccttttccaaagaggatttcacccttaattttattttatacataatcagattttaagctctataaaattttaatttaatgtctaaatttgtatacttgaacttgagttccttggttttaattataaattatatcatggccagatcatccatttaaaggccaattttagtgcaaaaagaacaaataattgctgtagccattcttttgcactcctgtatttcagatttcaaataactggttggtgaacaattggattagcttctaattaatttttattattttggagaaagctttttatgaattgtgaggactgtgactactgtcaagatgtgtatgcctataaacttgttactatatattaaagtcttttgctcacataaatttgtaagaatacctctttgccctaagcaaaatgcaaaagtaatggaattggaactctgctgaaacaggtgtttttagctcatactttgagacgagcctgactagatagcacatactgtgattttacaggatagagaattgtacgctggacatgtaactttcaagttggcttttcccttgggcttagaatcaattactgtagtgtttgaaatgaaggatgtataattatctggaggtttaaccaaggttctttgcatattagaaagtacttagtaggaccaaccctgtttccccctttggtttgtttagaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcggtcagtatatcattcacttatgtgcaagtaaaactcgttcacttacaaccgcacagcattttgagtggtttgcacacacagttttctgggtcatacggtgatacctcgattaacagatcctctgggaacctagctcgtttgtagagtccatctgtttgaatcctcttaatgtaatattggccctgctggtccgcacaaagtggagggtcatggggcctgtccttttaggcacactcttgcatgtgtgcaggtgtggctttgactgtcagctttgactgtaccctttgtagcagacttttgttatcatactctttgcattttaacccctgcaagaaaactatacattccgcacctcttaatatttccccttctctaatgaaaacagaaatagtgcgatggtcttttacttttatttggtccacattgaaagatggggtgtatgttccagccttgcactccaaataaccttctcctcctccccactcctcctcctccccactcctcctcctccccactcctcctcctccccactcctcctcctccccactcctcctcctccccactcctcctcctcccctctcctcctcctcccctctccttctcctcccctctccttctctccctcctccctttctcctcctccctctccccctcccttctctccccttctccttccctctccctcctcccccttactcctcctcccttcctcctccctctccctcctctcccctctccctcctctccctctccctcctctcccctctccctcctctcccctctccctcctcccccctctccctcctcccccactcctcctccctctccccttctccctcctccccatttcctccttctcccttctcccccctcttccccccttcctcctcctccctctcccccttcgagttctctcattcctcccttgtctcttctgcatatcttcactgtagtcccttttactgtccctcaggattctcagatgtgcattgtacaacatctggcaaatctaatgttagctagtgttgaatgattatatatatgaacttttctctccatcttatgaccttcctgtgccttttatattttcactaagaagattccaccaaggaaaacatgtcactgatacacagtgtctttgttaatagaggtattactgtattatatgtttatcttaacattaagtatttgcttacctggtaactttgttagattgttaatatgcagtgattttttttttcacctgtaataaattatgttgaataaaaatgaagtccagttggcatgatttgatggttttatttaagtttaggttctggtatcatcagttcctaggtggttctgcccagttttgcattaaacaacactaagctatgagacttaacttcacattttatctcatgcctccaaacttgtaatgcacaaatgttttatggattgagatctagcctggtggaaacctttggcttggaaatcaagaaaccagttttcttgtacgacttctgccagtaactaattatgtggtaattcacgtattctttctgtgccatggtgcctctgtcagtaaaattggtgcattgtctgcctccagctccactgggatgttactgagcaaaacaggataatcaaaggtgccccagatctgcaaagtccatgcagaataatactttcgttcttgccatcacgttttgaaactattattaatggattatgtgtttaataatagaaagcagctctgcagcacttcccaagtgctcttctttgcactaatgtcaaatttttctcaaatgtttagtttttctaatagaatgaaagttgatatgattaaaggaaatatgacttcttcaattttagctattgctgatatctttcctaaattaaaacagaagctccacatgcaggctgaaagtaatcaactcacttgggaaaagaccatccttgctcttctgttcttttgccctactcacagagttgttcaaattcggtatttcaaattgtagatttcaagttgttaaccaaaaattttgtgttaagtgtagatttttttctccctggacttgaggctatatggggctggtaaacaacgatgtgttgtgaagtttagttcatgttgactgctcctttagaagagaggagcaattttaaacgtaattcttttcctctgctgcttcatatgagggtccaggttcatgtttaagtggggcttagtagccccgtggccttgtcatgttttttgctccctttggctctatagttactcattttcaatgtgtcttttctttagccagatgagtctaatgtagcagcatggttcccacgccttactttgtctcgtcttggtgcagtgtgccttgctgtctctcctcttgctcatattacatctcccaaatactgatgggtcatccctggctcctggttaacttggtaaaagttatatattgataaaagtcaaatattttttctgaattttcctgcctcttgatacactggactgtatatctagaaaggggaatggttataggattttatactgtaaatattttttttaattcaaaaaataaagaaactttattgctatccagaataggacttcaggatattacgtatttcttagtagacaggatttttcatagcattaagatactgcatgagccgtttgaagtctgcctttctttgtcttatttacatcccccattggcctctgttgccccctgaaatgcctcttcttcctgtaagcagatgttttatgactttttaaaataccctgctttcgtttcttacattaaggagggtttcccttggtctccatggtgttctctggattgagtcatagccacttcctcttgcttcaaaaaattccatctttattttagatacttcctttttatttgctgtacattaaaccttcctctcactccaagtgactttaggtaattattgcttttctctgtattcctttttgtccttcctggttcttttgctctttaaacaccatctttctatccttcatgggaaaatcttctgtttatagtttatggtgtggtaggtccttcagtttcattaattacccatctacttttgttttacataatcttcctctttcatgggagttgtaggcttctaggtttgggaagagctaaaaatgatctattttaattcttctcattttacaaatgagtaactggcccagagaggagcattaacctgttcaagacaactcagtaagttaacccaaaatagtttcaatatgcttaggtggctctattgcctgaaataccagttcaagtagataggctagagaggctgtccttttattctctattgttatttagtgtttaaacatagctgttgctgaacataatgccttcagtcactggaaatgctaatgcgttagttatgattttaacagaatgcttgcaaagcttaaatagaatgcatacaatccagaacatgccactcctgtgtaacttcggaagcatctccatgattcagaagggaggttctaagaatagaagcatcttagattgtcatagaagtctttggacactgccccccggaaaccaggccctgtctgcagtcttccttccctgggtagctcacatctgggagcacatatgttcagttgtattagaggtaaatttctggagacttttgtacctgcagagagaccactcttaaatagttttcaggtgtgaacaaggaagacttggtcatcaagtggaggtgtaagtgttgcttagagtctttgtgtgaaaaagatgagatagaggagaaatgtatcttagatttaaagtttgtctttgttggattatatttgagcagggaatgagctaattgtgagattactagaaattcataaagtaaggaggttagctagacaattttttttagagatgctgaattttcagaggtttgtaattcatgcaatttcttaaacaaatgcaagtgtacttaaatttattttctaggagacaaaacacctaggtggttgaccttctctatcctgtggaccaccatgaaccccacatacattgaccacatcagtgtgtaccaggaaacagtgggccgaggccttggagccagaacttctttgttcctctctgcccctctgttcttggcatgcaggtttagacactgaagatttcttccattagaaatgctatttgggtcctggagatgggtaggaaactcagggccctggtgccagaatccagcatatgtaacctctccaaaaacagtggtctggagatttgacatccattcttaaaaatgttaaagatgctccaaaaatagaccatttgagttttatttttcttcttcatgatcttttctcttaaacatataaaaataggctgggcatggtggtttacacctataatcccagcattttgggaagctgaggtgggcgaatcacttgaggctaggagtttgagaccagcttggccaacatggcgaaaccccatctctactaaaaatacaaaaagtaattgggcatggtggtacacacctgtaatcccagctacttgggaggctgaggcacgagaattgcttgaacctgggaggtggaggttgcaatgagccgggatcacaccactgcactccagcctgggcgacagagcgagacgttgtctcaaaaaaaaaaaaaaaaaaaaaaaaaaaaacccataaacaattaagttgatttataataggaaaaaaactaaaatatacttccgaagggccattaaaaacctaaaagggctatgaaagtgtgttcatctcacccagtttttgcagttacacgtgtgttatggtcttgtgctaatgaccgtgtgtttatttttctaacagatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaagtaagtcataccgactttcaagttttactccactgctttattagcaatttagaagcaaggtagtagtcgttctattgaataacatttaccaagatctgaaaaattatgcagctatgccaattttgatgctttatgaaatacagctcatagctcatccaaatctttctgttctttccaggtaaagaccttgtccaaaaacgttacctattatttatgctcttgtcacgaatttttgctcaacaagtaaatatttatatttttttcttaagatgaatttttttttttttttgagacaagagtctcgctctgtcgcccaggctagagtgcagtggtgcgatcttggctcactgcaacctccgtctcctgggttcaagcgattctcctgcttcagcctcctgagtagctgggactacaggtgcatgccaccactcctggctaattttttgtattgttaatagagatggggtttcaaggtgttagccaggatggtgtcgatctcctgacctcgtgatccacctgccttggcctcccaaagtgctaggattacaggcgtgagccacggcacccagcctcttaagatgatttttgacaactcctaggaaaactattttttagaaaccctgtcatctttaaatttttccatagttccttttttatagggtacacttttgcttaaaaagtaatatttttaagatgaaggcaacttaagacactggttactgaatttaacttcatagccagtataagtccctgattagtaaatttttttttgccttaatcttgctcttaatttgattgatttttgctttgtggagtctttaataatgaagcggttctttagcaaaaaggggctgcctgcctgcagtaggggcagcttaacaaagaggagggagtgtgggcactggagccggtcggaatcctgccacccaccggctgggtgacctgggacctgcactgtctcagcggccatcttctcccccatgaagtgagggtcctgcttaagtgaggatgagatgagatgatgtatttaaaatgtgtagcacaacagtgcctgtgtctggagcatggagggctctgtcagcattagttccttcctgtgtgtcttcgctccctccttgtgcacacagcactggattaatgctcctggttgtgctccttttattcctggattagttatcgcaacatagagtttgatcattacaagaagctagatttgctgtccaaatctgttgctgtgtttttgcccataactccataattaaggaagtattagggggaagatacacagctatgccatattttacacacacacacacacacacacacacacacacacactctttctctctctctctctctctctctctctcctggcttttgttgaaacatttagttttggggaaatgtgattgaatactacagaagtgactgttttatcaaaaaaaaaaacatgttgaagttaaattttattttagtaggaccttcattctgatctttgtaggttgatcccaaaatgaaacacattacaaattaaggaatccatacatgtcttgatgtcttgactctgaagatggggattagtgaattttagtgtcttcagttttcaggactgttagacttgtgggtactaatgtagcctttccccctgggatgaatacagtttttatttggttctttattaaaataaataaaatttgattgtcagaaatgtgtgtgacatctggaacagtagttgttacctcagaatgtaaggaagcaaatgattaaaataggctaaaacagttttcttcaaatttgggtattgtatagaaaacaattattccagtggtttcttttctctctctctcttttttttttttttttttttatgagacagagtctcattctgatccaaactggagtgtgatcacacctcactgcagccttgacctcctgggctcaggtgatcctcctgcctcagcctttctagtagctgggaccacaggtgcacacgcataccaccacgcctggctgatttttaagttttctgtaaagatgggattttgccgtgttgccaaggcttgtcttgaattcttgggctcaagcagtcctctcaaagtgctgggattgcaggtgcgagccactgcacccagccccagtattttcttttcttttcttttttcttctttttttcttttctcttttctttgtttcttttcttttttcttttctctcttcccctcacctcccttcctctttctttcttttctttctttccatctttcttccttccttttccttccttccttccttccctccttccttccttttctcttttcttctttcctttcctccctccctctctccctccctccctccttccctccttcccttccttccttccttctttcttttcttttctttttttctacccccgcccccccctcagtctcgctgtgtcgcccaggctggagtgcagtggcacgatctcagctcactgcaagctccacctcccgagttcaagccattctcctgcctcagcctcctgagtagctgggactacaggcgcccaccaccacgcctggctaattttttgtatttttagtagagatggggtttcaccgtgttagccaggatggtctcgaactcctgacctcgtgatccgcccaccttggcctcccaaagtgctgggattacaggcgtgagccaccgcgcctggcccctccctccctccctccctccctccctcccttccttccttccttccttccttccttccttccttccttccttccttccttccttcctaagtgcaagcctaaaaataggtactgtattttaaattataaaaatgaaacaaatttgtagaagaagtggttaacaaaactccaaagccagtgaaagataagttaatcgcatggattcagtgtgagggctggtctggctgcctggagccctcacccgcagcctgactgtggcaatgacggctgctgcaccagctctgttgggcccagtaggcctgtactgcagtgttcccggagataaccctccctcacccccttttccaattaaaactaaggtaaaagctttcatcctgtggctgtttggcctacatttgacccaaaggtttcttttggcattaaatccatctctattctgtttacataagtccaaaatgactaaatagtcccagctcaggcagtgaaattccccagcagtatttgtttaacaggtggttatacaaataacataaatgtatgcaaatgatttgcattacttttttaaatgatcagtgttaaaataacctctcacccgtttttcttagagaacatatggatgtatgaaaaaatacccagcatcccagttcaaaaagcatggcacacgattgttgtttaatttactgcatttactctgtgctgggtactgttgtaagcactttgtttcttgttttccagtgtgtgggcaggcatagtaccctgctgtttaaaaggaaactctgagtaccccttaatcttttctggataatttgagatcattttgactgtccattactatatctttttttttttttttttttgagatggagtctcgctctgtcacccaggctggagtgcagtggcgcgatctctgctcactgcaacctccgcctcccgggttctcgccattcttctgcctcagcctcctgagtacctgggactacaggcgcccaccatcacgcctggctaatttttttgtatttttagtagagccggggtttcaccatgttagccaggatggttttgatttcctgacctcgtgatccacccacctcggcttcccaaagtgctgggattacaggcataagccaccgcgcccagcctttttttttttttcctttttttgagatggagtctcgctctgttgccaggctgtagtgcagtggcgcaatcttggctcactgcaacctccaactccctggttcaagcgattctcctgcctcagcctcctgagtagctggaattacaggcacgcgccaccatgtccagctaatttttgtatttttagtagagatgaggtttctccatgttggccaggagggtctcgatctctttaccttgtgatccgcctgcctcagcctcccagattgctgggattataggtgtgagccaccatgcctggcctatatcttatggtaatgaagttttgtgtctgcttctattttttccttgactgctgattaacagcagtttcttttgctgtgccttccttttatttgcaatttctaaatgtatgtaagtggagaaatgagaacttcaaaataagaattgtataagagacaagagtttttgaacatgttcctgagaagtaaaacacgcaaaattagaatagcagcatgagagaggagtatggagtcagaggaagctgaatttgaactttagccctagaatctgtttaacaccaagcagattatctagtctgctaagtcctggtgtcccatctgtgaaatggcagcagtgtcatctacctcactgtggctgtggggattaggtgtatgacgcggagggtggtgctttgcccctagttggattcagttgatggtaatgtaggaggtttatggcagcaatttcaaagcttggagtcttttatttatttgttgtgacacctgtttgaagtattctggagagtttgttgctgtaaatttgacctgagtatgggtatttggttttagctttttattcttttctctttctccttcctttcccgctccccctctcctcctctctctcttccttcttctccttcccgtactggctttgttgtggtgtagtcaccctgctactcatccgatcttgcatttaggattaggtccagacttccaggtttggctttcaaagccctgcacaactctaaagcaccctctctggccactcccacacccctgggagtccagctacactggggttctcactgtttcctagcacacggtgcccagtagacccctgcctttgtgcagagtggtctctccatcttgaatgctgcccctcctctctgcctggtagccggtctccctggggattttccattttcattggagagtttgctccatcctcagattctgctcctaaaagacatgtctgtgaggtttgtcgtatttggactttaaaaaaaaaatcagctgcagtttgtaatggattttatcctacaaaaaagctggaagaacatggagagaacgcatgcatctttgcatctttttcccccagattcctcggttgttagcgttgcagtcattggtctgtctccctccctgctttgtatttaggaggaaagggggaccatgatgtaaatgctttggtgtgttctgctctcttccacaaaaggaacttgtgtaagtaacctccgtgcagccccccagtcaggaagtcattgttgattacaataccatccaattcattgacttcatccagattcctcccagttgttatgcgtgtctttctcctctctggtccgagatcttatctgggtgtacattttggatttacttgtgctgccttatcagtgtccttccgtctgaagcagttgctcagtgtcccctgttctcatgtctttggccgtccaaaaggggacccaggcctctcctgtggctgaccctcacttggtctgtcactgcactgtcattgctggactcaggcatgtgctcttggtggcaatgcctgggccgtgatgccatgcttttctcaaaggatcactctgggggcaagggcgacatccacctgtcttacaaggtagtggtgatgccacccttcatcatcgaggcgaggcagtttctccattataaagtcaccattttcccttttatatctgttagtattttgtggggagggattctaatattacaccaacaacctgctcagcctcctcagaatgatagctacgtaaatagatggtctcctgttttacacttcctgttgttaagacagcacgtccaaacaacagaatccctccccaaaggaatgtagcatgaacaaaatgagctgtggcatagctgtgaaatagtgatttctcaaaatgtgaaaattgagttctcagcaatttcttagcctagctagtaaatctcagttcttttcttgaggctatccttatttatttatttatttttttttttttttgagacggagtctccctctgtcaccaggctagagtgcagcagcgtggtctcagctcactgtaacctctgcctcctgggttcaagcgattcccctgcctcagcctgccaagtagctgggactacaggtgcacgccaccatgccctgctaattcttttttgtattttagtagagacggggtttgaccatgttggccaggttggtctcaatctcctgaccttgtgatccgcctgcctcggcctcccaaaattctgggattacagatgtgagccactgcgcccggccaagtctatcctttttaaaacaattgtcctatgccaattacagaaaaaacaggaagtagagacaaacaaagcaataaaaatacatatactatcatccagcagagatgctgacaatcctatgccttctctttcttttctatgccctttaaaaaatgtgatcataccatacattctatcttgttatcttctgttttaatttgcatgaaaatctttccatgccattggtataggtctgtgacatcattttaaaaaatcttcatatagtttttttttttttttttttgagacacagtcttgctctgttgcccaggctggcgtacagtggcgtgatctcagctcactgcaacctctgcctcctgggcccaagcgattcttgtgcctcagccacctgtagctcccacacccagctaattttttgtatttttagtagagatagggtttcgccctgttgcccaagctagtctcaaacccctgagctcaggcaatccacctgcctcagcttcccaaagtgctgggattacaggcatgagccaccatgctggcctagttttctatttaaccacttatttatactcttggacatttgggccgttcacaacactaagcagtttcaaacagggaggaagtgaacatctttgtcacacctgctacggttaatgatgacaaatgattagtatacaacattgtgctgcattgtacggccccgaaaaccttgtctgcttctcaacaccccctcccccaagggtacttgtgctctgcagtaaagtaactaacatctcaagaccttgtaaaaacaggccaatccagttaaacttataaatcttacggggaaaaagagaaaaaagttacatctgtaactttggacagagaattgcacagtgaggtttgaagctacatgggaagtcctctctcagggccctgagagagggaaggcaggtggttttaggaggcattccgttcttcaactttgccgtaggaatgccaggtaaaacctcaacttctctcttttcatttctgaccctcacatccagtcagcttttctctgaccttttcctaagcggctccttagaattctttgtgcccattctcacagttctccagaggaaatacagatgcccataggccctctcctatgtgccagggtgacccagagcagtgactaaaaaatggtgacctgctgccatcagagctgttctcaaatgaccgaacacacatccattggaggcagaggccggcagcagggtagacgcagccctttaccctctcaagacatctcgtgccctcgtttcagtagagagtgtggatgggcaggagggattatgttcagaaggttcaggtctgctgaattcatttgaggaggctgcttgttagtaacatattagtcatggaaatagtttgtaggagacaagtgaatattttaagtcatttaaagcgtaagaaacattcaagcattgttgaaataacagtggtatcgattttattttctgtttcttgattttactgtatatttgtttactggtgtagggcttcctgtgttaagaacaggtatagaaatattgacattcaaatgtaaaattgctactgactctaaatgaaaactttggagttgagtaggcctatttagtttattaatcagattaacattcttttccaagttagggtatcatcattgccttgtctgatcttaaaaaaaaaaatctttaaaaaaaaaggatgcttttgctctgtgttaaagtaacatgaagactttgtacaaacatgtgccagttatagatttgtgaatagtaaaatggtcattaatttagatttctaagtaaatgtagctgaatgcatctttactgaaaatgttaaggttgatctatggttgagtaatgccagttgtcttcaaaagtttgtttcagagctaatcgttgttctatttattgtgtttgtgtgttctcaatgtgcctctgcctcccaagttcttcagctataaagtagcagatcctttgacttaaagaggctgactgacatgatctcgctgcactcttctattttagaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaaggtgtgtgtgcatctatcctctactttaaatgaattgcagatccattcattggtcataaatcaaggctgagctgcaggtgactctaaagcatgcctcactgtcgagggaagggatggatgctggtcgttgtcagtgagcaacttacatgctgtcatcatgtgttcacttgactgtggtgcttttcattcaggagtcctgatctgcctactaaagattagtgaaaaggaaccaatgtctgccctgattttaaaagagtaaaaaagtactaagttttttgttttttgttttttttaatatgtgaaaatgatgactgtgaagttttcctttcctttccttttttttttttttttctttttgagacagagtctccctctgtctcccaggctagaatgcagtggcacgatctcagctcactgcaacctccgcctcccaggttcaagtgattctcctgcctcagcctcccgagtagctgggattacaggcgtgtaccaccacacccggctaatttttatatttttagtttcaccatgttggccaggctgatcttgaactcctgacctcaggtgatccgcctgccttgtcctcccaaagtgctgggattataggcatgagccaccgcgcctggccgaagtttttcttttcttgagaattctgtaagacttagaaacagacaagggctctgaggaattatgctaattcacacaaatattggtatatttagaaaaatgaaggttttttcccttgaaattatttaagcagttaggtttgcattgtaattaatgcccctaaaccttttagtttcttttttttttttctgtaaagattgcattgtaaatggactgttaaatatctaggatatagtatggtacctggcacctggtggtgttcagttaatgaaatgaataaatatccagtgtggactgttttactctccaacccccaaaaggggcacagaaatctatttatagccttttaagcttactaaggccagtgcttagttctagctgcttaactgtccactgtaatatgttaagcatttttttttccttgtgtgattaggagataatatccattggctttcagagattaaaatgacttactttttaaacagagaaacaagagaccccatattatcaggaactcaatctctttcttttagttttgctcttttaaaaatacattatacaggctgggcacggtggcttacacctgtaatcccagcactttgggaggccaaggtaggcggatcacttgagaccaacatggtgaaaccccgtctctactaaaaatacaaaaatcagctgggcgtggtggtacatgcctgtaatcctagctacttgggaggctgaggcaggagaatcacttgaactcaggaggcagagatctcagtgagctgagattgtgccactgcactccagcctgggcgacagagcaagactccgtctcagaaacaaacaaacaaaaagttacacaaaaaaggtcagtttaaagcgcaaagtccctgaattattctagtctcatgtcagctaagtgcctggattatgaatccttgacatttcctgtattaaacatgtgtgagttcatatagagtaattgcttaatgcaaatgaacatcttggagattctctccttccaggcaaggtaaagatagtggtggtgatggcattacttgggtgaataaaagcatgggagatgcatttcatcattctcatttgaagtacagtaaaaccctcttaagatactttaactattttagctaaaattacataattattttgacaataaatatctatttaatgaaacaccaggaagaatttaaaactgctaataaaaatttagggatgttggaattaaaccaaaatattttaacatactacatgtgtgccaacaacaaagaaaagaacagttgcttcttaagaggcttttaaggtatttggtttctagaactcatctttgcatctggaagtcgggtcatcgactttgtggttagggtcttccttgtgttaatagtgaatttggaggaatacaaggttccaagaaatagaaactgaagaggggtggtaaaatcctgtggccacaaggaggaaagaattgttattcatcttaacctatgcaagactacatgatacgaaaacagtgggaataatcacttatgttctcatttcatgtatgttctatgcgtttaaaaatattatcctgcatttatatgtttggggttgggtaagcatagttttaggggcatactgttttttttttaatttttaagataatctatttagctcttgttatttatttacattgcctgtgctatgcagtttttcatgaggaaggaagaggaagtggaacaggcacaagttttctccacatacatattcacttaaagatgggctcttatttgcccagtttaatccaatttgtgtcattttcttctcctaccaaaatataaacttgtaggacctccatgttgacatttatatttaaacttttgagttacagacactcattcaaattaattattgttataggagctaaggaaaaatcaatttgaaaagaaataagttgtttctttatttaaaaatgacagtatgaatgaatgaatgaggcatgtcttgccatgttgcccaggctgaacctctggtctcaagtggttttctcaccttgaccttccagagcgctgaaattataggtgtgagccaccattcccagctgacatttgcttttcagagtcttttttttttttcttttgagataaggtctcactctgttgccccggttggagtacagtggcatatcagggctcaaggcagcctccatgtcctgggctcaggtgatcctccaacctcagccccccgaatagctgagactacaggcatgcgccaccacgcctggccgatttttgtattttgtattttttgtagagacagggtttcactagttgtccaggttggtcttgaactcctgggctcaagtgattctcctgccttggccttctgaagtgctgggatttacaggcctgagccactgcacctggacttagtagtcttaattttacttgcagtgtaacttgttgcttcttttctgtaatttctgtagcactttaaggttatcttacagaagaatattttaatattttatcctttcttcagcttatcagttagtaaaaatgcatttgcctagaaacttatgaaaagttgctagagggttttaggttttgttttctttaggttttaaatagttaaaaatggaaaaacttagcttctcttttgacaaagagcaatgaaacacagaagccttctgccctgagtggtgggcatgaagcaaggcatagtttttggctatcaagaaatcatgtcttgctccagattttctctttgcaaagaacatggttagacaatcacctcagccctcgccctgttgtttttttttttttttttttttgagatggagttttgctccgtcgcccaagctggagtgcagtggggagatctctgctcactgcaagctccgcctcccgggttcatgccattctcctgcctctgcctcccaagtagatgggactacaggcacctgccaccatgcacggctaattttttgtatttttagtagagacggggtttcaccgtgttagccaggttggtctcgatctcctgacctcgtgatccacctgcctcggcctcccaaagtgctgggattacaggcgtgagccactgcgcgtggcccacctcagcccccttttatgggccactttcactgttgcctgtttgggtagaccttgtgacttcagctggtgagaaaatgatagaacccctgtttccctctggtgaaaaatgatgttgaggaaggttagctagttcttggcactgtttagagaagaccttgccttgagaaaatgtgatggagagtgtcctgaaggaatggcttctttcttaaacatccaagaaggaatgtggagctgaggtctatcagtgtgagtctctgtgacccaggggaactcggatgtgtgaaagcctcttaggaaagatttttaatgttgtctttctgtagattcaggaattcatggtttaactgcaagcctgactgctagtaagaagagacggccctattcaaaaataaattgtatattgtatacagaggcaaagattttattttttgctctcctccaccctctttttttgtttttgtttttattttttgagacagggtcttgctctgttgcccaggctagagtgcagtggtgtgattgtagctcactgtaaccttgaactcctgggctcaagcaatcttcttacctcagccttctaagtaactgggacttcaggcatgcaccactatgcccgagtaatttattaatctttttgtagagatggggtctctctgtgttgcccagactggtctcaaactccaggcttcaagtgatcctcctgccttggcctcctgaagtgttggaattataggcgtgagccactgcatacaccccaccccgctgtttttattccatgcttttacaatacaaaacaaaaaccaaagtgagctggtctttagaatcaaattgcactaattttgcccttttcaaatttgaaatccagtgagtttaagttgaagatggctgttgtggccattatgttaatgatgatagttagctaagcaatttaaaaagacatgagtatctaatgtgtgtagttctcaagcctggctgccatcagtaagaaaggatgggtcgggataggatgtaaggagatgaaaattcctgacaaaacccagcaaaaacccagactgttactagtattccaagaatgtgaaaggcatgaagagaaaaaggcttgctatttactaacgtattgatcttagatgtttgctcaagtcagtttgttctagttgaattcctaataatgtattagcctatttaaacatttccaggctgatgggaaaggagagagttgttccgaaatggtttgttgtagagaggcctccctctgggatgttacaggaagataaagtaccaggattaatttgtgttcaatacagaggtctttctttaaagaattttaaaatggtacaaatatataggcctttaaaaagcatttggaaagagaaatgcataacgtatagcagacttttatctcttttgaaatgtatatttagcttaggtttttttctttatatattaaatatttctgaatgaatataaactggtgttgaaatgtgtaccacatgttaagatagcatacttgtgctttcttttagtgttgtgatttgtgatagatatttcttttctttttataatgtagtctatgcatggaacattgaaaagtattgaagggcctccaaacttgggtataaacttgcctttgagcattaagcctgcaactcaaaattcagcaaatcagaacaaagaggacaccaaatccatgaatgggaaagagaaattggaaaagaaatctccatctcctgtgaaaaaatcaatggaaaccaagaaagtggccagtcctgggtggacgtgttgggagtgtgactgcctgttcatgcagagagatgtgtacatatcccacgtgaggaaggagcacgggaaggtcagtaaagaatgaaagctgctctgggtgagtgcaagagagggcactggactggcaagcttccaagatgtgggctcttggcttggctctatcagtaattagtgctgtgaccttaaaaatcacttggtgtctctctgcctcacttctttatctgtgaaatagaccttttcaaatccttcagtcttcagttttcctggtcattgccttcacatgcactcctccagactggtgtgcatgaatgtggtaagttacctatcacattcatatttatagcttaggaaagagaaaaatagtaaaccaaggttaaagacatttgaatttacctctatccttgtgccagctaaggaagaaaggagcagagaaagacagtggaaatgttgaacattgccagtagcatttgtgtgacttacatgattcttccttgagtttggtagtgggaagaggaaccacatcctttaacttccagtagaagctctgtaactccaagtcactgaaaaatctgagtcacatatgtatatcctttctcttttaaatagtaagtatatgtctccaactgataaggaatttaaaaaatacttattagacctaataatattagcaaaattatttttcagtattatctaatactgtattaaatacaatattaggctgtattcacatttcctgattgtctcaaagttggtttgttatggtcaggacccaaaaagtccatatattacatttggttgttgtgtaattctttattttacgtagtcctcctttcattttattttttaatgtatggttgatttcttagaaaaattggattgtttgtcctatatataggttgtccctcactttactagatttaggtaattgatacttttttttttttaacttgttgacactaggaaccaacatggaatttgctactttttttttttttttttttgagaaagagtctcactctgttgtccaggctgaaatgcagtggcatgatctcggcttgctgcaatctctacctcctgggttcaagcaattctcatgcgtcagtctcccaagtagctgggattacagatgtgcaccaccacgctcagctaatttttaaatatttttagtaaagatgggattttaccaggttggccaggctggtctcgaactcctggcctcaggcagtccacccactttggcctcccaaagtgctggattacaggcgtgagccactgtgcccagctggaatttgatactttttgacaccgtttaacttgttcctctttatctcatattcctggaatattgattagatttgaattttttaggtaagccttgtcagctgggcatggtggctcatgcctataatcccagcacattgggaggcggaggcaggaggattacttgagcccaggagttccagggtgcagtgaaccatgatcatgccactgcactctaccctgggcgatagagcgaggccctgtctcagaactaaaaaacaacaaaagaatatgtcataggtgctgtattctttttgtatttcatcatgaggaacataataccagctaccagcttgtctcatttgtaatcctaatactgagattgattagtgggttcaaatacgtgacgttttcaaagaaagtcatcttactgctttaacttaagccaatagaacaaaatagtcatccgtagtgagactatatagagagtacatagaaattgttttgtaattagtatacactacatctttgagcagtttgctctattaaatgtgctaagaactattctgtaatctcatttatttgtactatttgtttgagctgctcatgaaactgacatgttttactttgtgattatcccaaatggcctgtgaacatggctggatcacaatattcacaaattgcaaaaagatgtttttattgtatttggtctcactacagtgtgtcttgatataaaaagtagttacttacagaatatatttggctttagtggcacattgcttatttaatcatcttagtctcaggctttcctactagcattgtacagtgttcattgtaaatactgggtagtttttaaggagcaatacttcaataatctacggtataagtacactgccagggtgctgtcagagtctgatgtggtggttctagggagtcttcacttggcacccctaccagattgcataagagtcaaacaggagctggccttcgtcatcatccggtagtccagtcctttcatttcgtgagatttctgtaactatcttgtaacatatcagaactcttttccttttttaaaaaactatctttatcttacatttgagataatgattagatctaggatatgagaggaggagatggtttcaaaaaggttggtgggatgaaatgtaccactgattgaaagcctttgctctggacctgcagcagagagcccactctgaattggatgtgtgtgcacgcatgtgcccttggttttgatggagatgttcatcagaatggaaatgtctggcttagcataattttaggattggctttgaaggagttgaggccctgcctttggaatgaggcacatcgtattagattgtagtttcaatcctgttccctcagcctcctgagagaatgaaggagatgagtgggtgaggagaggggaggagcatcttcataagctagtgaaatgaatggtgttgagtgtgagagttccaccatgccaagtctcactggagcacccacttccaaacacccctctacaagcatcttatatctatctccattcatttctcctttcctagaatacttaagtcacccaaacttcaaagcccctgtgctgtcttttctccgtcttccttcagacaaccaggcgagcaccttgctgtctatatctttccttcccatttaccctgggcttgccaccttatcactgaacccagttctctggtgacccctttgttgttaagtcgttggatgtgttcctgtctttacctccactcaccccacagcggtgtttcacatgattagcagttctttctaaaagcattttctacccttattgtggaataccactctctcctgggttctctcaccattaccggaacacccatcaggtttctgtcctagaaacatttaactttctcttgggaaaattcaaccactcttataactttgcttctcgtgtacagtatatatacagatagcacccaaatctgtgtctccagttagttgaaaagtatttcttgaattaatagaccaagaatgagttctgatttggaagacatctaactcctcttagacttaacctcctcttctttaaaatgggtacatatttagtgatcttccagtgtcctgtgttgtaaatacctagagaactgtatatgaagtgataagtattctctaattcctatgggtttaagatgagatatcaatatgaaatacgctatacacatataagggttcaaaaattgtatttggctaaaggtctcaggagagaatacagtttaacttccaccagcccagaagtcattggaaagatccaaatttattggattacccaatgaaatattatgcattaggataaatatgtcagcgttctgaaccagtgaactttgtatacttgattttagtatcataattatgacttaaaatacatatatatatatatatatatatatatatagaaataaaataacttggggaataatctaaacgtattctgccaaccacagtacagtcattaccttagtgttactgcttctagtatgattattattttgataagatttggagtaaatatttcaggttaggagtaaatttaactggcataagttaaaaatttatgtcaaaacattagaattcactgctactcattttagatggccattttggtttcattaattgtttttgacctttcttccccttctcagttcccatccagaagaactttactaaaaagaaatattctgtatacagttcaatttattgagtaaagatattcagtagctttgtttttaagattcagaactggccgggcatggtggctcatgcctgtaatcccagcactttgggaggccaatgcaggtggatcacttgaggtcaggagttcgagaccccccctggccaacatgacgaaaccccatctctactaaaagtacaaaaatgagctgggcatagtggcaggtgccttgtaatcccagctatttgggaggctgaggcacgagaattgcttaaatccaggaggcggaggttgcagtgagccaagattgtgccactgcattccagcctaggcaacagagcaagacaatgtgtcaaaaaaaaaaaaaaaaaatacaaaaacctaattctggctctgctagttattcagtagcttttctgtgtctctgatgctctttttaaaaaatgaattgtcagtatctactttcagtggtttttaacttttttccagttatttgtcgtaatctgatatcaagtcaaatactttaaaaaaatattgacagatattcagtgcatatttattaaaggcgtaatcatcttaaaacctacaatttgctgaattactgctttagctatttaaaaaagaaaaacagttaaagcagcagcattttaagaagttcttgttacaaattctatatacagaaagcagtaaaaaacttaccaatttctctttttaaagttttttctcaaatgcttatgtattatctaatttttattgtgctttctaaagttggtattattgttttgttatggccaaattttagctgtccttgtaaatggtaaagtctttgagggcaagttgtatgtccattttattattacagtcttctatggtttacagcattgtgccttgcagagtatctctggagtccctgattgaagcagttctctttggattgttacttgcacatatgggaaggggctttgtgttagtcacagatacacacaagttgcagtctaggttcaggtacctaactagctttctaaccacagaaatcccaccacctttgtagtctctatattctcaactataaaatcaggaggacgggcgtgtcagtgtcacattaacctgatgatctcatcccagccgtgagcctttcctcagatccatgtacaaatgcacagagttttacatacaattttaggtgggttgtggatctcctgctcttcttttttgttgttctagaaggccttttaggaaccaaactaagatcctttgaatgagataatatctgaggtcattcttagagatcaaacattctgtaattatgtgagccagtattaaaattaaaaagaagttacatgttatatgtacctgttcaaatctagaaaattacaacacaatctgtgataattgtaatcattctctcatttgctgcctggttctcctacacatcaaggaaccttaacttattaattgaaatatcctaaagcagaggcatatgtgctgaattacggaactctggtgccatcaaaatgaaccttagatcttttcagttttttgttttttgtttttttttgtttttttttggtttttttttttgacaaggtctcactctgttgcccaagctaaagtgcagtagggtaatcttggctcactgcaacctccgcctcccaggcttaagcagtcctcccgagtagctaggactacaggtgtgtaccaccacacccagctaatttttgtgtttttatagagacggtgtttcactgtgtcacccagttgaactcctgggctcaagtgacctgtctacctcggcctcccaaagtgctgggattataggcatgagccagtgcactcggcctcaagattcttcatgatgtagatagatgtggtccagtactgtgtctgtaacttgggaagagcctgggagacttgggtatatattctggcaccacaactaccagtgtgactttgtgaaaaaataattaacaaccaccatcttccagcgtcagcttcagtttgcataggtctaaaatggaaatatttaccacctaagagtctttttaaattaaataaaatgaaagcatgtagcacaatacataatagatgtttttctctctatactgtatttcctctctgaacactatagatttttttaaaattaaattttgctagaaagcagctcaccaaaatggaaggttctgcatacagagacgttatacatttaccacttctaagtagatttttcttctttttttatttttttgagatagggtctcactctgtcacccaaactggagtgcagtggcacgatcttggctcactgcaacctccacctcccaggttcaagcgattctcctgcctcagcctcctaagtagctgggattacaggtgcgtgccaccacgcccagctaatttttgtatctttagtagagacagggtttcaccctgttgcccaggctggtcttgaactcctgacctcaagtgggattacaggcatgagccactgcgcctggcctgcttgactaatttaaaaaaattttttggtagagatgccttctgatgcccaggctggtcttgaattcctgagctcaagtgatcgtctcatcttggccttccaaagtgtcgggattacaggtgtgagccattgtactgggccaattttccatctttacatggggtgaaaggagattgcaaatatatgcatgtcatggagaatgagctgtggccagataccctgcttgtgtgaaaggagaaggttggatagattcggaagatttcagataaagtctatctgaccttacttgagcacagccatttcagagaacagatggtgaagtagctggttcctgcctgagcactgggcaaaagaactaggcgaagactaagaacatgtgattgcagatcaatctccttttctttacagagggaccagttggtaggtagaataaccctctagacagaaactgggtttcagcaaaactgttgacagattctgtctgttttgatactgttctgtacagtgtagtgcaggagggcctgggtgaaatattgcatggatagctgactcatggctcactgccttgttggagagaaagcttccatcttggatcagattttcctcagtctttctatcaatgacttaattataggaagagaagctaggagggattttgcaaggcagatcttaaatgcagagcttttcacttaaaaaaaaaataaaagtacacagatattatgtgaggtagatatggcttagctaagttctatgaaaaagtattctgtctttatttgactatcttgctataacccatccttctttgtggctgctgatgtagcattcatatcaaggaaagctaacacccttcctttgacttggcaccataatctagctggcggttcccaagattggagtgtgcgtcagaattaactggaaggcttgttcagctagttgctggcctctaccccacagcttctgattcagcaggtctgggatggaacccgatcatttgcatttctcacaagccctagctgatgctgatgctgatgctgctcatcttgggaccatgctttgcgaactactggcttagtctgagtggcagtacaatcccccaaagcccattgatttatccaataaaagttcatttcttgcacatacagagtttgctatgcagagtttgcatttctccggggcagtcatcccttccactggtaactcagtgatcaaggctgtttctttcagccccattgtctcaacgtaggtgttactgaaaaaaagactggcgagtcctgcctggtctttacacgctcgttattctggatatgatgcacaacacgagtcattgcccagaatgaattatgtgagcagccccaagtatattcccgcgtgtaccgcaaaggggagggaatgacaagtagtatttgtcacctgcagtaaggtggccacagtgaatctaaacagggaaaggttccattgcatcgatttaagatggatgctgacaactagcagaggagggtaagcagaatgctgagtctagaaacagtggcaggaggaagagagaagttggggttaaggggagctttgatagctgtcttcagatagatgtcctccatgtgaggaccagcatgtgataattccagaccagctggggccatgcatgagtgaaatgtctgcctatctgttgctggaagtattcaggtagtggccagatgctcatctgtaaaataatggaatagaagggattctagggtcggctgggcatggtgggtcatgcctgtaatcccagcacttttgggagtccgaggtggatgtatcatttgaggtcaggagtttgagaccagcctggccaatatggtgaaaccccacctctaccaaaaatacaaaaattagctgggcatggtggcgggcatctgtagtcccagctactcaggaggctgaggcaggagaattgtttaaacccgggaggtgaaggttgcggtgagccgagattacgccactgcgctccagcctggatgacagagcgagactctgtctaaaaaaaaaaaaaatggattctagggccaatgtgacctttctcctcggacactggaatgaaaggaaactaccagtggtaatctatgtagtagccattgctagtgtgaggtggatattttaaaccagtcacagtctaaaagtcattccatggactaaccaagtctctgtggaaagcatttggtttcacagttaatctaatttgtggatcgaaacagaacttctaggaagaagtccttgtcagcaggaaggctacagggggagcagtgagtctgacttggtagctgcacacgagaatcacccggagagcctacggcccagcacacttggtgctcaccagaccagctaattggcatcactaggggtgggacctggccctggcattctttttttttttttgagatggagtctttctctgtcgcccaggctggagtacagtgacgccatctcgactcactgcaagctcccaccctgggttcaagcgattctcctgcctcagcctcctgaatagctgggactacaggcgcccaccaccacgcccggctaattttttgtatttttagtagagacggggtttcaccatgttagccaggatggtctcgatcttctgacctcgtgatctgcccgcctcggcctcccaaagtgctgggattacaggcgtgagccaccgcacccagccggccctggcattcttaaagcttccaggtgattccagtgttgtggcagggctgggaacactcataccacctgggatctgccgcacacctgcccttgctgctgatgctcattgctgtggccctcactgtgtgactgctatagcaccaacacacctttgttgagtttatgttttggggaaggttgatctcaagtgtatttgtttaaagactccacccaacgttcactcttggtggtgaaggcaggggacacaactctctggatgttggatttacagcattagtaagtctgttcaatataatttaaagcctgattataaatgattttaggatgtcttaatgtttctgttcctaaagcctttaagaaaagtccatagatttcatctgcattttccatacagggtgcaggtgataggtgatttgaatacttgctattttgtagcctttcccattctgaaattcactttcagttcactcagagatgtaggtgaaagacagcagtggcagtgaaggaaagtgggagaatgaaaggatcagagtgtggagagatgaccacagccactgaggcaggtgtgctgttgttacttttgaaaagaatggcaaggcaatcagcttgcatttcctagtttgggaccaccatgcttagaatcagattgactgaggagctttacagagactctcacttgcacagtatttaaaagaaaaaaatgtgtgtgtgtgtgtgtgtgtgtgtgtgtgtgtgtgtgtgtgtatgtatataaatttttaaagtgcccacttggccgggtgcagtggctcacgcctgtaatcctaacactttcagaggctgaggcaggaggattgctagagcccagagcttgaggctgcagtgagccgcagtcgtgtcactgcactccagtgtgggcaacagagtgagaccctgtctcaaaaaaaaaaaaaaaaaaaaatttaaaaggtgctcacccacacaacctggaacctagccatgtgtatgaaatgtgtggtagggcataattgccccccttaatctccctgaaacttgtttagataactttgtgaaataaaacgttacatctccatgttgtttctgtcttcgtgctgtactgtggtgatggccattagttaaggggataaaaatactgaaatactgtctagtttgcatagttcattgccagatggtttcattttcattcttttactgttagagttcatcctgttgtcattaggcatgccttactacaaagtctcttatttaatctaaatgtagggatataatagatttttatccttttaaaactcatcttttagctatggcgactttgacttcctgccaaaatcctgttaccctagcaacaggtaaaaaattttttaaaaaaccagtttctcctatcttttttggcttagaacttatttgtgatctcaaggttttaggagaaatatctttaaatcagttgcatgttctcttctatctctggttgactgttagagagtgatggcttctcacttgattctgcatttgtgtcagatgtgattaaaaggcacattaagagtttgtatattcatgctagaaatgtatatcactgctggctttatgaaacttatttttcattagttttggccactggaattgatattttgtttgtgtgtgtgtgtgtgtgtgtgtgtgtgtgtgtgtgtgtgtgtgtatacacagtttttctttttttttttagacagagtctcgctctgtcgctcaggctggagtgcagtggcgtgatcatagctcagtgctacctcacactcttggtcacgagcaatctgccagcctcagcctcctgagtagcagggactacaggtgaacaccaccatgcctggctaatttttattgattttcatttttttgtagggagttcggggtagagggagttgtctttgttgcccaggcttgtctcaaactcctggcctcaagtgatcctccagccttggcctcccaaagtgccaggattacagatgtgcgccatcacacctggcctataattttattatattctaaatatttttacttcatatatttcttatatatttatatactatagatcatatataatacatatttcttatactatataaatctataatttttaatactaacttttattataatttatattttattagtttatttgatattttattagtatggtttactatatgtagttttctgaagtcctccacttgatttaataagaactttttttaatgtaaggctataaatgtgttgtaaaaaggatgttgaaaatttttggttcagagcatattaaagtacatattgaactattggtgattttggtagcttgtggctaaattggaaggcggggtgttaaggatactggggctaacactgtctgagggcttaccctacttactatctcattgcagcaggctcctgaggggagacagttacgaatcccacttttaggtgaggaaatgaagcctgagaaaggttcaataacttaccccagggttttgcagcctgccagaggcaggtttctagcccagactctgcagtttgcacagaatgaaagctgacatttcaaaagctgcttaattttagtctccttgaatctttcaatatagatgtgggacagttagcagatatgtctttccatccagtttttacttctgcttttgatgtagtcattttcatttcatttaggtgttcaatcttggttaaagttggttatgccatcattaactggacgtgtgtgtagttttggaagactgtgaatgtcctggttttatattccttagctggggtctgatgctttctggaattacttgcagttgctgttaacagcatcatggtgtcgttaattaattgggcaaatcttcctgcagaattatgaaatgttttagagtggcttgaatttagcagttgcctgggatgtatctgggggctgcatggattgtagcagggcctgagccttatgagggacagagcctcttcctgcagtgtctcggaaatctggagaaatgcacaagagagaggccctttcttgactccaggagttatcttaaagcagaggctctcgaggcagagagcacagttagaatcagggtttttttgagtctggttatgggggtttgggatgtggagaagtgggtaggacctgggtaggagtgaagtctatttttaaatttctctagataattgtgttaccttcacacttacatacgttccctcctactctcctaccctctctcttctccttgagtagttctgctgtaaagggattaagctgagagataagctatttagaggattttgctcttaatgctggagagtttataaaagctgcctaacaggaagatgagattggagaataatttcagtttaggagttatatatttttaagaatagctagaaaaaccatgagtttttactttgggaattatctttcatttaaaatgtttatctaaaattacttgccttggtgtttataatttgtttctaaattatattttataactattatgtgttttagcaaacctgtttatttttggatcatgaacaagaatctggaaagccccaagcttgccccagtaccaggcaatttcactgaactgaaacaaagtgaaagatacaaagaaggaaccataaggtttgccctctaaattgaaagaaaatgaaatgacaaacgaccagattccatttctaaaatttactgattatttttccattagggacagaaaaataaatcctttcaagaaagactaacacgttattttgaaaatgtgacacaaataagactgtaaaatattagtccacatcttgtgtatagccagaaaaggcatttttttgtgttttttttttttttttttttttctttcaggttcttaggaagatatgctctttactgtgacatgttgctgcttggtcagatgtctgtctgttggaggcatttttctgtaaactcacccgaggttgctataaacaaggttgaagggctataaatgtgtatttatgtatgtcctgttatgtggtctaagggaaaagctgtggctttattaactcttgttattgttatggtgtgcacgttttctcatgacactgcatgagagtatattaatgtacatcccactggatattaagtataaaaaccccacatcgaaggatgtgcaatgaaattattaaagtaatagcaagacaaaggtgttgaatctggtaaccaggtcagtgggcttctttctgaaagtctgctaggatttaggggctggtaggcctagaggtagaatagctggtggtcccagtggagggtccccaacagaaccaatccccctatcattagaacccattgccagataacaaagctttccccgatagaccctacacagctgccagagcatctcttggaagtgtgactgtcataggtggccctggagccctccatgatcttaccctgcctccttttccacctctcctccccctggacccttgcctattcttgttccagcaatacagagctgctcgcagtttcctgacatgtgccacattcttccttgtctttgttgctttctgttccttttgcctggacatacctttccttgctgcattgcctgcctgtgagctagttatcaccagtaggtctcttcatccccaccctgcccccccgtgcacccttccgtgcacctgtggccgcctccaccatactttttttttctgctgttgttcaacagattataatctcctcaagggcatggagagcctggcaagttagagtcggagctcggtaaataccgtggaaggaattaatcgaaacgcacggcattcggtctcccacggcctgctgggttgctgaggctgcttcagacctcagtttggctgaggactggctgtggctacttaactctcaccacgttttattactatagatttgcaccttctaccttgccgcatggcagttgcaagcctttggccagaattgccggccgaaagggagtggttcagtgcaggctcattaaacatgtgttagaaaaaatcatttacagcacttgagctgtggataccaagctgtatctttgcacatgaagtacagcacatatggtactcgtctctgaaaagtcagtaccctacaaggcatgcaggcaataatgggttagaacatggtgcttaagaacaccacagtgactaagatgtttacagacacttaagacatttgtagttcattgcctaccagggctgctgttattttggagaccaaggaagatatttcctcccctggcttttcctgtttatctctaaggggcccagaaggtagaggctcccttgacactgggctggtgctgttgctgagacaggaaaaataggagacttggtgcctgtctttgtctgctttgggagaatataccaggacttcctggccaaaaatatttcagattaaaaacattcccatagccagagactaagctccctcactgtcacaaacaagcacttttccttccagctcggcttccagtgcccatggctgcagcgagtctagctccttacccctctcttccttttggcttggagattgggttctgctgtctcatcatggtgctcccatacctggaagcttacagatggcaaagccttggcttctggcagacccaggccagtgcctccctgaaccttctcccttgtcctctctcaatctcaagtcccttcttgtgacccacggttccctccctgtccctggaatccatggcaggtagagcgtagacatagatcccttggggtggtgggagtgggaggagtgtcgtatctctcatgccttgaagagcccagatttgcgctgggattaggtttcttcattgaatcagtgctgaaaagggtgatttgtctctgttgcattggttcagtgttgtgattctactgcagtgcctggtgaggctgttatggacttggcctagaatataactgtcatttgtaatttctttaggaaaatgtgttcctcaatccaattggcagaccagattttcagattttaagaatttaggacatgattccgtctgtaaattgacattaccttgaaacctaaaacaactagaaaataacttagccacaggtggggacatcaaagaaaataagaggccattcccgggcatggttgaatgaataaggacttgtaagatagacagcaccagaaggtaactgggaggtaggagatgcttgctcgctttagttttaagttgggaaaacttcagacccagagggattgtaggactttttgcagagcactttagctcttgtgcctgagcctcggggtgtgagcttttccacagccacctcgagttgtgagtgagaacacagtcttactgcttggcaggaggagagctggggcctagggtgagaccagcacagaggaaagttctgtccagtctgccaaatccagcaagtccatgttaatgtccagttggaagggtggttcagggaggaagatgggctccactctcataccctttcttcatgtctcctcaaaaccagtcattgcaacaccacaatcaacaccgacacggagcacagaggggcgtcttcatcgctgcccggcagcttggtctctcacctgggtacacagcaccttcctgggacactctaaggggtcacttgtgcactgccctttttctgttacaccttcagatatgatggttgattatacctactggtgggaccttattaaagtggtcattcaggcagttggaaagttcctatatgatgtggggctgggactggagaaagtgacatgtcatcattaggttagcttttttgacatttgtgtttgcttgtttactttttaatgttgttaacacattttttattgatctgataaaaacagcaattatctttaaaaggaatgattagtttcttttgtcttttgatttgtggaaataaatactagaaagattctatgtaagtcttcaagcggtatttaatttttattatgtagcaatatttgtcccttttttttttttttttttttttttgccccgagatggagtctcgttttgtcgcctaggctggagggcagtggcgtgatctcagctcactgcaacctcccactctgggttcaagcgattctcctgcctcagcctcctgagtagctgggattacagatgcatgccaccactcccggctaatttttttgtgtttttaatagagatggggtttcactatgttggtcaggctggtctcaaactcctgacctcgtgatccacctgcctcggcctcccaaagtcctgggattacaggcgtgagccgctgtgcccaaccatatttgtccttttataaaatactagctattatacggggaaaaaaatctttcacagtgacctttttctgtttcaattgctttatgattaaaaagggccaaaagattctataactactgtactaggagaaaatattctgtgtattcctgccagtggtccctttttgaagactggattctctgagaacaggaataataagagaaataacatgtcacccatctgtagatggacatcttgggaaccagggaggcttcaaaggtaggacagatgcctgcaagtagaaggggaatgaagttgagccagatctagacaaatagggcagcaaagatttttttcatagtcaggtggtctctggtgaatgtttcagagtttatgatcatggcaatggatgcctcaaggcacctgtcagccctctttccagggcgtcagtcattgtgaaggagaggcagtaaagattagtcaggatttattttgtcggctttctaatgaggattaataaagatgtacccagtggatggcacgagggtattgacccaagagtcccctgacagagaagagatgtgaggtttgtttagggtctgcagtgagagtcccaaacctctgctgcacatccccactggccagtggaggtggacacagaggcccctggcaggcatgtacccctggtagccccaccgtgccctggcaggcatttctgggtttcattggcatgatgctggcagcttgttagaaagttaggtagccttccttcagccctttctttttttctctgcccaagtgtctgacattgccctaagctcagaaactacggtgcgacacgtttctttgccatctgctccggatttggccttctgttcttgtgcatttgttactgttctgcgtcattactttttcagttgtacagtgtcatcagcagaccagacagtcttataaccagaaacttcggagacttggttttgtttttgttgttttaaataagcatagtggtaagcacacgttggtttaaccctctttatttcaaagttgtcacctcggtaatctaggcacgtgacagtgatagtgctggttctcagaacctgtttagagcatggcatatgaaaaaaaagcattcttttcactttatagttatgactggctttagattatctacataaatttacataaatttggttctgaatgattgagacttgtctctattttctattgaatgtgaaacagtggtctcaatcagggatcagcaaactgcgtttcatgggcctgccacctgtttttgtaaataatttatgagaacacagccacgcccattcatttaattattatcgtctattcttggttttaaggtacaagggcagagttgagtagttgcaacagaaaccttatggtttctggcctaacatactgtctggccatttagagaaaaagttggtcgactgttttacctatcactttggtagagttgaagactagagctggtgtgggaaactcccttggtgaacgtgctagtggtggtagaatgaatcttttttagggcagtttggcatttaaagaggcttatttttcacaacctttatattggaaagactgccttcaatagtttatacaaaggaaataattgattatggaaatttgtgtctgtagttactaagaagttgagacaacctgaatctttaatagaagataaacaattcatggttcatttgtgcaacagaatacaatacacttgttaagaatgcagaactagctgggcatggtggctcacgcctgtaattccagcactttgggaggctgaggcgggtagatcacctgaggtaagaagtttgagacctgcctgggcaacatggtgaaaccctatctctattaaaaacacacaaattatccaggtgtggtggtacacacctgcagtcccagctacttgggaggctgaggtacgagaatcacttgaatcccagggcagaggctatggtgagctgagattgcactactgcactccagcctgggcgacagagactctgtctcaaaaatacaaacaagaaaacaactgtcagtgtgtgtagatatgtgtgttttacaagtgaaaaagaattagtttgaaagccaatatgtataatatagatcggttttagaaatataaatacacatcagtgtgtatattcagaaaagtgggaaggctgtgtcattagaaattgacagtggttattttgatgggtgagattggaagcaatcttttctcttttacattgtgcaataagcatttgttactttgataaagaaataagaaaatgaaggccacagttatttgagtctgaagtctaaaatgtaccatacgtgcttcattttgaaaatggaagctgctgagcaggaattccctcaatatctgggccccttcgtcacccacccacccctgactttaataagcatcacacctgtccccggatgacgccttggctctggccacacaggaagagctgttcttcctgtgtctgaatccctgtctccctgctcattcattcatcgctcgcctctatcctcagtctcttcatttattacaggctctttcttatccgtatttaaacaccgtcatgtcttggccatcctgcaggaaataagcagagttcctctgtgtccagcactttatcctaaatttgttactccatgattacttcgtagaacctgccgatgttttccaagtagacagttttgttcagttaatctttatttattcattcccacagtatttactgttttctgatgcagagatgaacaattgacagcttctgttctcaaggagcttatgggggagggaaaatgccccccaaacatccctttaataattaaaaaacaacaaaactttgattgtacgctttttctttgaagaaagaggcttactgtaagttggtgttttacctactaattgaaatatatatctgttttttgagacagagttttcactcactctgtcgcccaggctggaatgcagtggcactatctctgctcactgcaactgctgcttaccgagttcaagtgattcttgtgcctcagcctcctgagtagctgggattacaggcatgcaccaccatgcccagctaatatttgtatttttagtagagacaggattttgccatgttggccaggctggacttgaactcctggcctcaagtggtgcgcccgccttggcttccaaagtgctgggattacaggcgtgagccactgtgcctggccagaaagatttttttgttaccttaataagtcattagagaaatgcaaattaaaaccacaacaaaatactactggccaccctgtagaatgactgaactaaatgaagtggcaatgccaaatgttaaaagatggcggaacggtggcagtttctctccattgctggtgggtatgcaggggacagccgctctggaaaacagttagacagtttcttatttaacatatgacttagtaatcccgctcctgggtatttacccaagagaaatcatatgcacagatgaatgattatagtaaatgtttatagtggctttattcataatatcaaaaactagaaaatccctaaatggctttcacttggcaagtgaataaacacacttgggcacatccacactggaacactagtcagcagagaaaaggaacaaataccaatagacccaacagcgtggaggaattatatgtgtattatgctgagtgaaagaagcgagactcaaagcttcacgtgtactgtatggctccatttatatgacaaatggagaaagcaaaaccagagatagaaagcaaatccctggctgctaagagcggggtcgagggggtggggttgattataaagggcacgtgggaattttgggggatgacacaactgttctatgtcttgactgtggtggcacttattcatagaactctacttttaaaaaagtgattttataaactatatctcaataagctcagttttttttgcggtaaaattttttttggatatgtgctatatttacatagtttaaaaatttaaacaatatgaaggaatatagtgaagtcttaactcctaagtttcttatcttgaagtctccttatgcaagtattagcatatatgcatatattctcattcttctaatacagaacacagcttccatctataattttgtgtaccagtactttctccgcttagtagttatggttcttttcgtatcagtgcattgagatcttccctccatttctgtagcggcacggcatcttgtggtatgagtgcatgcatgtatttagccagttctcctttgatggacccaccgtacacaatggtgcagtgaataaacttgaacacagtgacttctgctataacacttatgctgaaacaaatttatcccagtaccaagatttatcagaacaatgggagcttaacctgaatttcatgtttgcttatgtgtgatttcatccctgagaaataccaagtgactacagaatgctgtggagttgtgtaggaaaacacaaaacacatacacacaacaaacctccgatttcaccagggcctccctctcaactgtgggtcacatccatccacagctggtgttgcaagcttcccttccactaagattgccctccttcccccacttcacagtaactcacaagctgcaaccctctgacctccacaagctcactgcaggtctttttcaaggtaaagtgcagtgttttttgcatttcttaaccatttgacgtagttaaaactaaatattttcattcgatgtgtcactgacaaagtcttgagtgttgtctccgtgactccatttttgctagaggccctgttgttttgttgaagttttgcatagtgcagtgatttttaggagcaccgatgttgcattacagcagaaacgggctgtagtaagtatgcaggtctcttcatagaatagattgcccagtggaaggggtcagagctttaggagtgaattttggagggactgctgctgtgctatatttaaatcatgtgattggcttggtttttcctttttcataaaaaggtgtgagctgaagggcatgtgtcagcaacggttgaggataatcctgtagcctgcagtctttaagtttgtgggagtttctggctgcatggtggtcgttaaggaggctcttgcatgttggtgcaaggcagatacctcgtggaggtaggactcccaggacaaggtgagatgtggatgccttgccagatctgggtatgaagttatgacttttctccctctaacttccccaaagtcacctgaaacagagacccgtaagcacagaaacagaaaggacaagttattagaatgggaagtttctgattgtgagggaagccccgtggcaaaccgagacacgtccaccaagtgctctccgggaagaatggcctgccaaggccgtaccatcccaagcacagcagcagcatggggtagcgcacgcctagcatagtcactggagaaaaggaggcgggattaatgctttctttcctgaagctgtgaagatgaaagtcaaaaatgagacgggaggaagaaagtttaggaagtgtacccaagtgtttattttgatattttactctcaaaaagttttatgttaaaaactttggaaaccctgccagcttattagttcactatttctttaaagagttctatttaaaaacaaagtaactcagaactgagtaggaagacatgttccttttctgatcttagttaactattaaaaagtccacccaaagctctcaatctcagcttatagtaaagccaggaggaagcaaacggcctaaagtcttagaatgatgacggtgggctttacactgaaatgctgttttcccattttttaaactcataaaagcagaaggagctagtaatattgaggaacagaagttacgaaaataaatttggcaaagtaccttcgaataagtttgtatttaaaatctaacagaggaagaaagttgtctgttaggtaatgtgaccaggcaggtttgatctggaaactggtgttttaaacctcattttcttgtcaccagtgaattggaaaccctgcttatttttgaattgcagagttcatttctgcatttttcataaagatgctgaaacagaaggatgtctctctcacattgattgatcttttgaaaatagttactgatttgctaagctgctcttcattttttagggttttcttactggcatttctgtattaaaattttgttttgatgttaatattactacacaagaagaaatagaatattaaacccgtcaccttaataggaaatcgaattttcctttctgtggggtctcttgtcctattgtattgttagaaagatacatttttctttataatctgttaggatttggtgaagcagtcttgcttttagaaagatgactttcagttgattttttttttcttttgagatggagccttgctctgtctcacaggctggagtgcagtatcatgatcttctcggctcactgcaaccactgcaattcttctgccccagccttctgagtagctgggattataggcacctgccatcatgcccagctaatttttgtatttttagtagagacggggtttcaccatgttggccaggctggtcttgaactcctgacctcaggtgatccaaagtgctgggattacaggcgtgagccactgcgcccagcctcagttgatttttatatgtagaaaatataaaaagcattagatactagatttttaaatatctttattgaaatacagacctgttgttcatgactttaaagctttaaaataaataaaggctcgttacctcttagtcactcttttgctgcataaatgctaatccaagaggttagggattgctgctggcctattttgtgtaatcaaatctttatgagagaatatttttggggggtgccagcttgttatttgctttgttctctctttcgttgtttcccccagagatgaacagcattggtataacttttaacttggagaagaaattttctcctttgcccttgtttggattcaagacccttttgaatatctaccagactgatttggtttatttaaaagacagacagtatttttctatgctttttgaatggaagttggctgcataacttgactattacaagagcatttcctgagcgatgtgtcccatgctgcctgccccctttgttaatcatccccgtgttctcgaagcgtcctgggaggcaggcactgttgcaagcccacctcacaggggtgggagtggacattcacgtgggttgagtggctttcaccaggtcctgtgattcatgaggcagagaccaggtgccagctcatcttaggtgctgccggccagactcagccactccgatttgcctgccggtttgaacaaggacatgtttgtcaagcggttatgggaaaatgatttttaaaaatgtaatcagtctgggcatggtggctcacgcctataattccagcactttgggaggctgactgaggccagcggatcacttaaggccaggagttcgagaccagcctggccaacatggtgagaccttgtctctactaaaaatacaaaaattagccgggcgtggtggtgggtgcttttagccccagctactcgggaggctgaggcacgagagttctttgaacccaggaggcggaggttgcagagccgagatgacaccgctgcactccagcctaggcaacagaatgagactcagtcccaaaaaaatgtaatcaatcatttctttatcacatagcttgcaatcacttcttagtattatctcacatgaaaacttcgtcccacttcagtctttaatgagtttagagccagattttgttccattcatgaggcttgacagctctttaatttccttgtgatatgacactgtttagttccagactgctatgcatgtcataaccaaagaatttgttttacgccactaatttacttcaaaggttctgcatggaaatatattcagttaacataatatctcagcctgagtgggaaacttttaaatataaggaaattcggcttacctacttgacagtgtttgctgtctctctctctctcatcccctaagtataccagcaggcagcctccttaaagttgtttcaaagttctgtgttcttgagattatcaaatgatattatttaaaacaaaaatccttctagaaaacttcccttatataatgaataattacttagtcattaaagggtagccagagatttcatttaacatggcatactgaataaaacagcatattctatctaccacaaattaggtagtggctttacttagtatttactgatgtatggtttcatatattatcttttcagtaaaagatttatataatgttatttcaaatacctggatgtttgtgttgaatcaaaaacctgtgtttttgagagagaattttttttacccttatgatagtttaacccatcctcctaaaattagccccatcatggttacctcagccctgtcctcatttttattatatatttttaaaaagttttttggttttgttactgtattcctaaatacaggttgagtatccctgagctgaaagtttgggaacagaagtgtttcaaattttagatgtttttggatcttggaatattcaaatatacataatatcttgggactctctaattgtgatatttattcttgtttcatacataccttatatggatagcttgaagggacttttataaaataattttaattttgtgcatgacacagttctgactgtgacccgtcacatgaggtcagatatgacattttccatgtgtagtgtcatgtcaaccctcagttttggatttggggacctgtaataatgatttaacttaaactattacaaaagagttcttaattgtttgagtgcatctattttcattcccttaagtgaactttctctccttcctccagcaaatgaagaaacacccctgccgccagtgtgacaagtctttcagctcgtcccacagcctgtgccggcacaaccggatcaagcacaaaggcatcaggaaagtgtacgcctgctcgtaagtcctggtttctaacggaacgcagtgagaggactcaggaggaacctctggaaggtttttagtgtagtaccattaacttgctgtgtgctccacagttcctacattacatttctcaattgtattattgttttggcatagagtttttggattgggttgtcacacttaaatatgaaaataaaaaaaaaaggagcattttcttgcatatcccacatacattgtgtgttttttttttcccgagacggagtctcactctgttgcccaggctggagtgcagtgatgcaattttggctcactgcaacctctgcctcccaggttcaagtgattctcctacctcaacctcctgagtaactgggattacaggcacatgccaccacacccagctaatttttgtatttttagtagagacggggtttcaccgtgttagccaggctggtctcaaactcctgaccttgggtgacccacctgctacctcccaatgtgctgggattacaggcatgagccctggcacccagcctgatccctgagtgtcttgggggagcgattgattggcagtacagggtctctctgcacatgtcgagttggccacattggcgaggtgatttggctagcttgtttactcagggctggtcacagattcagtcctcggctgggccctttgccccttggctgcagtcaccactgaaggtggggcagcctgtgaccaaatgcaagggactgggtgggccaacatcaacccagactccagtggacagtcataagctgctgcttcatacgtgaacaccagaacgtatctcatcattagtgaaaggctgtcactcagctggaatatacctggagtgggttgataagaagaaagcatgtctcatgagagagagagagacaaaggaccctgaggctaaagcactgaaatgttacatggatgtcagtgcaggccagatggaccctatggatcaggagacttatgaaggttggctgtcagattcgcagggggttatgataaccgggtaggaatcatctgattcagtgaaattgaagctgtttagtgagataagaatgattatgaataaagtatgtgttgagaccaaatcaaaagaatcagaatttagaaggatgctctgggccaagaagacgatgggagatctggcccataatgcttcactgataggttttgtttatttccccatgaactcactgtaaagcagtaaaatgctgggattgttctgctaacttacggccaacaaaaaattcatcctcatggagagccctcgtcctttgggggtggtgctggctcctgccactgccctgcaagtgtctctaatgtgaggtcatcagggtttagggccaatcagtatgaattcctccgaagctattttgaaggcagatttgagaccacaagagactttttgtccttccctcagtagcattcttgatacctggttttatagcatacataataactagggccattacctcttttttttctttttttgagacggagttttgcttttgttacccaggctggagtgcaatggcatgatctcggctcaccctaccctccacctcctgggttcaaccgattctcctgcctcagcctcccgagtagctgggattacaggcatgcaccaccatgcccggctaattttgtatttttagtagagacagagtttctccatgtttgtcaggctcatctcaaacttccgacctcaggtgatctgcctgcctcggcctcccaaagtgctgggattacaggcgtgaaccactgcacctggccagcctgttttctaaactatctttggcctgctttattaaaataagtttttctttgaaaaataattgacctatttttgatctgcttatcatctactgagtgaccatacacactcgactgccatgagtataaacatgcatgctgcttttgtgcctggaagaatttggcgctggacactcatgtctttgtcaaggcagaggacagggataattaacagcagcacaaaggagtcaaggagggaccttatactaatgtgttcagcatggtgctcattctgagagaatactgagtcattgtgaaaacttcttttgaaatgcaatattttccctttaaaattaaagccatctagacctgtaaattaagggccactcctagcaaaattgctgattgcgtgttgaaccatggtgtgaactcagcttattggacctgtctgtgtgaactgacggctaaggaggaccttcgaccgtgagttcttccacaggagcttattttgtcagcaagtgcgttatctccttgcctttcaccccacaggcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtctaacattgcagatgtttgctttacagtgaaattgtgttgacttgcttttcccattcatttttttcctttcaagtttttgttgcatagttacagttttaaaaattcagactggctgggtgcggtggctcatgcccaccactttgggaggccgaggcgggtaaatcacgagttcaggagttcaagaccagcctggccgacatggtgtaacctcatctctactaaaaatataaaaaattagcttggcgtggtggcgggctcctgtaatcccagctactcaggaggctgaggcaggagaatcgcttgaacttgggaggtggaggttgcagtgagctgagatcatgccactgcactctagcccaggcgacagtgcgagactctcccaaaaaaaaaaaaaaaaaaaatcagaccacactgaaagtataaaataatgattaatctccccatagacccattctgacctcatcatcaggagttcgagaccagcctggccaacatggtgaaaccccatctctactaaaaaaatacaatacaaaaattagccaggcatgatggcaggcgccttaatcccagctacttgggaggctgaggcaggagaatcgtttgaacccaggaggcagaggttgcagtaagccgagataaagccattgcacccaaacctgggggacaagagcaggactttttttgtttttttgagagaaaagtttaaagaaatagtttaggccggacacagtggctcatgcctgtaatcccagcactttgggaagctgaggcgggcagatcacttgaggctaggagttcgagaccagcctggccaacgtggtgaaaccccgtctctactaaaagtacaaaaattagccaggcgtggtggtgcacacctgtaatctccagctactcaggaggctgaggcaggagaattgctggaacctgggaagcagaggttgcagtgtgccaagatcacgccactgcactttagtctaggcaatagaacgagactctgtctccacccccccaaaaaaagttagcagatacttaaaaagccctcctgtcttcggtgctatgctagatctggaatgtacccaggtaaaagcttgtatgtgctttcaaggagttaatcatcgagtaaaacctcctcagaatataagtcagactgatgtggcattaaaatgcaatacttcaagtgctcctggtggtgagttaaagaatatgtgtgaagccaaggcgtggtggctcacacctgtaatcccagcactttgggaggccaaggcaggcagtcacgaggtcaggagttcgagaccagcctggccaatatggtgaaaccctgtctctactaaaaatacaaaaattagctggacatcgtggtgcacacgtatagtcccagctacttgggaggctgagacaggagaatcgcttgaacccgggaggccgaggctgtagtgagccgagatcatgccattgcactccagcctgggcaatagcgcgagactccgtcttaaaaaaaaagaaagtgtgtgcaaaggtagcttcaggtcatggccacgtgtgaaggtgcacatgaacagagcagaaaagctggggcacagagtgcggagaggaggggcacgttggcttggggaggggattcagagtgggatttagagccctggaagcagacgcagtaggggaaatggtgtgaaggtgaggaggcaggaaagggtggggaaagcttccagaggctctcagtctaaaagcaaaatcctgacactctctcccacaaggggcgttacagttcacctcctgcagtctccctgagcactccttcctactggctctagcccctcttctgttgcccactcacaggcctgttcccaccttgggccttggcactcacagcttcctatgcctggactgctttcccgacactgcgtcaggtctcttttcaaatgtcacctgtcaccaggctgtccctgaccgtaccacatcacctagcagccacacatataccccccccttgcttcccatggccctcatcccaccctgcttggctgtcctgggtctgacatactgcatattttctcatttgtttctgttcatctaactccgctgccacaaatttcaggaagctaggagctcatttgtccactgttgtgccccactggcagagcaatgcctgctaacagctactaggtttctctgtggagtggaagaaaggcatgggcctccgggtggggtggcagacacagctttaaagcccctaaatcccaaagcgttcagcacaagttttcctggcagctctaaagtaagagaaccgatcatttatcaaccaccgtgaaggatggttttcagtcgtgtcatttgctttctttccctgaaaggtccccagtcccaagcggaagttggaagaaccagttctggagttcaggcctccccgaggagcaatcactcaaccactgaaaaagctgaaaatcaatgtttttaaggttcacaagtgtgccgtgtgtggcttcaccaccgaaaacctgctgcaattccacgaacacatccctcagcacaaatcggatggttcttcctaccagtgccgggagtgtggcctctgctacacgtctcacgtctctctgtccaggcacctcttcatcgtacacaagttaaaggaacctcagccagtgtccaagcaaaatggggctggggaagataaccaacaggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgtgcttctgtgagag

SEQ ID NO: 38614 - DNA, 44003 bp, Homo sapiens
gttctccgcccccgccgccgccattacggagctcccagtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggtgagagccccagatctgagggttggtactgcattaacagctgtgaccggggacagccacttaacctttttgagaaagagttgtctcccgtacggagaccggaccgggtgaactgtgctgccgcatccgcgtgcacgttctctctgttgtttattgtgcttcctgactttgcattgcattaaaaagtgagaatccaattcgaaataacgtctaaaaatcgcctggggctttttgagcacgctgtcttgtcttagagtgaaattagaggtgactagtgtcatttttgaaaggtgctctaattttgtttaacctgacataggcaaaaaacttgttagctttttgatttttcattgctcttctcaaaagtttagtgtaatttgtttcaaaatagaagtaacattttaaagtttgctgggttggttggttttggctttgtttttaagcttgcttggaagattgtagggctggaagttagtggagaacgtatactgaactcttcatttccggatgaaagttttaactccttacccagttagattgtgattttattgagatgagacactgtagtgtccttagtatctatgcccaaaacagacactgagtatatgtttgcttatataacttacatttgaaaatgaaaaacaagtggtgtcagcagtcaaattacaggcatgctttttgtgacatgactcgttaaatctgagtgtagtgaatgacttaagattgggaacaatgtgaggtgttcagcgcatcactaatgacatgtattacatatattttatggtaaaatgtgaaattatagtgctttccctaaaatgcatattatcaaggatatcagtaaactgaaatacgttgttaaactcctcacttttctacagccttctcttaatgtagaggaaataaattaaaactgaaatttggggctttttatttctacaatacttttttttattgcttgcattcaaataatttaaagccgtgcatggtggctcacacctgtaatcctaacactttgggaggccaaagaggaggatcgcttgaatccaggagttagagaccagcttgggcaaccctgtctctacagaaaatacaaaaactatccggctgtggtggcgcatacctgaagtcccagctactcaggtggctgaggtgggaggagatcgcttgagcccaggaggtcgaggctacagtgatccctggtcatgccactgtactccagactgagactctgtctcaaaataaacaaccgatttaatttaagcatttcccttgacaaaaagcaaatatttgttattgttgtaacattaagtttaagcaagctgatgttcataagaggaccatgtaaaccacaagtaaactcagactgtttatttttggcacatataaaaaccaagatgaaaaacatgaataggccgggcacggtggctcacgcctgtaatcccagccctttgggaggctgaggtgggcggatcacgaggtcaggagatcgagaccatcctggctaacacggtgaaaccccgtctctactgaaaatacaaaaaattagctgggtgtcgtggcggacgcctgtagtcccagctactcaggaggctgaggcaggagaatggcgtgaaccgggaggggaggttgcagtgagccgagatcgcgccaccgcactccagcctgggcgacagagcaagactcggtctcaaaaaaaaaaaaaaaaaaaagggaaaacacaaataagttttatttgttcatcctttagtttaacaaatattaattgagcatctattctgtgcctggtatgttcttaggcatcaggtatgcagcaaatgaaccaggtagataagatccctgccaggaacaagtgtggcagcctcaaaatttgatcattcagagtgcaatagtaaaaagtttagttaataggtacactgggtcagatgcagtggcttacacctgtaatcccaacacgttgagaggccgaggcagatggatcgcttgagcccaggagtttgtgaccagcctgggcaacatggcaaaaccctgttgatacaaaaaagagaaaaattagccgggcatggcggtgcgtgcctgtagtcccagctactagggagactaaggtgggagagtcgcttgagcctgggaggttgaggctgcagtgagctgtgatactacaacctgagcatcagagtgagaccgtgtcttaaaacaaacaaacaaaaaacataggtacagtgatgttaaggcagtgtgaattaacgttgcatatacttagctctgtaatgaacagtgagtttattaaatagccaattaacccaactattctaaagcaggtactacagattgaagctttgaagttctatgactttgacttttattaaggaaatgcagagctgaggctaacatctctttttttttttttttttttttttttgagacagagtctcacactgttacccaggctggagtgcagtggcatgatctcggctcactgcaacttcggattcccgggttcaagtgattctcctgcctgagcctcccgagtagctgggactaacccaactattctaaagaaagtactacagattgaacctttgaagttctacagcttttactaaggaaatgcagagctctaacatctctattttttttgttttttttttaaattgttgttgtttgttttttgagatggagtctcactcttcacccaggcttggagtgcagtggcatgatctcaggtcactgcaacctccgcctcccaggttcaagtgattcttctccctcagcctcctgagtagctgagactacaggtgtacaccacagcgcctggctaacttttgtgtttttagtagagatggggtttcaccatgttggccaggctggtctcggactcctgacctcaggtgatccctgcctcagcctaccaaagtgctgggattacaggcatgagccactgtacccagccctaacgtctcttaatatttatcccaaataactgggttttaagtgttcttcacacataatgaatgtagtcataagtactaccagatgtctttgttcattcaacttttattattattattattattattgagccaaggtcttactctgtcacccagactggagtgccgtggtgcaattctagctcactgtagcctggaactcctggacactggcagtcctcccatctcagtcttccaagtagctgggactacgggcatgtgccacagtgaccagctaattttttatcttttgtgtgtgtgggttttttctttctttttttttttttttttttcttttttttgagaaggagtcttgctctgtcgcccaggctggagtgcagtggcacaatctcggctcactgcaatctccgcctcccaggttcaagtgattcttctgcctcagcctcccaagtatctgggattacaggcgcgcaccaccacacccggctaatttttgtatttttagtagagacggggtttcaccatactggccaggctggtctcgaactcctgaccttgtgatctatccgcctcggcctcccaaagtgctgagatacaggcgtgagccaccatgcctggcccttttgtgtttttttttaaattattatttttttttcttgaggcaggctctgctctgtcacctaggctggaatgcagtggctcgatttcaggttactgcatccaaaaccttctgggctcaagcagtcctcccagtctcagcttcccaagtagctgggactacaggcgcatgccaccattcccagctgatttttaattttttttttttagagacaacgtctgtattgcccaggctggtcttgaactcctgggctcgagtgaacctcctaccttagcctcccaaagtgctgggattacaggtgtgagccaccacacctggcctgtttttaaattttaatttatttacttttggtaaagaccaagtctaatgttgactaggctagttttgaatttctagcttcaagggatcctcccacctctgcctcccaaagtgctggggttgcaggcatgagctactacaccaaatgggaaagtatttttttaaagatgcctatgaacggagactcctgaaggttgttgacttcacggtagcattttcagcctagctagtgttatcgtgggttaagaaagataaattcattagcaatataactttactaaggataacctgattgtgatattgttttatttccatatcatatttgcatgtaaaaataccagcagatttgcataaggctttttatcattaagaaaaatgggccgggtgcggtgggtcacgcctgccatcccagcactttgggaggctgaggcgggcagatcatctgagatcaggagctcgagaccagcctgaccaacatggtgaaaccccatctctactaaaaatacaaaattagctgggcatggtggcgcatgcctgtaatcccagctactcaggaaggtgaggcaggagaatcgcttgaaccaaggaggcggaggttgcagcgagctgagatcgtgccaccgcactccagcctgggcaacagagcaagactccgtctcaaaaaaagaaaaaaaaaatttaatattaatggatattctggttccctaagtatgagtgtgttacactgcactgaattctttcagctgactgaaagatttccttgcagctgactgacaattgacaagtctggtattgttcttggtgttcccataaaaatattttcccgataagtgtgaatgcatcctctttgtttcaatcttccggatttatcctagttgttgtaggttgggactgttacttgccaagttgaaagctcttcaattcttagacaaggttagaccttaatgtagaagttgcatgactgtcattccctactcattgttaatagttcattagcacagagatctagatacttaagtggtcttttttttttatattgaggaatttttgtataaaatgtcattgagtctcagatgagatttttggggaagagggggtgttagtgatcaggtaaacttgggtgactgcatgggtttttatctttgaatatttaattatattcttctgtactagttttccttacattaaaaatatgacagtcttagaagcatacttttattctcctaggtgatggtctaaatttgcttctgtgggtctggaagctattagaatgtcatgttattcagcagtatttttccccttgtgttttcccttaatagaaggaaaaaaaaagtactttaatagagatagagtttaagattacagttaattttcctgactctttcgagaacagtaacaacaaaagccttctcttggtaaactgatctttgactaactgttccttagtctctttattctatccttctaagttcctgatggtggcaggaggggatggggttaggttccttaggagcttccttgcccttgttgtctttgttcatgtggaaggtgcaacagctgccgtggcttatgcattcgtcttagttgctgctttatgtagtctatattttggtagttttatctttctgagtaaccaaatcatctgtcacttacctataaattttatagttatattttttccctttggatgtgtattaaatttagacgttttagtttagttttgtttctgttaatcttcacaccaggtcttttctgtgctttaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgaggtaggggctgacacattcttgaagctcactcttggatcaatccctgacttcaggccctgctgggtccttcttggtacatgttccttcccttactttggggagtctaggttgtgaatttgaaacaaaatcagattcttttcatcttccctttcccctcaaattcctgagaaaacctccaaccttctaaatttatagcaaatcaactataattatgtgtttccatttgaaattcaagctaaaataacatactttaaaaagtgtatcttaaaaatcatatttcacttcaaaaaaaacttgttaaaagtaatttgcatcagatcctggagtcgacttgaagaattctcctacatctgacacccagttaggccctttgagaaagagagaaaagagaattttttaatgcatgtttgattatggccatctcttttcttagaaggtagaagatagcaccatgccgattcgtcgaactgtgaattctacccgggaaactcctcccaaaagcaagcttgctgaaggggaggaagaaaagccaggtaaagtaaaatggtgacacagcttaaaacatcaaaagttatactgcaatttggagtgtcccataaattcctttgaacttaattgtttttttttttttttcatggctaagtgttttggggaaacatttagagagaatcagtagctattggtatgtcattgccagaccatgagggcaaagtaaggtttcatcttctctataaaggtttttggaaggtgaaaatgttatgttggaattaaaaacaaaaatgtttggggatgacaggaatggccagagagtagcattctggacataaagtgtcatggggatcagtgcagtgtgggagaatggaaaacgtgggcctttagaatagacagtggaaggttcatccagaaatcatctggaggccttcagagaagcaaatggtgatctgttgatctataacaggtattggtagagagaagattggccagtcagtggtgggagcataacaaatggaaagaaacatagacccatcaacatggagtactaatgctcctttatggcatgtataaccacctcttctccttttcccgtctttatttttcttctcatgatctttttggtttttttccttatcttttcccttttttcctttctctcttgccttttatctcaggtttttcagggataagcacactgtgctgcctctgttgtggctgttagaatcaattatttgctgaccagcatgtattaggaatagagggccgggcacagtggctcacacctgtaatcccagcactttgggaggccaaggagggcagatcacctgaggtcaggagttcgagaccagcctggccatcatggtgaaaccccatctctactaaaattataaacattatctgggcatggtggtgcatgcctgtaatccctgctactcaggaggctgaggcacaagaattgcttgagcccaggaggcagaggttgcagtgagctgagatcacgccattgtattccagcctgggcaacagagggaaactgtctccaaaaaaaagaaaaaaaaaaaaaagaggagtagaaaatacatgcatccttggtgcatcagggcagacatcaataaccagtcaatatactcttttctggctgagcctggattttttctctaaatccttagatgaatgctataagcaatttgggcaccctggcctaaggcagttaagaaacacgggaatccaaatatttaaaaaagtaaacgggtgctggtaagttgaagataggttatcttgtccagcactgggataagccacttggtggtccatcttaatccatgtttaacagccagctgaagccactaaatcactaataacatcagttttcagaatatatgccagagggttcagatgtaaagtattagaaaactcaaccagaagtttatgaagaaacagtgtcacttcacaagttgtatgtttgtttaatcttctctctatcccattttgtacacagtattttgtacatagaaattagacttcacttattttaaattttgtaaactctatgttttacacagaaacacagtagtttaatgagttggaaacagtcttatacataatacatattcaatatctgttgagtgactgaactttattaagccataactcttgagcagttattcttgagaagagaaaataatgtaaatttataagtcttactaccgtaaaacccctgaatgattcttagcttttcatcttttttagaataagacaaagtgtaaataaacatgactaactaatagtaaattcttgcccatgcagccatttaggtcaaattgttgggttgaggggcagtaaaagatatatcatgatgaaaaatacattttattgtggaaaacctaaatgtagttattatctttatccccagataccattgttatagtgaagttctatccataatactttgtcatcctaagcatatgggaaacaattctagaagcagagaattccaaaggaggatggaaatcactcgcttagtataagtgttagaattgtacttatgtgatttggttttaagaaagaagtggcattttaaaattctctttatagctgggcgcggtggctcacgcctgtaatcccagaattttgggaggctgaggcgggtggatcacgaggtcaggagatcgagaccatcctggctaacacaatgaaaccctgtcactactaaaaatacaaaaaatcagctgggcatggcggcacgcacctgtagtcccagctactagggaggctgaggcaggagaatcgcttgaacctggggaggtggaagttgcagtgagccaagattgcgccacagcactctagcctgggagacagagcgagactccgtctcaaaaaaaaaataaataaataaataaaattctctttatgggaaggccacaaagaagtcctcgtcattattgcaataattagttcacataatttaaatgatcaaattcttcaagcatatactttggcttgaagtatatgcttgccactggagtcctttttctttcatgttttttttattttttttatttttatttttttttggagttctctgaagtccctgcataaccagtgcctggggttctgtgttttatagtagctactcagagacatgctgtgaaggaaaggcacaaatagcagcagacctccatgttcccctcatatttctactcttgcttcagtcattcctcttggagaatacatgagtttttaaattacttattctctgagatttgcctgttgaattataaaatggctagtttcttaattatgagtctcatgaatattgcaaagtagaataattaaacaattggggatgaaatgagttttcctttctatgtaatttcctggtctatttttctaataatagataaataaccacctgaccaggaaacttgagtgacataaagaatgtaagaaaactgcattagtggtcattcattttcattttagaattcatttgttaattggagactttggctggtccgtttaataagataagcttttaccttttattgactcagattggaatacatctgcttatgcaattctgctcacctgattttttagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggagtaaggagttatgtcttcttgctatttatatttgaagaatgtgtaaaaggactttagattagattgttttaaagtgttataacattggtttatgctaggtatttgctatttggatttaatttttagaattaccatttgaaataggtttattatatagttgtttgacctgttagaatatgctgtagttagcagaacacaatggtttgaataatccaaaagtctttgtcattggctttggaatgtgtttttgagcttgtaatttattgtgggagtatctgatattttaagcattggcaagacttcaataagaaatgaaacataactataaaaatctgacctagaagacatttcactattttattcctacttctgtgccaggagtgggttgtttttgtgtgcttatgttagaaggcattgatttgtatcaagccattggtagtgtgacctaaaagtctatatatgtttgatgaaatattcagttgaagaattggctttgagaatctgaaagtaaaatttgctattgatgtgtatctatataaagtgatggcagttactttttaatttttaatttttttttttttttttttgcaggagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggtatacctgtgtaggacacctaccatgaatggaccttaaaggattggaagttgtttgggtgagtgagtgagtggtaagtgaatgcaaaggcctaggactactgtgtgcaacttttaaaactaaaaagtttttatttttagcaacttttaaaactaaaaagtttttatttttaaaaacttttaaaactttaccaaaaacaaagacacaagccggacgcaatggtgcacagctgtagccctagctacttaggaagctgaggtggggggattgcttgagtcctgaaatttgaatctagattgggcaacgttgtgagacctcatatttataaaaaaacaaaactaagacacatacacacaccttaacctaggcctgcacaaggtcagggtcatcaatatcactgtcttccacctccagatcttgtcccactcaaggccttcaggggcagcaacacacatggacctgtcatttcctatgataacagtgctgtcttttggaataccttctgaaggacctgcttgaggctgttttacagttaactttttttttgtaggtagaaaacatatactctaatgataaaaagtatagtatagtaaacacataaactagtagcatagctgtttattatcaggtattatgtataattgtaatgtgctttttttttttttttgagatggagtcttactctgtcacccaggttggagtgtggagtgcagtggcgcgatctgggctcactgcaacctccacctcccaggttcaagcgattctcctgcctcaacctgccaagtagctgggactacaggcgtgcacctccacacctagctaatttttgtattttcaggagagacgggggtttcaccatgttggccaggatggtctcaatcttttgaccttgtgatccgcccaccttggcctcccaaagtgctgggattacaggcatgagtcaccgcgcccagccaatatgctatatttttgtatgactggcagcactgtaggtttgtttacaccaatgtcaccacaaacaagtgagtaacgtgctgcgctgtgatattaccacagctatcatgttaaccaggtaataggaggttttcagttccattataatcttaagggaccaccattgtatatgtggtctgttgaccaaatattgttacacagcacatgaccataaaagaataacttagtaataactataccttctagctataatcttcagggtattctttatctgagtttcataagtatagctaaggtctgtggaatttatagcaactatcgtgtgtgggtgtgggtgtgtttgtgtgtgtgtgtgtgtgtttaatggagatggcgtctcactatgttggctaggttgggcttgaactcctggcctcaagctgtcctccctcctcagcctcctaaattgctgggattacaggcatgagccactgcacccagcctatcgtctgttgttaaatgttctaatgcacctattaggtgcacagagtactgttatatactcagaataaaatttacataatgctttaaatctcacaaaattgttttgataaacatactcttataattcttgcaacaccttgggaaatagttggttctatattactgttttatagctgaggagaaagactcacatcatttactaagatcatatagctagctagtaaatgtttgagtgaaaatacaaacaaaggttttctgactttaagagcttgagttttttccactataccatattgcatctgttgtaattgttaactaatgtgcattttaaaattctcatttgtcttatgtactgagcccttataccagtgctaatttatgtgactcctttctcctgcagctaagagaaaaatacctttttaattcatttatagtacccagtttttaaagaagatttattttgtaaaattttgcttatggtacatgtcatcttagcctgtaaataaattaaagcattaatttttatccctccctggtcttttcctccttctgactttatacgtctttctagagagcttatcttctataataacaattctttgttttaaagtgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcaagtttttatttcaagcaattcatcttagatttattatgttcatttttttcttatttgaaaatggcatatatctgtctagacatcataaatcttgttctgcttcctaaaggagttttaaagagaggaaagtcattataagttcatgtttttctaatataatcacatttggtgaacactgttaatttttttaaaaaaattatatttaatatagcaaatattttaactttagaatttttaaatgcagtttatcgattaagtacagtttttatttgaaggctgaaaatgttaattcattgaacaaacatttaaggactaccttcctctgttgggcgcccctgctagtggtgaattaactaaggctagcaaagtccttgcccttataaatctaattgtgactcagtaactgaaaaatattgagaatttttgtttaaaaaatatctctaggttcatttctaaagctaagtgatcttggtagtggttatctttcacacctgaaccctgttaataaacactgctttattacctagacattccaaaatgcttacaaaaattatcctccttacatagatttatgatttcattgactttcattagatgtagttttcctattttaatttttaaaggttatcttctaatttgacattgcctttattgtataagtcttttcatttaattttgccttgtttagttcatatgatcagatgataagaggagttagaacagacccatctttcagggaccctgttgttaggatctgaggcaggactggggagacagggatacagatgattttaaccagaaaaggggggatgtgtacgaaaaggagcagcctggttgtcattctcagaatatgagaagatagcactaacacataaactggaaaaagggtttgccttcagacttctccctttactccttcaagacttcttatgctctcacctcattaagaaaactttattggtctagattacctcactgtagtgaaatctctgttctttgtatagcctttcttcaaggatttcacttgatgaccactcagcctgggtttgaaggagcagcatcatagtgaggatggaaaaagggctgaaactttaaaatagtgaaataaaaaattaaaacaatatcaatttggcttaaagaatggtttgaatataattgtgcatatttatggagatgattgattttatatagataatgtgtattccatgcaatatgacaaattattgtttcagaccatggataccattttctgtattgaacaggaatcatgatgtctactaccatctcactgtcggattggtggagcaaaagattatttgtttcagcattagtgttcttttctgcttgattttctttgctctgtgttttcttttaagatcaggagtaaacctcagtaggtcattaatagttcagagacatagacttgaattacatgacccatattaatacaacttgtttcgtgttgtgcaatcttttctggaccatctacctgtgagttatttttctttgttgtcaaaatgtataaaaacattcaacgaagttcttatccaatgagaatgaataagtgctacattgatttaatagacactgtggcagtacaaaattgatggactagctcattagataaatgacagatgctacttttgtgtgtttcaaaatttaaagtatttgatttcaagtcagtgaccagttggaaaacaaaattttaagcatttgaaaaaaattaagtatttgctgcctttgtgacataatgagctacttaattcttccaggtgcattagtcaaatggagtataagtaaaataggatggaaatggaagagggcacattaaattcaaatagaacaccttcactattacccaaaactctccttcagcactttgccatctgtaaacccatttttatgccacttattcagattatctttgattcttctttctgctgacattcatacagagccttcagggaaatgtcctggcatgctcattccttaagctcgtgccttaaaatgggacagatctgtgatcctgtaagtgataggtttgttctgcttttctcattttgatgccaaagattcatcttctaaatacagaatggaattaaaatggaaagaggttcttcattatacatagaatgttgttcgtgttcagtatggtctcttaggctgttttgaacaatttaaaattgtagtagaaatatttagtaattctgttacttctctgtagtcattatgaactgaagtcttctgaagttcattcttccctaccgtttttgtcatctatcatcaaattcacttccaaaataatttattttgaaaatatatgtcaggctctatctaataaaaaaaaacaactagtttaataaatcttttctaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggtattacacaattgttagtagtaagatcatttcattgtgtattagctttaagtctacagttagtaacatttaggctttttgtgccttttttgttaaaaataagtttcatgatgatgaaattccttaagtttaacctagttgaattatctgaggctaggtttcgaaaatgctggtgccattaagatagtgtaacttttttctagcttactttgctcttaattggatattttttggggggctgcttgtgcttgaaatcatgtagcactgaacatgaaaaagaggtaaggaatcctactactgaaacagcaaaaatgaggctagggatggtggcctacacctgtagtcccagcaccttgggaggcttagttgggaggatcacttgagcccaggagttcgagaccagcctgggcaacatagcaagaccccttctctacaaaaaatacaaaatcagcagggtttggtgacacatgcctctagtcccaggtacttggaaggcagaggcaggaggaccgcttgagcctgggaggttgaggctattgtgagttacgatctcaccactccagcctcggtgagagtgagaccctgtctgaaaacaaaaaggaataacagaaataataattgcccttgtcttaggtttgtttcctttaaagcctaacttacatgatagacttgttactattaatttttagcttcataaatgtgctcaccttaactgattagtatctaaactattaaagcctgttaagagtatcagagaaacccgagtgaaatgtgactagtactagaacaaatgttgatttcaggcataaatctactttatcttgcatagtgcatggaaacttagaaccatagaaatctaaagctagaataaactttatattatgttaccctcttcagaggtccagagtgatgaaataactgctaaggtcttacggtagtggcaaaaattttaaaaacctagttcaccccattcctagagtcttgttaagttttttctataccccctgcctgtttgatcagaacagaattctgtgccactcaggcatttcagctctgcttagggacttccaactagtacttaattgcacagatacgtcttgtctcctatgtgccagttgcctggaggtctgttagtgaataaaacagattgctgctctgtggagctaggagtccagctttctcaaaatgtaaaactgatatttaaatggcctttaaaattatcactgacggccaggcacagtggctcatacctgtacgctgaggtgggagggttgcttcaggccaggagtttgagaccagcctgggcaacatagcaaggtgaggccctgtctctacaaaaaaattatttctttattctattttattttactttttgagacaggatctcactctggcccaggctggggtgcagaggtgcaatgtcagctcaccgcactctctacctgctgggctccagccgtcttcccacctcagcctcccgagtacctgggactataggtgtgcaccagcacacccagctaatttttgtattctttgtagagacaaggttttgccatgttgcccaggctggtctcaagctcctgggcccaagtgattcacccacctcagcctcccaaagtgctgggattacagacgtgagccaccatgcccagcctttacaaaaaacttaaaaattagccaaatgtaggggtgcatgcctctagtcccaactcatgaggctgaggcaggaggatcgcttgagttgagctatgagctaacatagcaatgagctatgattgtgccactgcactccagcatgggtgacagagtgagaccctgtctctaaaataaaacaaaattatcgttgactaaaaagtcttacctagttaatataattattagagccaaggacctgttgtgtaacatgtcagcaaagcttatgagatggcttcatgttttagtttatgacctgctctagcctacatagcctgaccacccttggtttgatgcctaaacaactcttagtaggctaaaagcattccagcttgattgctgcattgatagcagtgtaggtaaaactaagctgtggaggactttagttattgtgaatcaactttttttttgagatggagtctcgctctgttacacaatggcatggtctcagctcactacaccctctgcctcccgtgttcaagcaattctcctgccttagtctcctgagtagctgggattacaggcgcccgctaccacacccagctaatttttgtatttttagtggagatggggttttaccacattggccaggctggtttcaaactcttgacctcaagtgatctgcccacctcggccttccaaaatgctgggattataggaatgaaccaccgtgcctggcctattgtgaatcaactttaaaattttatgaaagtgctttgtgaactggaaatatgtggtaaaacttaacataccattgtgtgcagtggctaaaaaattgtttgtttgttttttgagacggagtatcgctctgtcacccaggttggagtggagtggagcgatctcagctcactgcaagctctgcctcctgggttcacgccattctcctgcctcagcctcccgaatagctgggactacaggcacccgccaccacgcccggctaattttttgtatttttagtagagacggggtttcactgtgttagccaggatggtgtcgatctcctgacctcgtgattcgcccgcctcggcctcccaaagtgctgggattacaggcatgagccaccgcgcccagccaaaaaattgttggataacccttcccataaggaataatgtatcattggtaaactgtgggaagttacgtggtctgagactaattaggctctaaactttttccaaggtgcttttaagacagtgagggcttttcttatttccctaagagattgtgtcccttccttttttgggacatttttgttttgattttttatttcattttgaaagtttttaataaactgtttaacgtggtatcacagtagcattcttcccaaaattttgtagatgagaaaacaaaagctcagagggttaactgggttgtccagtattactcagcatcagctagatggtatataaaggagctttcatctgaagtcttttgactctgcattgactgtttttttttttttctctgaagaagtaaacaccactttacattagctcttgcattaccatggcctgtaatttccttagcctactgtaaagttatgaatactagaataacaaaaattaatttactttaggttaaaggaaaaggtgcttctggaagttttgttgtggttcagaaatcaagaaaaacacctcagaaatccagaaacagaaaggtaagacatctataccacagtttgagtgctgtggagctgttactgctactaaaaatagcaacattcattgagtgtttgctgtgtgcctggcactatgcaaggttcagcctttctgctaaggcctagggaagttataaataatttgttcctctagtgagtagaatagccaaggtgcagatccaagcagtccaacctggttaagcctgtgctcttaagtgccttatattaaattatgggcagctatataaattacactgttttttgttttgagatggagtcttgctctgttgcccatgctgtagtgcagtgacatgatctcagctagctgcaacctccgcctcctggattcaagcaattctcctgcctcagcctcctgagtagctgggattacaggcactcgccacagtgcctgactaattttttttgttagtagagacagggttttaccgtgttggccaggctggtcttgaactcttgacctcagtgatctgcccgcctctgcctcccaaagtgctgggatttacagggtgagccattgctcccagctgaattatactgctttttgtgaaatatcttttaaactagaggaggtataagagtcctctgtttttttgtttgtttgtttgtttgttttcttttctaagatagaatcttgctctattgcccgggctggagtgcagtggcacgatcttggctcactgcaacctctgcttcccggattcaagtgcttgtcctgcctcagcctccccagtagctgggactgctacaggcatgtgccaccgttcccagctaatgtttgtatttttagtagagatggagtttcactatgttggccaggctggcctccacctcctgacctcaggtgatctgcctgcctccgcctcccaacgtgctgggatgatagatgtgaaccacaccatgcccagcctaaaagtacatttttaccaaatactagacccaaaaacaatacccagatccaatttttcttcctgtttttgtaaatactaacattcttcttcccaacacatataatttcatttgtgtaaagtatttctacaataataaagtgaaatgtcttgtactcatttatatcagaaattgaaataatatttttctacaccttttttttttgttttacaactctgaagctttttatccttttttcatagacttttcaaacactttcaaaatgaactttatgcatttttttctggtgctgtacttcataaattaggacctttaaaatctacactcctttttacttttatgtgtgttttttgtgtgtgtgttttgagacggagtttcgctcttgttgctcaggctggagtgcaataatgcaatctcggatctctgcaacctccgccttccgggttcaagtgattctcctgcctcagcctcctgagtaaatgagattgcaggtgcatgccaccatgcctggctaattatgtatttttattagagacagagttttaccatgttggtcaggctggtctcaaacttgagacctcaggttatcagcccacctcagccccccaaagtgctgggattacagacgtgagccaccacacctggctcctttttcttgttttgttgtgttttttttgtttttttttttttttgagacggagtctcgttctgtcacccaggctggagtgcggtggctccatcttgcatcactgcaatctccacctcccgggttcaagcagttcttgtgcctcagccttccaagtatctgggattacaggctacgacgtctggctaatttttgtatttttagtagagaggaggttttgcaatgttggccaggctggtctttaactcctgacctcaggtgatctgcccacctcggcctcccaaagtgctgggattacaggtgtgagccaccacacccagcttttatatgtatttttaatgctgtccattgaaaattttatatcaaagaaattgccataaaattgacaaatttggtaatcaactgaggaaagcccttgagttgtatgtagaaacatttacgttctataatgatcataatttttgataattacttttcagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggtatgagccattggcctggcctttaaaacatgatgtgttacttcctttagctcccttttcatgggaaaagagatagattaaatactgaggaaggattactttcagctaaaaataaatcttttttattggttttatttttttgccccattatgtttttattttcatatctccatgtataattttttttttttttttttttttagttttttgagacagatttgttcttgtcacccaggctggagtgcagtggcaccatctcaactcactgcagcctctgcctcccgggttcaaaggattctcctgcctccgcctcccgggtagctgcgcctacaggcacccgccacgacacccagctaatttttgtatttttagtagagccaaggtttcatcatgttggccaggctggtctcgaactcttgaactcaagtgatccacctgcctcggcctcccaaagtgctaggattacaggcgtgagccgctgtggccagcctttttttttttgagatgaagtcttgctcttgttacccaggctggagtgcaatagcgcagtctcagctcactgcagcctctaactcccgggttcaagcgattttcctgccacagcctccgaatagctgggattacaggccccggttaccgtgcctggcctagttttgttttttgtgtggtttttttttttttttttccaaacccaaatcttatctttctttgtaagatcctggtagagtaactcttttaaatgttgtcagctgttaagatatgtagtattgaactgtgtatcttctcagatatgaaatatcttaacagttgacaacattaaaagagttactctaccaggtttaaaagaaaaaaaacaaaaaaaaaactaggctggctgtggtggtgggcatgtgcagtctcagctactcaggaggctgaggcaggagaatcgcttgaacccaggaggtggagttcgcagtgagccgagattgcgccattgcactccagcctgggcaccaagagcaaaactccgtctcaaaaaaaaaaccataagagtaaaaaggagtgtagactttaagggtcctaatttattcttagcctttaataactaaataatgaagtacagcaccagaaagtaatacataaagttcattttgaaaatgtttgaaaagtctgtgaaaaaaaggatagaaagcttcagggttgtaagaaaaaaaagtgtagaaaatactatttcaatttctgatataaatgagtacaagacatttcattttattatagaaatactttacacaaatgaaattatatgtgttgggaagaagaatgttagtatttacaaaaacaggaagaaaaattgcatctgggtatagtttttgagtctagtattgggttaaaatgtacttttaggctgggcacggtggctcacgcctgtaatcctagcactccagcctgggtgacagagtgagactcagtctcaaaaaacatatatatgatagatatatgcatacatatgtacatacatatacatcatatatatatttcatgagaattcaggcttcaataacacctgtacatagaaatagcataatgtttccatcatttaaacatgcagcataaaattctgagataattttgttagtaattgatacgtaaaatttgccatttaacgtcttgacagatcatttagattgtcacatttgctcagttgtagattcatgcagatatatcaatttgtttaaatttgtaattcacagactctgagagtgtttgtgtgagatgacttctagaaaattatgtttaatccagatttctgtctacagaagactaccatattgaatgcacattgtcccgatacagtgtagtaccagtatttacttgcattactgaggcatgcaattagaagtgctgaggtttcagtccagaagccacattttcagaaaatcagtagtggtcatcagaatgccaaattaaagagctagtgaaatagtgcaaaagaaaagggaattatagaagcagaaagttctaaattaatgtgctgatattttcatgcttcttatatgctgagtatagtggtagtaggcagacacaattgtggatcaaaaatgcgttatatgatgcatttaaagatggaaacatatttcactattctttaacaaagaataaagtttatttggctcatggtactgcaggctgtacaagaagcatagtgcaggcgtctgcttctagtgagggcttcaggaaacttacaatcatggtggaaggaggagctatcgtatcacatggcaaaaaagggagcaagagaggagggaaaggtgccacactcttaaccagatctcacactcttaaaacaaccagttgttttaaacaacccgctcattacggccaggaaggcacgaagccattcacgaagccatccctataactcagacacctcccactaggccccacctgcaacactggggatcatatttcacttttatctcctttgtgtgaccccaaaatatctgagacaggtctcagtcaatttagaaagtttattttgccaaggttaagattgtgcccgtgacacagcctcaggaggttctgaaaacttgtgcccagggtggtctgggcacagcttggttttacacattttagggaaacatgagacattaatatatgtaaggtgtatgttggtttggtctggaaaggtgggacaactcaaatcagggagggggcttctaggtcataggtaaataaaagacaaagaatttcattatttttgagtttctgattagctttttcaaaggaggcaatcagatatgcatttatctcagcagatgaatgacttgaagttctgtctgtcgtttgtctgcaaggattttccttgtgattaggggattcgtgattagggtttgtgattaggggatcccaagatttattttcttttcacagcctttattctctgctttttggtgagtggagaccatatcttcccccatttttttttcttgtagttctactctacttacataaggtagtgtgttgctaccagtgtgcctttgctgcacttcttttgaaacatattgtcatgaccttaggctgaaacaaaatttacctgataatggatgggttgtcaacccaaaggtgctaatgaacctgaagaccttttctcatggcctttttaatggtaattttttccattgaaacttttttctcttatgtgaaaccatattgattttctctaattcttgattataatggagtcctttcatatacacatttaacttgaaaattcagccattcttgcttggccaaacaaaagaggaagaaaaatacagtttcaccaaagtgtaagttgtctatactggtatctacaatgtctccccttccactttctccactttagtcagactttatccccaccactttacctgaatattttctgtcagtctccacgttggaaatttcagtggtcaattcatagtccttaccagctgccctctcaatggcatttgacacagttgatgactcctacctgcttgaaacattttcttcacttgccttccaggacaccacactttcctgatttttctgtaacctttttacccttcgtttctcaatctcctaaggatttctgctttacctcttaatagaaaggagccctcagggttataccttaggcctctcatcttttatgtccacattcacttggtgattcctttcacttgcaaaactgtaaataccagctataaactattaattcacaaatgtatgaatctagcccatacctcccttctaacttcagattcgtgtatacggatgcctgttcagcatcagcacttggatgtctgatttaaatgttgaaaacatttaatgatccccactctgctccctctccccccaaaaatccctgcatttcccacattatcttcatttcagttcatgacaatattatccttccatgtgctgaaaccaaaaaccctgactttgtgctggtctcttctctttatcagacacctttatctaatctataagcaattatttttgctctgtctttaaaatatatcagtaaacaggctgggtactgtggctcatgcctgtaatcccagcactttgggaggcaggtggatcacatgaggtcaggagttcgagaccagcctggccaacatggtgaaaccccatctctactaaaaatacaaaaaaattagccatgcatggtggcacgtgcctgtagttccagctactcaagaggccaaggcaagagaatcacttaaacctgggaggcatagtctgcagtgagccaagatcacaccactgcactccagcctgggcgacagagtgaggctccgtctccaaataaataaataaaataaaatatatcagtaaacagactacttgtcatcacctgcactaccattctcttccaggccaccatcatctctcacctgtattagagcaataacttcttaactgcttttttcatgctccctttcagtatgttcttaccatcatagtgagagtgagacttttttaaaaatgtaagttctatcactttttaaaatttatttatttatttatttgagaaggaatcttgttctgttgcccaggctggagtgcagtggcatgatctcggctcactgcaacctccgcctcctcggttcaagcgattttcctgtctcagcctcccgagtagctgggattacaggctgtgccaccacacccgggtaatttttgtatttttagtagagacagagtttcaccatgttggccaggctggtctcaaattcctggcctccagtgatctgaccgccttggcctaccaaaggattacagacgtgagccactgtgcccagcctgtcacttttttttttttccaagctggggtcttgctctgttgcccagactggagtatagtggcaagatcgtggctcatggcaacctcgaactcctaggctcaaacgatcctcccactgtggcctcaaaagtagctgggactgcaggaatgtgtcaccacacacagctagtagtttttaaattgttaatagagacagaatctccctacattgcccagactggtctttaactcctggcctcaagtgatcctcctgcttcggccacccaggtgttgggattacaggtgtgagccactgtgtccagtgtcatgtcgcctttctactcaaacattcagtgtcttcccaatcccgtcacagttaaaaaatcagtctgtagggctgggtgtggtggctcacgtctgtaatcccagcactttgggagtctgaggcgggtggatcacaaggtcaagagttggagaccttcctggccaacatggtgaaaccccatctctactaagcatacaaaaattagccgggcatggtggcacatgcctgtaatcccagctactcaggaggctgaggcaggagaattgcttgaacccaggaggcagaggttgcagtgagccgagattgtgccactgcactccagcctgggcgacagagcaagactctgtctcggggcaaaaaaaaaaaaaaaaaaaaatcggtctttaaaatggcccacaaggcactacactcacttgtatctctgacctaagctactcctcttcactctctcactggtctcagagcctttgtgttgcattccctttacctgaatgtatttttccccataagccactttgccagttcctttacttccttaagtttttagtctgatgtcatcaccaaaggcctgccttgactatttttattattcttgttacttgggcatataaacaagagaaatgtatttctcacagttgtgcagactcgaagtctgagatcagggtgccagcatggttgggttctgtgagggcctcttctgggtgtcagagtgccttcttctcattgtatcctcacatgacagaaggagcccttaatactttcttaaatgttttattttggaaattttcaaacatatacaaagaaggatagagaacattaaccatcatacttaaatcattcttttttttgtttggagacagagttttgctcttgttgcccaggctggagtgcaatggcacgatcttggctcaccgcaacctccgtctcctgggttcaagcaattcttctgcctcatcagcctcccaagtagctgggattacaggcatgcgccaccacacctgactaattttgtatttttagtacaaatggggtttctccatgttggtcaagctggtgtcaaactcccaacctcaggtgatctgccggcctcggccccccagagttctgggattacaggtgtgagccacctcgcccggccacttaaatcattcttaacaaaattaataatttcttagtattatctagtacccagtccatgttcaaatgtccttaattgtctccagaatgatattttacagttgtttttcctaacatggcccacacgttgtatttggttgataatgaccaaccaaaacctctctcccagccaggtgctgcggttcacatgtgtaatcccagcactttgggaggccgaagcgggaggatcgcttgaacctacaagttcgagaccaggctgggcaacatagtggaaccccctctgtacaaaaaaaaaataacaaaaattagctggtgtagtggcatgtgcctatagtcccaactactcgggaggctgaagcagcggaagggttgcttgagcctgggagatcaaggctacagtgagccatggtcataccactgcactccatccagagtgacacagtgagatcctctctcagaaaaaaaaaaaaaaaaggccaggtgtggtggctcacacctgtaatcccagcactttgggaggctgaggcgggcagatcatgaggtcggaagatcaagaccatccttgctaacacagtgaaaccccgtctttactaaaagtacaaaaaattagccgggcgtggtggcacgcgcctgtagtcccagctacttaggaggctgaggcaggagaatcacttgaacctgagggggcggaggttgcagtgacctgagatcgcgccactgcactccagcctgggtgacagagggagaatgcgtctcaaaaaaaaaaaggagtgtttaacccatagggtttaagtctcttagtatgtgcgaagcacttcttagaatagtccttggtacctagtaaatgttcaactaatgttattcttactagtctcagttccagcttctcatagtatgaccattacagcatgctaaataggattctaatatttaaagacataatttttttgttttgttttttattttttatttttgagacagagtcttgctccgttgcctaggttggattgcaatggcatggtctcagctcactgcaacctccgcctcccgggttcaaatgattctcctgcttcagcctcctgagtagctgggactacagttgcctgacaccacgccccgttaatttttttgtatttttagtagagctgaggtttcactatgttggccaggctggtctcgaactcctgatctcgtgatccacccgcctcggcctcccaaagtattgggattacaagcgtgagccaccgcgcctggccaagacattggtttttaatataacatgcaagtcaccttcttaatttgataacagtgatttttttgcaaccctagaagaagaactgggcatattgggtatatagagactcagagttggccttgaagaaggtgtctttggaaattttctaggtctgtcatacagcgttagaagtcaaatgttaaaatctaatcttcagccaggcgtggtgcctcatacctgtaatcccagcactttgggaggccgagtcaggcagatcacctgaggtcgggagttcgagaccagcctgaccaatatggagaaaccccgtctctactaaaaatgcaaaattagccgggtgtggtggcgcatgcctgttatcccagctactcgggaggctgaggcaggagaattgcttgaacctgggaagtgaaggttgcagtgagccaatatcgtgccattgcactccagcctgggcaacaagggcaaaactccacctcaaaaaaaaaaaaaaaataataataataatagtaatcagaactctagatctgggaataaccctgtatctatttctttacatttttctttcattaatgtatttatcactattttttttttgtttttctttgcaggcctcagctgttgaagaacgctctgcagagagcagtagagaggggccagttagaacagataactggcaaaggtgcttcggggacattccaggttagagatcagaggcctggttgtggagaagtgcttcttaaagtttttggtttcaggacctccttatactgtaaaaatttattgaggacctcaaagaacttttgtttatgtgggttatatctgtcaacatttactatgttagaaattaacattgaggtctgggtgcggtggctcacacctgtaatcccagcactttgggaggctaaggcaggtggatcacctgcggttgggagttcgagaccagcctggtgaaaccctgtcgtctccactaaaaatacaaaaatgagctgggcgtgggggcacatgcctgtggtcccaactacttgggaggctgaggcaggagaatcacttgaacgcgggaggtggaggttgcattgagccaagattgcaccactgtgctctaggctaggtgacagagcgagatgccatctcaaacaaacaaaaaaacacaaagaaattaacactgaggaaaaatttaaatatttattgatttactttaaaatactagtagaaaacccattacatattaacataaatgacatattttttagtgaaaaatagctgtcctccccctgccacctcccggccttttttttgagacagtgtttctctctgtttcccaggctggagtgcagtggcacaatcacagctcactgtagcctctatctcccaggttcaaggggtcctccagcgtcagcctcccaaagtgctgggattgtaggtgtgagcctataatccgtcttccccaattttttttttttaatgagaagtcgtcaggcactgtttacatttttgcaaacatctttaacatctagcataacagaagacagctagtatctgttccagtttattttgggttacttatttgaagaaaatctaaccttacacagaaatacaattagaaaaggatggaatattttaagataactttgagatagttgtagaaattattctttgatactacaccaaaactcaacaaatcgttatttttttaacagctttattgaggttgatttgcataccttatacaatttaatttatataattacagtttataactcagtgattttcagtaactttatagaattgtacaactatcacagtccaattttcggacatttctgtcacccaaaaaagatcccttgtagccatttgcagtcactccctattccaccagcagcctcaggcaacctctagtctgttctgtctctctgcagatttgcattttgttcacatttcatatggatagaatctagaatcatgtactatatgatcttttgtgtctggcttcttttggcatgatgtttttgaattttatccacgttgcagcatgtaccagtgctttcattcttttttattgtccaatagtatttcattctatggatgtcacattttgtttatccattcatgagatgatgatggacatttggattatttctacttttcagctaattatgaataatactgcctatgaacatttatgttcaagtctgcgtggatatgtttttaggacttgctgggccatatggtaaatttatgttctaagaaactggcagtgtttataagggctcaagtcgttttgttttgttttgagatagggtctcactctgtcacccaggctagagtgcagtggtgtgatcttggctcactgcaacctccacctccctggctcaagcaatcctcccatcttagcctccctaatagctgggattataggcgtgcaccaccaccatgcctgattaatttttgtattttttgtagaaatggggtttcgccgtgttgcccaggctactcttgaactcctgggttcagtgaagtagtctgcctgcctcagcttcccaaagtgttggaattacaggtgtgatccaccacacctgaccagggctcgagtttctccatatcctcctcaacgtttgttactcttttttattatagccatactagtggatatagggtatctcgttgtagttttgattggcatttccctaataattactgatgttgagcatctcttgtgcttaaggccatttgtttattgtctgtagtgaaatgtttattcaaatcttttgcccatttttaaaagggggttggttattcgttaacaagaattcattactctagacataaagtctcatcagattttttctcctattctgtgactttctcagtagtatcttttgaagcgtttactttttgatgaagtcctatttatcatttttaaaaattgcttttgcagttttatggttatctaagaaacattgcctaattaaaggtaatgaaaatttactcgtacgttttaagagttttataattttggctcctacatttaggtctgtgatctatattgttttgtttatagtgagaggtaagggtataatttatctttttgcatgtgggtgtgtgattattccagcaccttttattgaaaagactgtcccttccctattgaattgccgtagcatcttatgaaaatcaattgaccataaatataagggtttatttccggattctgagttctcttttgttctgtaggtgtatccttcatgctaatactgcactgtcttactgactgtagctttatagtgaattttgaaatttggaattataagccctctaactttttcaggaatgttttgactatgccgggtcctgtacagttccatacaaattgtccatttctgccaaaaaaaaaaaaccaaaaaaacagctggagttttggtaggaattgccttgaacctatagatcaatttggggagactcactgtcaacaacgttgagttttccaatccatgacacagaggtctctttatttaatttctctcagcagtgttttgtagttgttcggtgtacgagtcttgaattttttttgttaaatttattgccaagtattttattctttttccatgctgtcttgaatggtggaagtgttttctaattttcgttttcaggttgttaacgctaacctgtagaaatacaatcgatttgtccattgctcttgtatccttcgcccttgctgaactcaccagttgtagtagtttctttgtgaattccttacagttttctacatacaggatctgttatctgcaaataaagagcattttacttctttgtttctagtctggatgtcttttacttcttctgattgcctgattgctctagattaacctccattacagtgttgagtagaagtggtaacagcagacatcttcgccttgttccacatcctggagagaaagcattcagtccttcacaagttagctataggtttttcatagatgcctattgtcaggttgagcaagttcccttctatatatactactagtttcctgggagtttttatcatgaatggctattggatttgtcaagtggtttttcagtgtctgttgagatgattgtgtggtttgtgtcctttgttcgtgtggtctgttaacattatttgttttgtggtaaattctttaaagtttagttgccatgtgaaacctgaaaccctaatcagtgaatttcttggactgtgttaccttaaaattcattgaactttgaataggtattttaatccttcataattttgtagcacgatacattggtcatttgaaaaatagtggcacagagttacatagattttccaaatgttggcatttcattatatacgacaacaaaaattacaatcattggtgttggccactgatcttataagaacagtatttaagtattgggaagataacagactcacagtgatggacacaagtttttcaggatttaaattttctcttgaaaggttgaattttatcattggcaacaaatactattatttttttacatgacaggctcttttagttcatttgcaagatactgtctacctcataaccaagtctgaataatgataggttagctgtcagttatttctttaagtaaaaaagtattacaggtcaggcgcggtggctcatgcctgtaatcccagcactttggggaggccgaggtgggcgaatcacgaggtcaggagatccagaccatcctggctaacatggtgaaacccaatctctagtaaaaatacaagaaattagccgggcatggtggcacatgcctgcaatcccagctactcgggaggctgaggcaggagaatcccttgaacccaggaggcagaggttgcagtaagccaagatcacgccactgcactccagcctgggtgacagaatgagactccgtctcaaaaaaaaaaaacgtgttccaagaaaaatgcagctaattcagctcataactttaacaattacacaagtgcttttcctggataccatcatgtctacatatgtagcagatacggattatgtggttcttcctgtttcatcccataaaatattctaaagacattcaaaagttgagatttaataaaataatttttagtactttatcaagggcattctaagtgaattcgtgctcttttttttaaaccataagtacatagcagtaaagaagacaataaccacatttttgtgtctctgcctttatctgtggtaagctgacagcagttttacccaccattgcttctgcaccatcagtgcaaatgtcaaaatagtgaaaaggccaggtgcagtggctcacacctgtaatcctagcaatttgggatgctgaggcgggtggtttacctggtcaggagtttgaggccagcctggccaacatggtgaaaccccatctctactgaaaatacaaaaattagccaggtgtggtgggcgcctgtagtcccagctactcgggaggtagacgcaggagaatcgctggaatccgggaggcggaggttgcagtgagccgagaccgcgccattacactccagcctgggcaacacagcgaaactctgtctccaaaaaaaaaaagacagtgaaaaagcaaatcgcatcttaggtttttgtttgtttgttttttgagatggagtcttgttgcagtgagtacagtggcttgatctcggcttactgcaacctccacctcccgggttcaagcgattctcctgccccagccttgcccaagtagctgggattacaggcatgcaccaccatgcccggctaatttttgtatttttagtagagatggggtttcaccatgttggccaggctggtcttgagctcctgacctcagctgatccacccgcctcagcctcccaaagtgctgggattacaggcatgagccactgcgtctggcatatcttagttttattatgcaaatagttttgaccttgcagatcctctgaaagggtctcaggaacccagacaattgtaaccagaccattctttaagaaccactaaacagttttgtagagcatttctggttttctccttttccctttttgcatattatttgctaacctttgttaccacacctttcattttcaaagtatgctatgtaattttcttttgtatgatacttttttttttttttagtttattatttatttttagagacagagtcttggtctgtcactcaggctggagtatagtgatgtaatcatagctcactaatagcctcaacttcctgggcttaagccatcctcccccctcaccctttcatgtaggtaggctacaggcatgccgccattcatagctagtttttttatttttagtagagagagagtctcactatgttgccgaggttggtcttgaactcttggcctcaagcagtcctcccccattagcctcccaaagtactgggattacagatatgaactaccgtgctccctgataccctaaatatttatcaaaatttttcactgctattttcctcataggattaaaagggctatttattattttttataactacagctgacccttgaacaacataggggttaaaggtgcagatcccccgtgcagtaaaaaaaaaaaatcataaaaaactttagattcccagaaaacttgactattaatagcctactgttgaccggaagccttacaaacagttaatacacattttgtatgttgtatgtattatataatgtactcttataataaagcaagctagagaaaagaaaatgttattgagaaaatcttaagaaagaggaaataatggccggccacagtgggtcacacctataatcccagcacgtcaggaggccgaggcaggcagatctcctgaggtctggagttcgagactagcctggccaacatggtgaaaccgtgtctctactaaaaataaaaaattagcgagacctggtggtgggcgcctgtaatcccagctactcgggaagttgaggcaggagaattgcttaaacccaggagaccgaggttgcagtgagctgaaaccacgtcattgcaatccagcctgggcaacagagcgagactctgtctcaaaaaaaaaaaaaaaaaaagagagaaaatatatttattgttcattaagtggaagtggatgatcgtacatgtctttatccttgtcatctttgagttgagtaggctgaggaggacaaggaggtgttggtcttgctgtcttggggtggcgggcagaggcagaagaaaatccacatataagtggaccagcacagataaaattgtgttgtgttcaagggtcagctatacttcatttttcagattcagaaaagtgaagtattctcaaataaaataatctttttttttttaaatttattttatttatttatttttttagacagaatcttactctgtcgccgaggctggagttcagtggcatgatttcggcacactgcaaccccgcgtcttgggttcaagtgactctcctgcctcagcctcccaagtagctgagaccacaggcacctgccacacctggctattttgtgtgtgtgtgtgtgtgtgtgtgtgtgtgtgtgtgtgtgtgtgtgtgtgtgtgtgtttttagtagagacaggtttcgccatgttggccaggctggtctcgaactcctggccttaagtgatctgcctgcctctgcctcccaaagtgctggggctataggtgtgagcacccagccaaaagaatcttaatttttagggacataactggttaacctgcttattgggtacagttgtcagtatctttgggttaggttggctattattttagggtggatggagggtagatggaaggagaaaatatccataggagggttgggacttctcagttagattgaatacctgttgaatgggaagagaaagtccctaagctgacaatttattgtaaaacatatctgtgctaatgcaggaactccgacccacctggtgcagaggagtcttgtcttgacctgctttgggagagtgttgtcttgatgcttttctcttcctccttggaaaacagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaagtaagactcggttgtgtatatttaactgggattaggagaattttcttttgaaaaaaccgtggagggccaggcactgtggctcacgcctgtaatcccagcactttgggaggctgaggcgggtggatcacgaggtcgggagtttgagaccagtctggccaacatagtgaaaccccatctctactacaaatacaaaaaaattagcagggtgtagtggtgtgcatctgtagtcccagctactcgggaggctgaggcaggagaaacgcatgaacccaggaggtggaggttgcagtgagccgagattgcaccattgtactccaatccggacaatagttgcgagactatgtatcaaaaaaaaagaaaagaaaagaaaagaaaaaaaaatcatagagatcatgctattaatgtcaaagtattaactactgactgaaaaccaagagggaacagctttacaaatttcatatttacaaaaagaaaaacaaataatcaaaactgaattcttaatttaaagcatctgcttataagaagttgcttttactgtaaagatttttctgatatttattgtaatttagataaatctctaggttcaaagcaactctaaattatagtgtattttttcctacttttgaatgttcaccaaaaacatctaattttactttgaaacaaagccaggattttagagtacttactacttatattatttcttattaacctaagccccacaacagacaatactttatttcagtaaagtatatttactctaggaggtggtgatttgagatgagacaccctgccttatcagcattatcgtgtggattggtgagactgggtgacttctcaatgaactattagaagaggcacaatgttgtagggtgagggatatggaaattaagtaacagaagaagacaatccagaatatattattgtaattaaaaggtaattttgaagtctttttttttttttagacggagtctcgctgtgttgcccaggctggggggcgcagtggtgcgatcttggctcactgcaagctccgcctcccctgggttcacgccattctcctacctccaccccctgagtagctgggactacaggcacctgccaccacccctggctaatttttttgtttttgtattatttgtttttagtagagacagggtttcaccgtattagccaagatgatctcaatctccttacctcgtgatctgccggcctcggcctcccaaagtgctgggattacaggcgtgagccgccacgcccggcctatttctatatgccagatgttttaagagaagatgaatttggttaacaagcctttcagtttcactgatatttgcagctgttttttggatactgaatcaccataaaatatattttggatatgtctctgtaagaaagatgagaatgaaggacttcaggaaccatgatattgttttgttactgtttactgatttatgaataattagttctgttcatctttataagagattctcctagatgattatcaatacctataggtacacaatagatgtttaagtgaatggaaataattaaatacttagttttaggtctgctgtttatgtgctaccttagagcaagtcacttaactactttgagctcaagtcacttaaccactctgggctttttttttttccctgtgaaataaggtatttgactcaatggtctctaatgtgtcttttcattataactcttgccaggtatggtggctcatgcctggagtcccagcagtctgggaagccaaggtgggagtattgcttgagcccaggagtttgagaccagcctgggcaacatagtgagactttgtctctatattttgcaaaattttaaaatatagatatatgtatgtatgtatgtatataatttaactcttgccaaacttatgggcaataagtaaatgtttaattaaatacctttgaacacataggattcacttagtgtatgtcaattaccgtatgtgacaggatattaaattgatgggcatctgtttgtggttgagggaattatctaatctgaataactagataactttcatttctgaattttttttttcagtgcatttgctgaaaaaaaccctgcagaaatgcgaaaagaatgggtggatggaacagatctctgggaaagggttcagtggcaccttccagctctgttttccctattatcccaggtaagtacttagcctataatagatcactgtaaatttatagtctaagttacacactcagtttaatttattttacccttattactgttttagtgaactggaaatacagtcgtcctttgttacatataggggattggttacagaactgcccgcatacccaaatgcgcatgtactcagccctgtggaatccatgtatctgaaaagtctgtcctctttgtatgcaggcttcgcatcctgtggatgttgtatttctgatctgtgtctggttgaaaaaaaaaagtccacatataaagtgggctaatgcgttgccaacctgtgttgttcaagggacaactgtatttgaaaataaagatgacttttaaggcagtattattttggagtaaaaggttttgtataaaaatagtgattttagccaggcataagattatttgagatcctcggatggtcattttgatgttcattccttctttatcaagtaaatgataatgacagattcttagaggattatgtataagtttttgtttttgttttttgagacagggtctcactctatcgcccaggctggagcagtggtataatctcggctcactgcaatctccgcctcctgggctcaagtgatcctcccacctcaatatcccacgtagctgggactacaggtgcgcgccaccacacccagctaatttttgtgttttttgtagagatgggggtcttaccatattatctaggctggccttgaactcctggctcaagcagtcctctcgcctcagcctcccaaagtgatgggattatatgcataagttttaattgtccaataccaagtggggagaacattgactgttttcaagaatcttaactctacctccatactgtagagacaggaacacttatctgaaaatttgtttcttgcaaataccttatttattctttgaaacaaaaaaatatattgatcacctcctgtggtccaagcattgtttcatgcactgggtttaaagccttttgatttccagtaaagtacataacatataccactaagaccctgttttagcaagactattgtgtaactttcttatattattatttctgtacaaacataagtgttacttggcttaatacatattatataaatttttcgaacattaaacattaaatttaattcccaaagtcacacacacacaaaatgttacattctgccaggtgtggtgggatgcacctgtagtcctaactacttgggaaggtgaggtgggaggatcccttgagcctaggagtttgattccagcctgggcagcatagcaagaccctgtgtctgaaaaaggcaagaaacacacacacacacacacacacacacacacacacacacacatatatgtatgtatgttatcatttaaggatatgttaatcaaaggaatcaaggttcataccaccaaggacaaaaaagagtttaggagatccttgccgaatacctttgaagctttgaacagatttaggcctttgaggtctttttttttaagacttggaggtcttttgccagtattatgaggctgaagtgtgtattccatgcagactgttcattgctgtgtactcattggctaatacagtgccagatacatattaggagtttaagtaattgtttactaaataaatgactatggattaattttattaaatagtgggtatagaattaggtatggtgcaggacttttatagatttggcataactttatatgtatgttcaaaatacggtaaattgtaacctgatacgtgtaacctagcttgacatttttgggaagggtgggaagaagtgggatatgtccaggtaagagcatctaggttcacattatttttcttgttttatatgggacttgtgttttaatctaatttttccccgtatagcccaggagttctgtttccgaagaaagagccagatgattctagagatgaggatgaagatgaagatgagtcatcagaagaagactctgaggatgaagagccgccacctaagagaaggtgtggacatgtgaaaaccccttgtggggaggacactaaatacctcagagctgaaaaatagtgctataggaggggctaaagctaaaaagcatttcagaaactcaggatccttctcaagttctttatataaatttggattgatcttctcctttgaaaatcaagggctccagacttttagggcaagcctgtgtgtatccatagtttagttattcaaagaaaaataattacatatttccctaggaacaacgtcatgaaattgtgtctagacttcatgaattggttgaatttttatacaattttagtaaaatctctagtaaaaaattgtcacattcctattcttaacgtaagtgaccacttcatatgccgtttctctttagaaagcatctggttgtcccaacaaaacgaatctcttaagtactaaatgacggcctttgctctttggttctcacaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaatttt

SEQ ID NO: 38615 - DNA, 27858 bp, Homo sapiens
tgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggctgcgccagccgtcgggtagaagtcgggcgtcggtctgtctgcggggccgcctgtgtccgtctttccgtccgattgtcggcaggactcgctttcaggaggacctggctgcattcaggacggtctgcccgttcgttctccactggacatggctcgctttctctgccttttgggtccttctccactttgagccctcggggctactctgggacaagcaagagctagagctagagatagaggagagggcggtaagagagagggagacccccgtagcatctgagcgagcctggaccaagtgtccagctccaacaacccgtagagggcctgggacccaacggcgagggggcaggaggaggccaccccgccggtgcgcacgggagccgctgcggggatccgaggcctctgggacgtcgccgagggcttcacagtgataatcggacgatcacagcgcacgggatgccgcctggggatctgtgtgcactatctgcaggcgcgcgcctggccgagggtgcgtgcgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagccatgggctccgggcgggcagggttccgcacagctcttcgggtctggttcttctttcctcaggctccgcgtggagccctgggcctggcagacacaagtttctctccctcccatccccagaccatcgagaacatcaaggtggggctgcatgagaaggagctctggaagaagttccacgaggcgggcaccgagatgatcatcactaaggctggcaggtcagcgctgggagatttacttccggggatggcggtggggagcaaggggggccagggaggtcccttagaagtcctctcggccccggcctggtggcctgtgggaggcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtcccagctccagcacttttggccccctggggggctgctttgccctcctctctttgaggacctgaggaggtttctcaggaatgcattgattggagacccagagatgcctctcagcagatggggagagggaaatagactatgctgttcagttttcatacattttcgtgagtgactcgaaccccaagtttttcatcccaggggcgccgctcttctgtttccatccccatctctggccaacgggaaagcactacgttgggctccgtgtgtgttgttgggggagcggctctcggtggctgccagaaaaggatgatttataaagtggaaacatctttaaaatgcgctggtgtctgtgggagagaacagggaggagaggatgagaggaggaagactcacggcgggggtgggggtgagtgagagattcgctggggctggtggggtgggggcaggagtgtggaggagaacggttatcaggtgaaggtggattgctgtagacagagacgctggcaagttcaggttcaggaactccctccccacccactctatcccctgcacatacacacacttgatttctgtccctgaggacagattaggtgtgaaaatgtccctttgcctggatgtgtctcataattgggattttgaaggaataagatgatgaaggctcaagtgccaggaatttggagtcagaccacggtgggtgagggctgcagttccaactcagctactttcatctgtgcaacctcagacaaggtgcttaatggtctctgctccctccccactccatctgtaaaagaacaggtcttgcctcatacattgtatgtaaagcaccaagttcctgtcacatgcaagcacacaagaagtgctagcgaataatattagcaataattagagaagtgtctggcgtcccactcagtattttcttctactttttagagaactcagctctgctgaaccacttagtgaatgatagactattcaaaggaaacaaaaagccggctggtttgctgtgtgcagcgtatggggtgctgtggtccttcctctctgctccctggcaggccttataaagtttcctttcttttgttgagggtggaggtctgggcacttggccaccctcaggccttagccagggaggtggcatcaccactcagggcctctatcaggagagaaagtaggtttagtttagggcttgagcttgctgtattttggggatggagatagggaaggaagacacatgaaggggctggcagagggtgcgacatggagcaggcattgaggacagtggaagccaggtgtcacaggccctgcctctttctggctgagtgtacttgggcaagtcacagtctccttgtagctcagtggtgtcagggaaatggtgaccgtagacctatctgctgtcccttccttttctatcactgtgaaactcaaaccagggaatcacgtggatgatggttggtaaatggataatccacttgatcaagtgcgaaggggaatggggctatttcttgtgcctgctagtgtggaaagaaggtaagaaagagaaaggttcagaactgccatttttaggcagcagaaataaccttgtctcttgaaaataactggccagcatgttctctgggcatgtctggcctttggcattttaaacaaagggcatttttgtttgtttgttttcctcagtagtgtttcctgcatctgcatgggtcctcctcctccctctcccaacacatacacttatacacatacttccataggtggccagcttcaggcagatgtttgtgcttgatcctagttgaggcttagagatggaccttagggaattatgataatatttctaaaatggctgtgatgatgttggccaattatggatccatcacagcctttcacttctctggcagaaagttatccttgcactgggtctggttcttaagaaaatcactagtctcatgcccccaacccctcacccctcacagaccccatttcctccttcatagctgcccccctccttcagcaaccactgtattgctctgatctacgttactcaggctgtggttcttcaacatcctgtccagtgcctctccctgctccccaaattctgtgtgcctctactggaacccttcttggtacacgtccatttgtcagcctgggccctgctgctaaacctggaatcatagcttcctagatggctagagctggaggagaaccaagagaacgtaaaccaaaccccagagaagggaagttaggcagttaccaggtccacacaggaaaacagatgagacaccccacccccagaacacagcccctactttgataagttcccttgattgcttttttacggggtcctattcagtgtggattgtggctctgccctagagaccctggctgattagggacacgataactgccatctggctgggtaggagcaggccctggaaaaggggagccagaatgttctcaagccaggttgagttctcagatcacaagtttccttcctaccttagccctttgggtccttgagagtcttgaaggttgacagagagaagaatccctttcactggatagtgactttgaactgccaaacaatttggcctggtggataaaatgccaaccacagtgggagccaccagtttctgaatactcagcgacctccatgtcaggtgtgaaatgggggccacagccctccgcagcccgtctcagtctcttgggtctctgtgtccagagggttcgtgctgatagccgcagacagcagatccctctcttggcctccccacatccctgccaagcttgatacatgtgagaaactgcattttctcccaaacatagataaaagtgagctccacaaaaaaatttaaatataaacctccccaaaatgaaaattgcctaactgtctcactgccctactcctaggtcagggttttgccaccagataaatctccactatcagccttcatagcctgttgagttcaatgttgcttgtgttagtgacagtgaatttgcgtttgaaaaatgaactaccgatgagaactcctgttgaacctgtattgtttgttattctgaggcaaggatttggcccggcttaatccggggcttcaaagccaattgccctcactctgtatacagagcgtcagagcccagtggcgtggatgataagagaagtaagggttgaagacactgggaaagtgggttggggagagagtgctttgatctctttttaaagtattttctgaaagcaaaagtctatcagaaggaagtgcctttaaaaaaaatctaagagaagcaaccgatcttccaaaacaacatccattccacacactctcacccctgcccctccctcagggaaaagatttcttaaatatgctttgggtgaattagaaaactgtgtgtgtatgcctctatgtatgtgtgtgaaacgtggaaatcgatttattatcttcaaaatcagaactcacttggctacagaaggcttggtctcagtgtaggtggcaccagcagccccactcctaaccccagccttggatgctgggccctggcctcttccccgtacacccaggattcctcctgaaaagcccccacggacatcagggttggagaaacaaagggttttaaggggacccctgccatttcactgctgtagggttcttttcagactctgagctccaaggcgcctgtgtatgtgtacacacatatataatttttaacctaaatgtattgaagtggaacattcctacagaagagtccacaggtcttaagggtgcagctttacagacttgcacaaaataaacacactcgtgtaaccttcatccagataaagaaatagatcatcaccaccaccgccccagaatccttcttgtgtgcctgcccagtcagagccatccccacctttgaaaccgctctctagacttctgaccccttctggctggtgttcccctacattaagggagggtccgtgtagctgttcctggagtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcccctggcggagccgtttccgcgtgtgccgtggggagggcgggggagcccccatctgtctgggggcgcgggagcccgacggcgcgaggggaactgggggagcatggagagggcgcttggggcgcggagagaaggtgcggggcacgtggaaagcgtgccgaggggctgggaagagggagggacaggaggacggggtgggagcagggagagggtagggggcatagggagagggtgcagggaggggagagggggagcgcgcaaggagggggctggctggggcggacccagaggtagagcgcagagtgcccgggacaggcgggcttcaccgccagcgctggtggcagggcctgcgtggacacaggcggcacacacagtgtcttccttcttggtcacctcccccaccccaacacacaaacagggaggcgttgctttccaccgtagggtgttggttttcaggtacattctatgtcataaatcacagaaacaatttacatctcactccatcatttcaaacctttcatgagagaggcagagctcacaggaagtcacagctcccaaacccagcctggcctctgtcgcctgaggcatgccacgctggggaacacccccaagtcaggcgtctaggcaccaactttagtcccttcaagaacccaagggcagatgcccaaggggccttgaattctcccctcgacctgggcaggaagccaatggaggggacagagggggcctcactttcacaggcagccctttcccaacgctgggtggacccttcctccttctggagccacctaggcagggaaacggtagtgcttagggccccccaccccaccccagagtgggttctgcatggctcagaagcagtcccccaactagaccctgccaagacctagacatctgttgcattgaaggcaatggaactccctgaggcagttcaggccacagcagagggcttttgaactccccattcagaccagacatcctacgtccctgtccctcggcttctgagcgctgctgccttaggtagaggggaattggtgggcaggggaggcgaggctgggaggtactccccttccctgtgccgacgcccacatctccttatcagtcaggaatctggcctacgatcagcttccagcaggggccaggtcccaagacaccagctggggctgcagagaacaggctcctcaaaggccttccagaaagcacttagttagtgtcagcctggccccctgggctgtggaaatgaagcccagcagggagaaggagaggggaaggccagggccccttagcctcctctcagcctaggctatgacgcgtgccaaagtggcagtgagcccttcgctcctggccccctatgtggacactggccctggagggaagccatggctgccctctgctgttgccacctggaatgatgacaggaaacaagctgagtgcaggcccccggtgccaggccagcccaagtatggccagggctgccccattttgtggctgtttctgtggcagttacaaaatggtggcctgcagggggcgggattcttggccttaccccagggaagggggaggtgaggcagctgctgccctccctgcttcagctgttggcccaccaggagagaggcagggccgggaaagggtggtgcaagatccagctgcgcccccaggccccataggggggctggtaagcaggaggcagggttgggttcctgagcccctcacttcccccattcctggagagggggtggggtgggtatttgaaaatgctttcaattgacatctgagacaaattcttccacaaggtttataagtccctagacttgcagctagaacttccctcctccctccaggcacgcacacatccacacatgcgcacttgcacaccgctcacatgcgcctgggcacacacaccccacatccccacgtccccgccctgcagtgcttgcacaggcctctcctccagcaagagaggggcacaggcggggctgggtggggcgtgggctggcaaggaagtgaaccctccacctcggtcggggtcctcgcctgggcttagggcccgccagcttatagaggccttgatcctttctggaagccctgttctgtccaggtaagctggtgcccctggtgacaaaataggggcctctgatcagctgtttgtggcatcttggacagcttctccagggtcccgtactgtcttgggttagtgagaggcagagaaccacctgatggttgtcccagagtggaccagccgggcagtggcacagctcagtggggcttagtgtcttcactgtgtcttcagctaggtttggatcctgtttctcttggggaacacctttgtggaagatcagctggggtgggggatggagtctgaggaggatcgtgggaagttccgttcttccctctggtgaagtcagggacctagtgactaggggagggagctgtgcccagagcgtttgtgtatgcgctgtgctgttgtgtgtgcgtatgtgctgaggggtgtgcggaagccccctctagaatgtgcctcgaacctcagggcccttgacagcctcagcatgggctgcaggaaatgacaaactttctgggttttggtgaatccattttcacagaagtaggtcataccacttctccatttactttgctgagggaggagtgcagcaggggtccgtggtaattcacgcagcaatctatgagataggtggtaatgttatcctcattttagagataaggaaaccaaggcacagagaggttcaagcaagttgcctaaggcttatcagtggggtccaggctgtgaccatggcaggtggtttcagaatccatgccctctcttatccatgaggctcctggaccgactttcccctgatactcagggtgcacaggtccaggtgaggtgttcacagggagaagtacccccgatagacacactggaagaacccaaacctagcagggttttggacagcagtctcctgttttcctgcaagctggttttaggcctaaggatttccacagaggcatgacccagaggaggcagctcattatttatggaagcagctgacgggggtttccgtccccctataactgcaccccagaacttcacttgtgtgtgggctggcaaaggacaggagggaaattaaggcagcaaggttggcgtcagaatctgctcccacaatcctgactggggtctctgtgcttcagctgctcatgggcactagccccaagtcttaggggattatgggggaggggataagtgaatttgggaaatggtgtaaactctcctcctagacacagactgatagctgcaggggctcagagacagcagccagtgccaccttttcactgtgcagctcgggcagagggggaagtgagttgtgcaggtcacacagctgtgaccaatgccaggatcgctggccaaaagggcagcatctgttagcggccttctgcccccttgctcactctgttccatctctcctggtgctctgtccacacgctccgcctcacccctcggctcccccaggaggatgttccccagctacaaggtaaaagtcacaggcatgaaccccaagaccaagtatatcctgctgattgacattgtccctgccgatgaccatcgctacaagttctgtgacaacaaatggtaagtggaccctgaccgcatcacccacgttccctcaactgcccacttgccacgcccccacctagtgttttgtccgggggatttcttagctacctgagtgactgcccaggtctgcaggctggagtccactgcctggaactggctgtgcggaggctgaggtggtcagcgaatgtctgcatgcctgcttcaggtggggctgggtttgggctgaaaagcagctgcgtgtttgggagtttggtggatcgcaagggtctgtactctccttatggccgtgggtagtcaggacttggtaactatgctgtcaggtgacagacaaatcattaacactggccagatttagactgtcagtgcttcactgtggggaagatgggagcagttctcttggggactttaagggcaagccattacctgctgtgtgggggcactcgcctgtttctccatgttctccttggcttcaggcccctccagccatccagacgaagtgaggctccaccagggggttggtggatgggaccctttggcaaggggctgggagacatagagaggtaaagggacaaaaccaaaaggggccaggtaaataaacgctgggctacctttcatgaagccaactccttagtccctgactgcctgggagctcggaacagcgctccaggagcgagcagccagccaggacactgggctccgtggcaagtgagccacagagctggagagattgggccgagcaggcaggatttggtggccacgtcctggcaagggccatgtttctgtttcttctccctctctgggctagaactcagagcaggctctggctgcggggagagctaccaattaatttcttaccattgttttggggacaagccttttgagagttgtctaggtcctctgagaagctccctctaaataatataatttataacatgtgacaatcataatcataccaggtgtagcggctcatatctgtaatcccagctactctggaggcagaggcaggaggatgacttgaaggtcaggagtttgagaccagcctgggtaatatagtaagatccttgtctctgtaaaaaatgtaaaaagttaactgggcatggaggtgcatgcctgtagtcacagctacttgggaggctgaggcagaaggattgcttgagcccaggaattggaggctgcagggagctatgatcataccactagcatgggtgacagagtgagaacctgtctcttaaaaagaaaaaaaaattttaaatcataagtgtaaatatacatagaagtgcctaaatctcctcacaatatctttgtgattagccccagtccttcaattaaatgatcccatttccctgtaacctcccttttcttttctactgcagtaaaataaaggagattcagaactgctctctcctcctcagcattctctcctctgaacctcacactcctacccttgaagtactaatttgacaatgtggtgggaccagcagctattttttcctctggtcaatgggggtttgctccaagaggggacggggaatctggcctcaccagcccctggagtaatcacctgctcttatctgctctgttggcaggatggtggcagggaaggctgagccagccatgccaggaaggctgtatgtccacccggattctcctgccacaggagcccactggatgcggcagctggtctccttccagaagctgaagctgacaaacaaccacctggacccctttggccatgtaagcatgggggctgcctggccccaggaggcaagtctggggcagttttaggggtgggacaggccaggatggggatagggagaatccactccgggatccagctccaggctttggcgctcactgaccagtttagggaaggagctcaagcctctgaggcctgcagagagctggacttccttcccggccacttactggctgggtaactctggacaatcgtctcagcctttttgagcctcactttccttgtctagaaaatggagatgaccacatgtacctttcatggctgtgagacttaaatgagagggtttaccggaagcactttgcacgtaggaggggctaaataaatggcagctatgatgataaaggtgacgggtcagatctcagcttcagttccccaaaatcttgccttgctggaacataacacaagaggggtaagccttttcgagcgagagtcacggatatgttccaaagcccctctttggtgtgtaccgtctgcctggcctgacagccgcctgcttctgggagaaaagaccttgctctggctcacatgttagctcctgctggatttggcctggtccttacagaagagattctgaagccccagggatgctgctgacgccccatccaggcagcccaagctcattctttccccatctggccctggaaagtccacaaaaaagagatttttatgtggaaatttttagctcaagtgtgtggcaaacagaagtctggggacctggtactatctgccagggcacaggcccctcccctcgagactgcccgtggtttctggggaagtgcagggcaggggcagtggaggctttgagatgcaggtgtggctgttggggttacgagatgtgcaggtatgtcccgcttttacgtcccagctctgaagcatagttcctatggaaaactccagccatgcttcttttctgattgatgggtatgtaactggcattgagcttctagttttaatttctcagaatctattcagttcgcttctgagtcattggtgagctataaacaagcagctaggagaatgtttaattaatgcagtcaactcctgacttatcttatctggtttgtgagtccctttgctgggtttcccatacagggcaggcagattcccaatggggaggatcagccaagttcccacctccccgagccccaaggcatttcagctgagaggcagaggggcttcctgggtctccctgggcaccatcctggtcaagactttgttcccagtcaactcctacccaacttcctatgcttggccaggctgtggcaccagcctcaaagggtagggagggtctctgtgtggggaggctagggaacctggcccacgacggcacacacacacagaccccatggggggcgaatacagagcttgtggggagctgcatctttgggtggccatttgtccctagagatccaaacctggagaggattttggatgagccagcttgttgtcagggctgccagctgcagggatgtctcagaggacacctctgcttccctgacctctagaaagtgagagcagagggagttaagggctggaaagctgcgccttctttaggaagtgggagagagcgctctggccttcacagcccagcagtagcttttcacagcctggctaacctcttcagtagctctccctgggtctgtgagtggtttgtgataaactgcatagaagtcagggccagtgaggctgcttgatgggcttgtgatgctgggggtgcccctggctgcatctgccgtgcctgcctggcgcttcccttgccttgatgatagggatactacccacaggaactcagctttttccctggatgagtgggacgcagagcatcttccttctcccttcatccccacacttacccagtacttgcagtttattggctacaacagccctgtgggtgtggcagggcccaggtaccgtctcagacccaggccttctgcttccaggtccagtgtctctgggcttctccactgcctttctgtacccagggctctcgctgcggtatcttcacctatttagagaacccttgaagagggagcagcctctggccattcagacaagggctgtggagagacatatcagggcacagcaacccatttggacattgattttcttctgcctcttggcccgtgcccgtgggagtggtgagctcccattgaaggatgaaggagtcacccttcttggcttctcagtgcaagaggctggggaaaagccacgttgtattgggaattgcccttccttctgcacaaccacttctacgttttcagcttgccctgaaagcttccaggcctcaagggactttctccagccacatgggcttggacttttcttggggatcctcacggtatcccaggagcttgagcagctgcctcctattggcagccctcacccccaactcctgcccaaaagggtgggctctctcctcgcgaaagggcaagttgagagctcatgagagtggctgtggtatcatcttggggtccaacaggtggactcagtgtccttctagcctggagatccctgggcccaagccatcccatttcctcatcccaggagatgagcagggtggctcatgtgtctgcttgctggtgccttaaggcttcaaagagcaggaagccctgactgtcggggagggggtgtggaacaactattttgggataatccgggttttcctatcattcaagattcctttcttccatgaatgctgctcttctctgaagtctgaggaccttagattgaagtcttgggcctggtagcctgtcctgtatggcacatggggccctggaacaggaacctctcagaccacatggccagaacctcctaaaaggactgagctcccactagaacaacactccttgtgggtttttgctgtgggattaggaaagccttcacagcagaaatccacaaggaattttccagtctgaaccttggaaggcaggttcaggagggcagattcagacctgggcgtcagctccagtcccgaggttgggccaggcgggagcagaaaggaccaaggggctggggctggatgagctgcctccaggtggcctgaattcagctttgcttctgctgttctgctggccacagaagctgcctgcccactgtccctcctgcctgccactacctcccacgcccagcagggtcctgtgcccggcgactatgagatgggaaaggaaactgcttccctcggctttcttcctcttctcctcttctgaataagcttctagcaatacctgggcttcaggaagtcagggagggcctcactggggcataggcgggacctgtatcctgtagcacgatgaggaaatggtggcatgcaggtatcccagattgctgaggagggagggccagtttatgatttctgacgcagtgagtccaactgttggaggggctgcattagcccctgggctagaggtgtgggctgcagttcctcagtcacaaagtagcacgcattagtccccttaatatgcgacttccttctagccactgggcttcataactggcataggcctgactgccacacccttaggcctgggactattttcccaccttcttcacctaggtagctactcctgagctgcgagatccaagctcaaatgcaccttcttcagagagaaaggttggggtcctcattccatgctgtcagagcactatgcaccttttcatgctagtacttgccaaggttataattttatacctatttgcatcttaacattttatttatgaataggaaatactttcacaagctttaaacataaatcattgaacaaattaaaatgtctacaatacgacatctctctctacttgttcctgatccactgtttctttcaacccccagtacaggcaaccatggctaccaatttcttttcagcattttttttttttttttgcacataggcagaatgtgtaatctggaatcccctcttttacacacaaaaggtagcatactatagaaacattttttgcatttgctctgtaaacttaataatatctcttggagaatagtctattcagagagggcttcctcatcccttttgcagctgcacagaattattattattttaatttctttgagatagagtttcgctcttgttgcccaggctggagtgcaatggtgtgatcttggctgactgcagcctccacctcccgggttcaatcaattctcctgcctcagcctcctgaatagctgggattacaggtgcctgccactatgcccagctaatttttttttttttttttttttttttttttttagtagagacagggtttcaccatgttgatcagactagtctcaaactctgacctcaggtgatccacctgcctcggcctcccaaagtgctgggattgcaggcgtgtgccaccgcgcccggcctgcagctgcatagaattttatcaaaatgattgtttcagaaatcatgtagccagttcttgttgaaggaattagatgtttttttattctttgctcttctgattaagcttgtacatatgccattttatgctgtgccaagtatatctgtgagataaatggcctgttcaaagggtacgtggatttgtaactttgaaaatatcaccaaattcccctccatgggagctgtactgatgtatatatttccaccactgctgtggccttaccaataagggcgggagagcaaacttgtggatttttgtcagtttgacaggtgaaatgtggatatcagtgttagctttaatttgcatttcctttattatgagtaaggttaagcatcttcttttaataaatttcctctcctgcgaactgctgttctcatcctttgctcatttttcttgtaggtttttgatatcaatttctaggaactcttataaattaggaggatgtagctcttatctgtgatgagttacacatgtccaggttatcatttgtcatttggttttgcctgtagtgatattcccacaccgatgcttttgattgaattgaccagtcttttccttatagattttggattttgagttattgaaagccctaacccccctccttacttataagggacttttcttttagtattttatggatttatttttacatttaaaccattgatccttttgaaatttatcctggcattgatttgaggtgtgaatccaattttttttttttttctacagagctatccagttgtcccagcatcactaattgagttgtcccctttcctcccctggttgaggtgccttatttctgaacactaaatccctatatgaatgtgtgcctgttcacacgccagtcttttaactgttgagactggataataggttttagtgtttggcaggactgggcctccttgatcttcttcagagttttcttggctagtcttgtctattttttcacataaattttagaataagcttgtagtgttaaaaaaggagcttatttgtatttttattggattttccttaaattataaatttacttagagaagactgataggaaggcttttctatttgctgagggttttctggttcttcaaaacgtattcaggtttccttgaaatggccctgcacgtttcttgttaggtgtgtcacctgatttgttaccatgataaatgcagcctttctttcactacattttctcaccacttatttctgctcattttcggagttactatgtgactgccccaccagatagtaaaccatgaggtttccaatcactgtgacatcctagtgcctagccaccgtgtctggcaagccagcgggtgctggtggatggtaagtgcatgagaaactcctgaagggggtggtaatcagacagcaaagccacttcccctgccaggggcagatgtccccccaaagcttatgctgctaatctgccagtggggacccagagctatttatctccctctttcctcctttcctcccacatttgctgatccctgacaatgtggcaagccctgaactccagatcaggtcccaccctccccagccaggttaaggtatgaactcaggcttggaaactagtaccaattctggctgtgcctgaaatcggctgtctgatgctgggcaaatgcctgcacctccctgaccctcagtcccttgcctgttaaaataagggcaataataattaatgcctactttatacggatactgtaaagattaattttatggtgaatgtaaatggcttagcacagggcctggcacataagctatgctcagtaagtgccagctgttactgctgttgctgtggcagaaggcaggaaggtttggaggccccacggtaccaccccagtgttgctcgcatgggagtgatgcctaaggttccctgggcaaggcctcttgagtgggctgatgggctccctgacttagatctagtttgaattttccttggatgcacctcttatcatccggggtctcagttttctttctttccttctttggtgtttaagctgagatcctgtcactgtcctaacctctttgtagggctggggaggatcagaaggatgatggagaaggtagtcacagaaaataaaattatgatgcagggtaaatctggttttagtatctgacaaaatggacattagccacacttttgaggggctagcatccagataacatgtgttctgtgttctgtagggcctgctgacccaagtcccttacagtgtttaattggcaccttctcattaactctgagcttgttgagagcagtgtgtgctctctcacaggccatctggatcctgctccagactgtgtctccaaccagctgtgtgttcctgggcgagtcacgtctccactaccagcattctgttcctcatctgtaaaattagagagctggacacgaatgatctcaatggcctgcctctccatgccctaatgttctgtgattccaatgtagatagatctgggctttattggccaagcacgctatggcgatctcttgaggagagggatgtttggcgcaattgcagttgttaaaatagaacaggcttctgaattgtggccagaacataatgaatcccatttctgtgaaacgatgatgacggaaccagtcatgtagtggggttgttgacgtggctggcccatttggccccatatcctctgcagcaaatataaatgtgaaactctggcaaagtagtttaatgtggcgcctgaggaacttccgagcaaagccaggtgtgtgagtcactgagttggtttcacattctcccggctgatgggactaaggctcaagtttatacttgtcttggctcaatgggtgggactttcttccagatacctgtccaggttctagactgtcggagtcagaaggggtgtttgggaccacttagtcaaaggccccacttcatagatggggaccccaatggttggagaaggagaagagcttgctcaggacttgacgctggtgaacagagatcatgacggcgtctgcacccttcttgacttctctatgaccggggttaccctcacctagtggctcccacctgcccctgtaggactggcagcttccctctttgcaggtttccctgtgagcctggctggttccctgcctcggaagatgtgttgggcactctctccaccctagtcatcagggactttgtctgacgggctaaggagtttggcctttattccaagggtcaagagggaacaatcaaaggtggattgtgtacataaggcatttactgagccccatatactggcagcagtggtaggaggggatgtgggggaaagaggaggaaatacaaaaggccctgctcttaagcaatgcacatcttcctgaatttcccagaaggttctgagcaggggagtgaactgatgggatgtgtttcaggaggaaatggagagaaagtagatggaggtagggggaggctgtcctagcagcccagccaaagatggtggggcctgaagcaggggtgtgcaaaaggaatggaggggcttttgttttatagatagagtcacaggaatcggtcactgagtggacctggaggtggatgacagtgaggaggaggggagttgatgatgatacccagggctttgacgagcccacgactgcttgtgactgcccaggtgtcacaggagcagggtggctgctgccatgtgtcctagtgtcctgcacagccttcatgaggtgctggtgcctatggctctgtcctgggttctctcagcccacggtctttgttctccctttgcgctgccacctttggagagctagagtgactgggggaggccttcatgccaaggagctggcacatcggggaactcatgggagatcatctctgcacatgtttcatcaccacttttgacctaggaaatgccttagagatgatctcgtctttagtgagcaagcaaagaccagagaggaggggacttgcccacgttcccacggagggtttgtggtcgtggcccagatcttcccactctcaaacccgaccttgcactcactagatcctgtctgggggcaaaggagcctggaggtacaaaaggataaaaggtatagccctttctcctgaggagtttagagtttaattgaagggacaagaagaaataggaagccactaggatgcagaatgacaaccaggtagataacacatgagaagtaagtttcagaactgggcgttcagagcaggcccttgtacctgagacttcctggaagatctgggtcttcctagaagagatgttaggcccagaaggtgagaaaagaatgggaaaggaagatcgagacagcagagggacctgcatgtgcaaaggtgcacaggtaggaactgggcattcctggagctatcgggccacctcccaggtattccattgctggatcttccgggaacgtgggtcctttgtggatgcctgcagctctgtgaatagtgcacggtgatggagtcacctaaaggggctgggaggtgttttccaggcccagttcctctcgccacaggagcatccccagcgtcctggaaagggacagacatcgaggcctctctgagcgggacctgtgtcctgtagcctcactctgcattcctcacctggcaggcccccagtcgggcagcaggtccccagctgcaggacctggtttggggtttgggagttatgtacttgcctcgtgaaggtctggaggtttgtcactgagggctgaggcgggagtggccagtgcagaaggcagaaagtgtggttcctgctggatggagtcacccagctcaaccgaggagcccagggaaggccagtacccacagcccaggtcctggcccacccattcctcagctgagctggctctctaggctatccctgtgccccagggcacgataagagcagagtcttcccagactaagactttggccaaggtttgccataaaagagcctgactctggcctttctcttggcactctggtcactaacaggttaaacctttcattcagcgtcagtaccaggtcccatccctgggaacctagaagggtggcagcccaacgaccaacccaaggaaagggcactgccagctacggagaggggagctcagaggggaaggggacccgagggcccgcctggcctggccaggacagaaaccgaagggttaacagaagccgcagggctgataaaatgccccaaattcctggtcctgccttcaatggggagggcgtctggcaaatgtcaacgataaaaaatacattttaatggcacatgatgcagctgctaccgtggggcgcagccaaatgaagcaggtttggagcagcaactactgtgagcggcccccgggggctctggcagccgcgcctccagggcgctttgctaagctttgtccagccgcggcaacccgcctcccccagcccacggcatcctcaagggcccttgggatcgggggcctcttgccttctatggcactattttggaaactgtgccgtctcctaccttggcaccttgaacgcttgaagagcttctctgagggctgggagcggccttaggcaggtctgaaggcaggatacatttgggtctccccagcacaccgtcagcaggcctctgtgaacgttgagaaatgcataaacaaggctaggtgcggaggctcacgcctgtaatcccagcactttgggaggccaaggtgggcggatcactggaggtcaggagttcgagaccagcctgaccaacatggtgaaaccctgtctcttctaaaaatataaaaattagctgggaatgatggagcacacctgtaatttcagctacttgggaggctgaggtacgagaatcgcttgaacccaggaagtagaggttgcagtgagccaagattgcggcactgcagtccagcctgggcaacaagagtgagattccatctcaaaaaaaaaaaaaaaaaagaaaaagaaaaagaaagaaagaaaggaaagaaaagaaatgcatgaacaaatgagcaatgtgacaaaaaaagttacagtgggacattttcctcagctttttccctctctctcatcctgcaaaacccaagtatttctagaagaggcaggtcatgtgtaagaagggtattgagaagaggtgaggctggagggggacccctgagggagggaggttacatgttatgatcccatttacaaatgtggaaactgaggcacagagaagcccagtgacttgtctgagatcaaacagtgactcggtggcaccctggacttttgctgacagctcacaattccacctgctacactgtgctgagttcacagtgggctttgacagtgttaagggctgactcaagttctccattaccacagtgaatcaactggtcacatcaaggagggcctggagctgggcattagtgctggtgcagagaggctaagtagggctggggtggggagagtttggggcccaggggcctggttcttcacttgggagctccagtcctggtcggtaggccccggatcctgggctttgaggagaatgagaaaaaccaggccagggccagaagaatgaggtcaagggcctggggcttgcggatggggacctggagctcagcatgagacccttctcttccagatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaaggtacagccactgccccactgccccacagccccacttaacaccaccctgcgttctcttccaccaggcagagaggcagagtgtgaagccagagtcccagcagggcttgggcaggcccagtgcagggacctcagaagcctagagtccctcggagccgcgagcaaatcgaatgatgaacagaaaaggaccctagatatgtccatctccagcacagaggaattacggtctctgtgttttggggaatggagaaaattggcaactgtaaaaaccaggagcttggagtctgccttgtggtttgagcattgggccctttcattccacaatgttctttctcctggttcatctcctggtgccttcagagacaggggtagggaatggggataggagccctggggtgctgtcagctggggtgtggaagcagagcctgagcggaggcccttcccaggctgtgataggaggtgccccagccacctcccacactcactactgccctccccagcccggccacccccactgcatcccagtcactgacagccgtgctctgccgcccgtctgctttccacagtatgcacacagggactggcaaggtgggcaggggtcactggggaagggccgtggctgtggtggattttaggcagaagagtgacagagtcggaactgcatctagaacggtcactcagagcctgatgtagttgcacagactcaggcagcaggcccgggatgctcactgggaagatgttacaggtccccaggagagacccatggggacagaagcccggcagtgcggagggctggggagcaggagaaagaatcagagggtggagagcaaggagtagggagccagggacaaaccaggtgtgaatggcaaggcccacttccccagacctgccccagttctgcctgtgcctggggttggggaggagggaaggccagaggccagtccagtcccaccctcctccccaaggagggtagtgagaagcggtgaggctggagagcgacccctgagggagggaggttacatgttatgatcccatttacaaatgtggaaactgagacacatttgtgtgcctcacactggtgaccctatgtgttttctccccacagatcacccagctgaaaattgagaacaacccttttgccaagggattccggggcagtgatgacagtgacctgcgtgtggcccgactgcagaggtggggctgcgtagcctgggggtggggcgggcagatgggattcaggcacgtggcctctgtgaccctcgatgtatcttcactctcttcctgtctctcctcctgtcctccccaccccttcagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgaggtagggctctcctggtctagaagccctagagggtaagaggagcggtgaggttctccccgaaaccactctgcagcgcccccccccccaacacacacacactcatctcgtgcttgtgtggcctgggagagtgggcctgaagggttagggatcacagctgggcgcagggccatcttttccagtgcagggatgctggttctcatctctcatgctgcctttggaaccctcacagacagcttgtagccccggtgtccccagacacctttccaagtgttgctttgcagtcactgctctgagagcctcgtggggtgagctgggctctgcctggaagtgcaggaagaggctgacacttcccagtccagaggttttgggattggggctgttgtttgtcaaagcaacctcaattccagaacagggaggacttggtgtctcacgtgcagggccttccacccaatcattccttccaggatctgcagaggctgcttgagagttgagatgagctattgtggatgtaggtgggggctgggaagacaagccacagcaccctctgtgccaggcctcttcgtaaagaggaggagcccggagctgggcaccatcacatctgtgctctgtgccaggtcttgattcctccatggatagaattgcaatgattcgtgttactccaccagaagacctcatggggctgctgaaattcccttcggaatgagcctggggacttttgcttgccttccggaatgttccctcagccctggtcctagggactagcccagcagagctccgagatcccctgtacaagtctcattagaactcaatgacctagagcacgggttggcaaactgtggccttcggacctaacccagcctgctacctgtacaaaatagtttttacatttcaaaacaattgaaaaaaatcaaaagaatatttcatgagatgtgagcattatgtgaaattaaagttttagtgtccataaagttttattggaacacagccatacccatttacttacaggttgtctacggctgctttcatggtacaacggcagagtttcgtagttgcaacagataccctgcggcccacaaagcctaagatatttactatctggtcctttgcagaaaaagtttgcccagtcttgacctagagtgagtaggccacctgccaggatcaagagcttagctcagggagaagagagggatttggagagaagacggagaatcgggctgagtgaggggcaaaggagagagctgggcaagggagaggagcaggtctccctgggcagggcagatgccaccagcaggggcagaggagagaggtgagcagaggccttcacacccatttagcccctctgcttccagccccgtgggtgcacacacagagctccccgaatgaatccctggagaaaacaggaggagggaggccaagatgagccatggatgtgtggggtttttgttgttgttgttgtccttgttttgagacggagtctctctctgtctcccaggctggagtgcaatggtgcaatctgggctcactgcaacctctgcctcccgaattcaagtgattctcctgcctcagcctccccagtagctgagattacaggtgtatgccaccatgcccagctaatatttgtatttttagtagagatggggtttcaccatgttgatcaagctggtctcgaactcctgacctcaagtgatccgcccacgttggcctcccaaagtgctgggattacaggtgtgagccactgcacccagcccggatgagtgttcttaaattggctcagtgggctgctccccaaaccctcaggcctgggtcagccctggatcccaggggaggtcatgccactccagatacttaggccctccttgtggaggatgtcgaaaggcacacatacatgatttgtggcatctgatgtcatctttccccagagtatctgcttagcctgaaaagtatgtcacctttttcacttattatcagttctatttcttaatttggtagacactgtggtgttggaatctgtgtagtaaaaatctgatggttcttctttaaacacatgtgaggttagttcatcttctaaaagcaacagaaacatgcctacaagtggctttggctccctgaggtcttcctgggagctgaggatggaggcagaaacctcatggccttaattttctggctacttcagacagatgtggcctctgggcatgggctggcctggcaagtgcctctactttccttggccagggagggcctagcctgagaatgccactgcacatcagggcctctcactctgcaagagtcaggctggcgaaggatcaaagccgagtgctgcctggctaagcctggccctcagtgtccggtgatgtggtgtcccccgtggcctctgagtagggtccgtaatctgaccacttcttggtgcctgcaaccctataaaagccgtggctgattgaaatggctctgggagtgccatggcaacatggggagggcgggcgcagagggacaaggacaggctgtcccagcatccaacagggtgctctggggcctgggctggtggaaatggttcttcctgaatgttactttgtctttcagcagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacaga

SEQ ID NO: 38616 - DNA, 22771 bp, Homo sapiens
actctgggcgaggccgcccctatcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggtgagccttcgccccagaacaaagtcctctggggtgaggcccaggtcttgctcccagcccctcctcccccagacccaggaacttaggcccccaccccctcctccctcagacccaggaactcaggcccccaccacctcctccctcagactcagggctccagcccccagcccctcctccctcagacccaggggtccaggccccagcccctcctccctcagacccaggaactcaggcccccaccccctcctccctcagactcagggctccagcccccagcccctcctccctcagacccaggggtccaggccccagcccctcctccctcagacccaggaactcaggcccccaccccctcctccctcagactcagggctccagcccccagcccctcctccctcagacccaggggtccaggccccagcccctcctccctcagacccaggaactcaggcccccatcccctcctccctcagactcaggggtccaggcccccagcccctcctccctcagacccaggggtccaggccccagcccctcctccctcagacccagaaactcaggcccccatcccctcctccctcagacccagggatccaggccccagcccctcctccctcagacccaggggtccaggccccagcccctccttcctaagggaacctggaaaatgggccacccagttttctccttccttgggcacccatgccctcagcccgattttgccatttccttggtcacccagcagcccaattctggttcccactatcccactatctcagaattcagggaccccatggggtttcctacactgaggataaaataaaagttagctattactattattctctgattcaaagttttctagatgtgtgcacatttgtgatcagaacttggcctggtctggctgggtacggtggctcacacctgtaatcccagctctttgggaggcccagctgggaggatcaggcctcagaatgtggagaccccatgggctcctaggtggaggagaggtagatggacacacccaaagaaactgatcattaggcccccatcacggtttctgcctggactacccacttggtctttagttcctgaggaacagctggctccagacccaggacctgcctggaggccacccctctgctgttctgcactgaggaaggaatctcagagtgaccaggcagatgaggtttggggcccagagcccagaacaaggtctagttcagggacccatgccacttctttatattaaatattttgtagtgtctctttttttttttttttggacacaaggtctggccctgtcgcccagactggagggcagtggcaccatcatgactcactgcagcctccaactcctgggctcaagtgatcctcccacctcagcctcccatgtagctgggaccacaggcgtgcaccaccatgccagactaatctttttattttttggtagagaggaggtcttgctatgttggctaggccggtctcaaactcctggcctcatgcgatcttcgtacctcagcctcccaaagtgctgagattataggtgagagccaccatgtccagccaagtgtttccttaattcatcctgagaggacatgcagaggttcaacaacctacccacctatagttttttaatcactataatgcccaaattataagagagtgatcaaaggaatttttttcataaatattatctatgttttaaatgaaaatgccaaggcacaattattcttggaaggcagagctgactagtcagacactcgtacctgtaggtagaaccactgtcatacagaatcaaatagtcttcccttaatatataggagagctggatttctgcaaaattcagcgtaatttttttttttttttagacatggtctcactctgttgcccaggctggagtgcagtggcgcaattttgactcactgcagcctctgcctcccatgttcaagcaattctcctgcctcagcctcccaagtagctgggattacaggcacccgccaccacgcagcgataatttttatagtttttattagagacagggtttcaccatgttggccaggctgttctcaaactcctgacctcaagtgatccacccacctcagcctcccagagtgctgggattacaggcatgagccactgcttctggccaaaatctaataaaagccatgtatatcgtttttaatttttttttttttttttttttgagatggagtcttattctgtcatccaggctggagtgcagtggcgtgatctcagctcactgctacctctgcctcccgggctccagcgattctcctgcctcagcctcctgagtagctgggattataggcgggcgccaccacgccaggctaatttttgtattttcagtacagacagggtttcaccatgttggccaggttggtcccaaactcctgacttcaagtgatccacccacctcagcctcccaaagtgctgggattacaggcgtgagccaccacgcccagcaggaatggactcttaccttacactgttgagatagagtccagagccttatccctgcaggtgttccccatgaggggaggaagagggtgtcagtgggagccccaaggatagccagagtccttgcccatccccacaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgagtaagcccttgtcctcagctcccggagccccatcctgccctggcccagggacccaggggtccaggcccacagctgcttctttcctggagaccctcccatcataggctctgggaggcctcagcggtgtctcccccacccctctcccacccaggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcaggtcagggaaggccaaggctgggagctagacttgggtccaggaggaagtagagggctgaatcctggattcctgggtctgagggaggaagggccgggacctggactcctggatctgagggaggaggggccggggcctggactcctgggtctgagggaggagggggctgggacctggactcctgggtctgagggaggaggggctgggggcctggactcctgggtctgagggaggagggggctggggacctggactcctgggtctgagggaggaggggccggggacctggactcctgggtctgagggaggaaggcctggggcctggactcctgggtctgagggaggagggcctggggcctggactcctgggtctgagggaggagggcctggggcctggactcctgggtctgagggaggagggggctggagacctggactccagggtctgagggaggagggggtgagggcccggactccagggtttgagggaggagagggcggggggcctggactcttgggtctgagggaggagggcctggggcctggattcctgggtctgagggaggagggcctggggcctggactcctgggtctgagggaggaggggctggggcctggactcctgggtctgagggaggaggggctggagacctggactccagggtctgagggaggaggggctggagacctggactcctgggtctgagggaggaggggctggagacctggactccagggtctgagggaggagggggtgagggcctggactccagggtttgagggaggggagggctgggggcctggactcttgggtctgagggaggaggaagctagggtcccaaactcctgagttctggagaaagaagagcttggggtcttgtaaaagggatatgcctgaggcccaccatgggtgtgaaggaggtggttggatcctcgagccctagggactacttagggatgtgagctgcttccctggtcgctccctgacccaagccctgccccaccccagccatggccaacactcctcaagaactggcagctcctggcagtcaaccacccaggctacatggccttcctcacctatgatgaggtccaagagcgtctgcaggcctgcagggacaagccaggcaggtaaagggtccagggctcagcagaacaaggctgcagggctcagggatctgggctctgggctggtgcgtggtggagcccagatgtccttccaagagtgggaacagaggtacccaggaccccagagagttgataactcagaggcaggacactgagtgcccctcccagcccgcctcttctctcgaggcctcctgtactgtcccataatcctgcagctaagggacagtgcccgctctagcaaggagcccaaagacccgcttgagggtaaggtccgtttctggtaggtcagagtcatgttgtaccatctgttcagtattttgagtatgaatttcccacctgttggcataggagactgaaaaacaagacatgagagtccttaaattatttcaaccaggagttttgagctgttgggtccccctagagggctgagaattgagctgtctagataccaagagaagagaaggtcaggtttgtgagtctctgcagggctgaggtgcaggggtaggacggtgagtgcgttagcattcttccagttacacttcaaacttatttaagggaaaagaaaaaggaaagaataaattcctataattgaaaaggccaggccccgcacagtggctcacacctgtaatcccagtactttgggaggccgaggcgggcaaatcacttgaggtcaggagttcgagaccagcctggccaacatggtgaaacctcatctctactaaaaatacaaaaattaggcctggcgcagtggctcacgcctgtaattccagcattttgggaggccgaggtgggtggatcacctgaggtcaggagttcaagaccagcctggccaacatagtgaaaccccatctctactaaaaataccaaaaatttagccaagcgtggtggcgtgcacctgtaatcccagctacttgggaggctgagacaggagaatcacttgaacccaggaagtggaggttgcagtgagccaagatcacgccattgcactcctgcctgggcaacaagagtgaaactccatctcaaaaaaaaaaaaaatacaaaaattagcctggcatggtgatgcgtgcctatagtcccagctacttgggaggttgaggcacaagaatcacttgaactcgaaaggtggaggttgcagtgagccaggatcccgccactgcactccagcctgggcaacagagcaagactctgtctcaaaaacaaaaaggaagaaaagaaaagaagcctagggtgtgggtttcaggcacagctagatccaggtgctcaatggctactgtcaggaatcagttcctgttcatcccctttctctgctttcctctgtttgcttcattctcaaacatggtttctcctcattgtggcaaatgacttctagaagtcccagctgtgtaccctaccttcttagcaacctctgtaagaaagggggcaccttgctctgacacttgcagcgaaagtcccagaacggactcccatcactgtggtcaggggtcctgaaatgcactgattggccaccccagccttgtttaaactccagtgaagcgaggagagatctccaaatggaatcagggctgtttttatcataaaagagccaagcaggcaaaaacagcatatatcccctagagaggcaggcaggggtctagcacatgccgttgcctagaggatgggaagctgggggtgaggacctagacacctggattcccaacaggccaggggactggaagttcacaaaagggatggcagtgaccactccctcaccccatcctacctacctctccctccagttacatcttccggcccagctgtactcgcctggggcagtgggccatcggctatgtgagctcagatggcagcatcctgcagaccatccctgccaacaaacccctgtcccaggtgctcctggagggacagaaggacggcttgtgagtctccattctggtaggaggagggtgtcagcaaaatctggttggaaagatcttgcatgttgtgcactgccggtggccaccacgtttgagggtgcaaccattcacataggggacatctcaaatctgcagtactacaaaattccagcaggtggcagtcaaaggtcttgaggaaggggcgcctctgagggtcgcacaaagtggccatagatcgggcccagccacagctccgaggagaagtgtgtggggcattgggcacaaccgcaagggctccattccttggaactgagctcaagagcgtttgcttctattttcttcctcttttactttagttaatttttaaaaaatgagatggggtttcgccatgctgcccaggctggtctggagctcctgggctcaagcgatcttcctgcctcggcctcccaaagtgttgaaatgacaggcgtgagccaccgtgcccagccagcttttgtttctagatatgagatcctgctctagaatctagattgatggggcagaaacagaactggagaacttgctagacaggtgtttttttttttttttttttttttttttttttttttttttgagacagagtcttgctctgtcgccctgactggagtgcaatggcatgatctcggctcactgcaacctctgcctcccagattcaagcgattctcctgcctcagccgcctgagtaggtgggattacaggcacccaccaccacacccggctaattttttgtgtgtgtttttagtagagacagggtttcaccatgttggtcaggctggtctcgaactcctgacctcatgatccacccacctcggcctcccaaaatgctgattacaggcatgagccaccatgcccggtcctaagttttggatttttaatagagatggggttttgccatgccaggctggtctcaaactcctgacctccagtgatcttcccttctcgaactcccaaagtgctgggattacaggtgtgagccactgtgcccggccaggaagacaggtttcttttcagagtttcacctttagccagaattttcttatcagtcatatctatatgactactgacatacaagagaggagataggaaggtaggtagctagctagatagtcagataggtagatagatagatagatagatagatagatagatagatagataggcagataggtagatatgctgttgattatttgcaataattattattaattttttaatatataatttttttaacatttttggtggggcacggtggttcacgcctgtaatcccagcactttgggaggccaaggcaggcggatcacctgagatcaggagttcaagaacagcctggtcaacatggtgaaaccccatctctactaaaaattaaaaaaaattagctgggtgcagtggcgtgcacctgtaatcccaactactccagaggcagaggcagaattgcttgaacctggcaggtggaggtttcggtgagctgatatcacgccactgcactccagcctgggtgacagagcgagactccatctgaaaaaaacaaaacaaaaaaattttattgtatatttggtagagatgggggtggggtgtggctcaccatgttgcctaggctggtctcgaactcctgaactcaagcaatctgcccgcctcaccctcccacagtgctcagattacaggtgtgaaccacacgcctggccaatttatagtaattatcttctataaaatcaccacacaccctgaattattgaatatcaagccgttgctcccaggggaaatacattcttgggtcctgagtagctaggactacaggtgcacgccaccacgcccggctgggtcaccacatttttgtcaaccagtcacaacatagtaacctttatgtatgttttcgtttaaagacactttattcaaggccgggcgcagtggctcacacctgtaatcccagcactttggaacaccgagtcgcgcagaacacgaggtcaggagatcgagaccatcctgcctaacactgtgaaaccccgtctctactaaaaacacacaaaaaaaattagccgggcgtggtggcgggcacctgtagtcccagctactcaggaggctgaggcaggagaatggcgtgaaccctggaggcggaggttgcagtgagccgagatcgtgccactgcactccagcctgagcgacagagcaagactccgtctcagaaaaaaaaaaaagaaaaaaagaaaaaaaaattgacactttattcagtacctattgttggttcgctaacattgaactcacaaccaacagcagtataacttgtgtctcagcaaagcttatacaacacacacgttttctccataagacacatcacagccttctttcacttaggaacaggagacaacacttcagctactcttggggaccatttaaaacagaaaaatcagaggccgggcatggtggctcatgcctgtaatcccagcactttgggagactgaggcaggcagatcacttgagatcaggagttcgagaccagcctggccaacatggtgaaacctggtatctagccaggcatggtggtgtatgcctataatcccagctactcaggaggctgagacgagaattgcttgaacccgggaggttgaggctgcagtgagccaagatcacgcctctgcattccagcttgggtgacagagtgagattccatctcaaaaacataaaaataaagtcaatcataagctgggcgcagtggctcacgcctgtaatcccagcactttaagaggctgaggtgggtggatcaccaggccaggagatcgagaccatcttggctaacacggtgaaaccctgtctctactgaaaataacaaaaaattagctgggcgcagtggcgggcgtctgtagtcccagctactcaggaggctgaggcaggagaatggcgtgaactcgggaggtggagcttgcagtgagccgagatcgcgccactgtacttcagcctgggtgacagaaccagactctgtctcaaaaaataaaaataaaaataaaataaagtcaatcgtagaagtcccttcttattgggtgtttatgcacagaggaggacgctgcatttaaaatttttttctaatttaaaaaatttatttgcaccgggcacccagcaaagtgctgggattacacggtggctcacacgtgtaatcccagcactttgggaggccgaggcgggcagatcacctgaagtcaggagttcaagaccagcctggccgacatggtgaaaccccgtctctactaaaaatacaaaaattaaccaggcatggtggcaggcgcctgtaattccagctacttgggagggtgaggcaagagaattgcttgaacccgagaggcagaggttgcagtgagccgagatcacgccattgccctccagcctagggcacaagagtgagacttcatctcaaaaaaaaaaaaaaaaaatttattcgccaagcatggtggctcatgcctgaaatcctagaactttgtgggaggatcacttgagcccaagagtttgagaccaacctggacaacatagtgagcccccatctcaataaagagaaaaaaagaaaaaaaaaattagttaccgacaaggtatcactatgttgtccaggctggcctcaaactgctgggctcaagcgaccctccctcttcggcctcccaaagtgctggggttacaggtgtaaaccactgcacctggccagcgcttcatgtttcttttggtggttctttttttttctgtgacagggtctcactgtcacccaggctggagtgcagtgacatgaacacggctcactgctgcagcctcgacctcccaggctcaggggattctctcgcttcagcctctcctgagtagctgagaccacacgcacatgccaccatgcccagctaatttttttaatttttttttttttagacatagtgtctttctgtgttgcccaggctggtctcgaacccctgggctcaagcaatcctcccgcctcagcctctcagagtgctgggattcaggcatgagccactgctcccagccagggctgcatgttttataagcactgtctttcttatttatttatttttaaaatttcttttttttttttttttttgagacagagtcttgctgtgttgcccaggctcgagtgcagtggtgcgatatccattcactacaatctctgcctcctgggttcatgaaattctcctgcctcagcctcccaagtagctgtgattacagacacgcacctccatgcctggctaattattattgtatttatttatttattttgctatttttagtagaaacggggtttcaccatgttggccaggctggtctcaaactcctggcctcaaatgatctgcctgccttggcctcccaaagttctgggattacaggtgtgagccactgtacccggccagcactgtcttatttaatccatcacaaatctttgcctcaggcatgatcatgtccatgttacagaaggggaaactgaggccagaaaggtcgagtggccccagccaggtcacacagtgtgttagtgagagagccactgtggggcccaggtcagggatcctgcactgctccacatgacaggccaggcagggccactagcctcagggagtctgagggtccaatatttcatgtgctatacatgtcggaataactggagtagcattgaggcatgccagataggccgaggaaatgatccagggggagacccagggagcccagagcttgcttctccggtgtcctggagcccagtgctgagatctcgcctacaaccctggttctcggtctctctggtccttgctgtgtgaccttgggcaaatgcctttcccaccctgagccttgggtcactgtctgtgagggaagaagtggtacaggtgctctcagaggatctttccatcctgatattatcagattctaggatttgatcactttcatgatctgtgacactaaaatctgttatgcttgggcgtggagaagggtgaggttctagaagagctaagccagagattttcccttttttttttttgagacagagtctcactctgttgcccaggctgcagtgcaatggcatgatcttggctcactgcaacctctgcctcctggattcaagcaattctcctgactcagcctcctgagtagcatgcaccaccacgcccagctaatttttatattttcagtagagacggggttccaccatgttagccaagctggtcttgaactcctgacctcagatgatccacccacctcggcctcccaaagtgctgggattacaggcgtaagccaccacacctgccctaagccagaaattttcatatcgttttctggttcttagtctatctcatccttgtttctggagcttgagtcactgaggttttgtgtgccctaccttgggagtctgaggggacatagccctgccctggggtatctgagaagacacagtcccaattagaggtgggtggagggaaaataagcccaggccagcaatggatttgggacagatcctcaactcagggaaatatggggccctgtagggggtaaaggtacttgttcatctgggggtgggaaatactggatggccccccagtccccctctcttcccttcccccagctacctctacccagatggaaagacccacaacccagacctgactgagctcggccaggcagaaccccagcagcgcatccacgtgtcagaggtgagacccgcacctgcacccgcagtcccagttccctgaccctgccacccccacgttgccttggctcagaggcctggggttggaatgttggcttggtggctctgtgaccttgggtaaatcacttgacctctctgaggctcagttattcttccggaaaatacggctcctcctgcctctttcccaggggtgatcacggggattaaataaggaactgatgctgctgagatcatcaggacagctaatgcattcgagcatttgccagcaatagccccgtgccagctcctaatcttcacagccaccctacgagtgagaaaaacaacaataacaaataaataatttattttttatttatttttatttttagagacagaatctcttctgtcgcccaggctggagtgcagtggtgcgatcatggctcactgcagcctcgacctctgggctcaagcaggcctcccacctcagcctcccgagcagccaggagtacaggtgtgagccactgcacccagctaatttttgtatttctctgtagagatggggtttcgccatgttgcccaagctggttttgaactcctaggttccagcaatcctcccgcctccacctcccaaagtgctgggattatagccatgagccactgtatctggccctaaattttttttagtataaatatatcccgtgcaatatttgggacatccttatacttcaaattgtattcacggtttacatgaaattcaaatttggaggccgggtgccaccgcacccataatcccagcactttggtaggccgaggccggcagatcacctgaggtcaggagttcaagaccagcctggccaacatagtgaaacccatctctaccaaaaatacaaaaattagctgggtgtggtggctcacacctgtagtcccagctgaggcacttgagttgggaggctgaggcacgagaatcacttgaacccaggaggcggaggttgcagtgagctgagatcacaccattgcactccagcctgggcaacagagtgagacttggtctcaagaaagaaaaaaaaaaagaaagaaagaaattcaaatttaggttaggcacagtggttcatgcctgtaatcctagtactttgggaggctgaggcgggtggatcacttgagcctgggagttggcggttgcagtaggccaagattgcgaccctgcacttcaacctgggtaacggagtggggctctgtcccgcaaaaaaaaaaaaaaagaaagaaagaaaaataatgaaattcaaatttagcagcatcagcatccaatacttttatttgctaaatctggcaccactgggtgtagacaactggggagaagaagtctcataacaaggagtgaagacatggccgggcgaggtggctcacgcctgtaattccagcactttgggaggccaaggcgggcagattacttgaggtcaggagttcgagactagcatggccaacatggtgaaaccccatctctactaaacatacaaaaattagccaggtatggtggcttatgcctgtagtcccagctactcaggaggctgaggcacaagaatcgcttgaacctggaggcaaaggttgcagtgagccaagatcgcgccactgcactccagcctgggcaacagagcaagactgcgtctccaaaaaaaaaaaaaaaaaatgagtgtagacatgtaggaggccattggacatgccagccttggacttaggagagggttcagttctggcacagaggtttggtttattattttttttttaaatagagacggggtcttactatgctgcccacgctggtccagaactcctgggctcaagcattccacctgccttggccgccagaagtgctgggattacaggcatgagccacagcgccaagatagaggaggtgtgggattttctttctttcttttttttttttttgagacggagttttgctcttgttacccaggctggagtgcaatggtgcaatctcagctcactgtaacctccatctcccgggttcaagcgattctcctgcctcagcctcctgagtagctgggactacaggcatgcaccaccatgcccagctaatttttgtatttttagtagagacggggtttcaacatgttgaccaggctggtctcgaactcctgacctcagatgatccccctgcctcagcctccaaagtgctgggattacaggcgtgagccaccacaaccagccgaggtttgggattttcttcctgtggcccaagttgtgtccccgtggctgacgcatgcccctcgctgtcttctctatcctctcacctgccaggagcagctgcagctctactgggccatggactccacatttgagctctgcaagatctgtgctgagagcaacaaggatgtgaagattgagccgtgcgggcacctgctctgcagctgctgcctggctgcctggcaggtgggtctgacccctgtggcgccttcccctctggtctccccctctctacagggaaagccccaaaaggatctccatgcctcattgatcatatggggaaaccgaaggccagagagggcaaagagctgatggcaaccactcaggagcccggctgtctttcccagggcctctggttccatcccactctgcacacgctgcctctgtttctccctctccggcaatgttatcagtggaaagctctccttccttctctgcctaggtgatccccagccagtggcttcacgtctctgagccttagcctcgtcccctggagaacggggctgagaatagtgacctcccaaaggccacagtgaggctgggcacggtggctcacgcctgtaatctcagcactttgggaggccggggtgggtggatcacttgaggtcaggagttcgagaccagcctggccaacatggtgaaaacccgtgtctactaaaaaaaaaatacaaaaattagacgggtgtggtggtaggggcctgtaatcccagctgctcgggaggctgaggcatgagaatcacttgaacctgggaggcagaggttgcagtgagcagagatcgtgccgctgcactccagcttgggtgacagagcgagactccgtttttttaaaaaacaacaacagcaagggccacctgagggtctgagcctggaaaggcctggcccggaagctgtggccacagctccatggggatccctggcctgtgtgccccctcctgacctcggctctggttccgttcctctctcaccttccctcccagcatttccctccacattcctctgctctccacgactcttctctccttccgtctcccttcctctgtctgtcttccccacatcaatcttttgggcggggagctcctcgttggcccaagggacaggatggagagcaggggagcactgaccctttccctcccgacctcccccagcactcggacagccagacctgccccttctgccgctgcgagatcaagggctgggaggccgtgagtatctaccagttccacggtcaggctactgctgaggactcagggaacagcagtgaccaggaaggcagggagttggagctggggcaggtgagcagggccagccgggagctggaatccaaattcctgaggcctgagtggggagggactggagcctggactcctgggtctgagggaggagagactgggggcctggactcctgggtctgagggaagaggggttggagcctgtactctgagtctaagggaggagggctgggggtcctggactcctgggtctgagggaggaggggctaggggcctggactcctgggtctgatggaggtgggtatggggacctggactcctgggtctgagggaggagaatatgggggcccggactcctgggtctgagggaggaagagctgagggcccacactcctgggttctaggagaggagggggctgataacaagattctcaggtcctagggaactggtcttttgcttccccaagggctggggctgtggctttccctggctgtaaccctcctaagtgttcatacgttgtcttggtctctgttatatcttgagtctagaacagtgcctgaatgctgagtcccaggcaggagaacatggaggcgagaagaaaatggcagctcacaagccccttctccttcctctgtcccaccccaggtgcccctttcggctcctccattgcccccacggccagatctgccccccaggaagcccagaaatgcccagccgaaagtggtgagtcaggcgctggtctgaggttgggggctggggtctcactcacctccagggtccctggttcacctgtgcactcaggggtgccagggcagggactcatccttggcacccatttccaaggcacccatcccctctgtgacctcttcccttgttttcattccccctctgggactttctttttttttttttttttttttttttgagacggaatcttgttctgtcgctcaggctggagtgcagtggcgcaatcttggctcactgcaacctccacctcccgggttcaagaaattctcctgcctcagcctcctgagtagctgggattacaggcacccaccaccatgccccgctaatttttgtatttttagtacagacagaatttcaccatgttgatcaggctggtctagaactcctgacttcattatctgcccccctcagcctcccacagtgcggggattacaggagtgagccactgcgcctggcctcaaggactttctagctctccttccagcatcccagatgtgtcctacctcggggcctttgcataagctgttcccttggcctgcacagtctttcctgaggcttgctttcccatcccttttcagggaggccttccctgaccactctgttcaagatagcacccctagctggggtggtggctcatgcctgcaatcccagtactttttttttttttttttgagaggagtctcactctgtagcccaggctgcagtgcagtggcataatctcggctcacagcaacctctgcctcccagattcaagcaatgctcctgcttcagcctcctaagtagctgggactacaggcacccaccaccatgcccgactaatttttggatttttagtagagacgaggttttgccacattggccaggctggtctcaaacccctgccctcagctgatccaccgccttggcctcccaaagtgctgggattacaggcatgagccaccatgcccggcctgcaatcccaacactttgggaggccaaggcaggaggacggcttgagcccaggcatttgagaccagcctgggcaacatcacaagaccccaacactacaaaaaaattttaaaattagcccaaagtggtggcgcacacccgtagtcccagctgctcaggaggctgaggtgggagggtcccttgatcccaggagttggtagctccagtgaggcgtgatcacaccactgcactccagcctgggcaacagaatgagaccctgtctctaaaccaataaaaaaaaagagtctgtaatcccagctgttagggaggcagaggcaggaggaaagcttgagcccaggattttgagacctttctgggcaatatagcggaaccccgttctctaaaaaaaaaaagaaaagatgaaaatagcaccgctgtccctcggggccctgctctgctgtatgttcaaagatctttcgccacccggcagagcttagggttggttttgtcggcttttatcactgtcaggttgcaaccttcctgcaggtcaggcctttgttgtcttctccgtcatatctccagagtgcagaacagtgcctagcacacatacacgtcataggtgctcaataaatagatgccaaatgaatacactgaagtgagtcttcccaacagccctatgaagtcaaaagtgttcctctcccggctgggcgcggtggcttatgcctgtaatcccaacattttgggaaggtgaggcaggtggatcactgagttcaggagttcgagaccagcctaaccaacatggtgaaaccctgtctctactaaaaatgcaaaaattagctgggcgtggtggcgcacacctgtaatcccagctacttggaagactgtggcaggagaatcgcttgaacccgggaggtggaggttgcagtgagccaagatcgcgccactgcactccagcctggatgacagagggtgagaccctgtctcaaaaaacaaacaaacaaatgaatgttcctctccccattttccagaggaaaaaagttcagagaggtgacagtacctgcccaaaaccacacagcctgaaagaggagaagtcagcgttggagtctttaaggcccccaaaccatctacttatttttttgttgtttctttgtttgtttgtttttcttttgagatggagtttcactcttgttgcccaggctggagtgaaatattatgatctcagctcactgcaacctccgcctctggggttcaagctaattctcctgcctcagcctcctgagtagctgggattacaggcaggtgccaccacgcctggcaaattttgtattttttagtagagatggggtttctccatgttggtcaggctggtctcgaactcccaacctcaggtgatccgcctgcctcggcctcccaaagtgctgggattacaggggtgagccaccgcgcccggcctacttattttttaataagccctgtcctggctttcttttctccctacgctgccaccccaggatttttgggaccctggattgctggggagaagcagatctcttagtatctccggctgagtacacacaggcttcgatcaatactgagctgtcttcaaacaaacagctcaggaagtccgggaacattattcgaccacagcaaacaagagagccagcaggaagcggggcggtgggggggagggtggcggtgaaaccagccagggaagctaaaaacagatccaacctgccgccaaaagcaaatggaaacattaggaggcactcagccggctcccagaggacagtgatgggggacacagccaggacagcaggctgacagggacctcgggcctgatggtgacacctttgcctaggccataccctccgcctcccccaccctttcctcctctccccaaaccctgcctgattaaaattccagtccactcccacctagtctttcattcttcaaaacataccacagaagagacagccttgggtttgttacttctcagcaaggcactgtcataacttttgttgttgttgttgttgtttgagatggagtctcactttgtcacccaggctggagtgcagtggcacgatctcagcccattgcaacctccgcctgccaggttcaagcgattctcctgcctcagcctcccgagtagatggggtcacaggtgctcaccaccatgcctggctaatttttgtatttttagtagagacagggtttcatcatgttggccaggctggtcttgaactccttacctccggtcatctgcctgcctcggccttcttaagtgctgggactacaggagtgggccccgcctgtcataacttttgctatgtgcctggcattgctttttttttttttttaagatggggtctctgtctagcggagtgtggtggcgtgcacctgtaatcccagctactcaggaggctgaggcaggagaatcgcttgaacccaggaggcagaggttgcagtgagccaagatagcgccattgcactccagcctgggcgacagagcaagactccatctcaaaaaaaaaaaatagggtctctgtcagccaggctggagtgcagtggtacaatcacagctcactatagcctcaatcttctgggctcaagtgatcctccctccttagcccccagagtagctgggactacaggtgcctgtctccacacccgaatcatttttaaattttttgagcagtgaggctggggctgctgtggacactggatgtgatgggactgtgtcagtggtcagtgtcaccgtggttgtgatctgtgtatggtgctgtggcccctggggttgctgtctgcacgctgctgttctccatctgagaaacctccctttaggggacgacactgccattgagctggatctcatcaccccactgaccactgaggacctctctgaccctcagtgttttcatggggaaaatggggaccagcctgacacaagccccacaggctgggtttttttgtttgtttgtttgtttgttttaatgttttaatttaattagagacagagtctcaccgtgttgccgaagttggtctctaactcctgggctcaagtctcccaaagtgctgggattgctggcattagccacttcgtctagcctccccatgagttttgatgaagccagcaagctcagtcatctctaacctgagtcatatcccctccctcacctctcagaaatctccactggcagccaagcgcggtggctcacacgtgtaatctcagcactttgggaggccgaggtgggcaaatcctttgcttgaggtcaggagttcgagaccagcccggccaacatggtgaaaccccgtctctactaaaaaatacaaaaattagctaggcgtggtggcgggcacccgtaatcccagctactcgggaggctgaggtaggagaatcgcttgattctcgcttgattatcgcttccgccaggaggtggaagttgcagtgagccaagattgtgccactgcactctagcctgggcgacggtgcaaaaactccgtctcaaaaagaaagaaagaaagaaagaaatccccactggctccccagggctctaagaactcaagccaaagtcctctccgccgcccaaagacctggggctggggatctgactcttccccacctctctgatctcccctactccacctcctttccggcaacattggacccttgctgctcttctaacttgccagcaagcctccactcactcggagcctctgtctggatccttcttgcactcaggcatcagctgggtcattcccatctccaagaggcctccccggcatcttccctctcccaggcactttgaaggacatggaacttgctctgggacatttccttgttcaggagctgatcagtcactgcgagcctcgggttcagtggagcatcagctccaccaggacaaagatagttttctgtcttgttcacagctgtcttctcagagcgaaaaacagggccttggcctggcgcggtggctcatgcctgtaatcccagcactttgggaggctgaggcaggaggatggtttaagcccaggaggtcaaggctgcagtgagctatggtcccatcactgcactccagacgaggcaacagagcgagaccctgttttgctttgttttgttttgagacagtttcgctcttgttgcccaggctggagtgcagtggtgcaatcttggcttatggcaatccccacctcctgggttcaaacgattctcctgcctcagcctcccaagtagctggaattacaggaatgtgccaccacccctggctaatttcgtatttttcatagagacagggtttcaccatattggccaggctggtctcaaactcctgacctcaggtgatccacccacctcggcctcccaaagtgctgggattacgggtgtgagccaccgcgcgtggcccctgttttttcggtttgttgttgttgttgttgttgtttttaaaaaagaaagaaaagtaaagaaagagagagagaaagaaagggagagaaagaaggagggagagagaaaggaaagagagagaaatagaaaaagaaagaaagggagggagggaaagagaaaaaagaaagaaggaaggaaggagagagcgagagagaaagaagaaagaaagaaaagaaaagaaagaaaaagaagaaaaaagaaagagaaaaggaaaagagaataaaagaaagaaagggcctgacccactggagaggcttgggaactgtctgtggggcacacaagtgagcagaagggtggacacatggatggacaggcggacagacaaactgaaacttcatcctacacgagttagaggtgagagggaaaaggcagcatggactagggacaaggccaaaggtcctgtcagatggtggccgccaccactgtgtcacccctgtccagggcctgtgaaaggacgtccacccaggctgcagcctagcagagacatttcttcatctcctccccccaggcacttttggccctccccagacttcgggcccctcttctcttgccaagaattaaggctgtggcctcagccgcgcaggaagccacctccagcccccaggtggtctgggactcccaggtctaagacaaaggggacagggaagaggggcagagggaaagattggatgccgggaatcaaccgccctctcaaaatatctccattgcagagactcctaaaggggaactcccctccagctgcgctgggaccccaggaccctgccccggcctgaaggccaggtgagtccattccctaaccctccctggcccactccaccccactccaccctcctccacctggaggtgacctcatctaacccacccctctctccgcctacagggcacccagatgtgctgctcaagggagccccaagggctggaagggggttgtgaaaccgaaataaactgccaagcctggtctgtcctcca

SEQ ID NO: 38617 - DNA, 4177 bp, Homo sapiens
aaaggatgtacagaggatccccaaccgcctgcgaaacccaagccgccgcgtaggagcgtgcgttcgggccctcttctcccacctgttcggtgagcatcgcgtaccgcgttcttcaggaggcgttgcgggcacaacggggctgcgatcagcggccgcgcgcgcgcatgcgtcctcaaagttcaaagtcctcgatacgcctgaggcgcctcaggcctcgtggctgccagcatttttctgctttaagatcctttccatgacttccttgtttaggccagcctccacgatccagctgccaaccatctagcctaccctgatctctgagcaggggtcgtcgtcattttactccagaggagactgaagccaaaaggtggtgagaggagagtacagcagcatttactgagtcctatagtagcccaagcgcttttcattcgttatattaatcttcattctaattgtgcgaattaaatattattaatgggaaaactaaaatgaaaaagattacatagtaaggcgtagtgctgggatttgaacacggatctcttggtttaggatcaaggcactttctattccactgttctttctctaaattatttgctcctggccctatttaaagagttaacagtgtatttaggaagagaaaactatcatttattgaactctttagacataccagcctccttacaaaccttacctttttttttttctttttttttttttttgagacagggtctcccgctgtaacccaggctggaatgcagtggcgtgatcacggctcacagtgttgcccaggctgggcgcaaaccatcctcccgcctcagcctcccagtgttgggattacaggcgtgagccatggcacccggcttcatctctgtgcttccagagaggttattaaatgatgtgtccaagggcaccaaatgaggcagtgacaaagctaggtccaagtctgtttcaaagcccattttctccctcttgcttaagttataccgcctccaaggcaaatgagttgtgtaaagtgcctaactccctcttgtgattccccattgccctcagaataaaaagtcttaaactccctactatgtcctacaaagccttgtgatgatcacttacttatatcgccagtttaatattgtcttattctcacactgtattctcccatcactgaacttttttttttttttgctctcatgtgtcagattctatctcaaccacctgctcttccattgaccaaaaatagttttcccatctctggctaacttctgttccatctgtcaagtttcagcttggaaatcacttcctctaggaagccttccctgcctattcctgcccttgtctggattaggcatccctccactgtggtcccagtctttgctatctgtacactgtgtagtaaactgccctgtttccttgtctaggttgtaaactccatgaagccaggaacttaactgacttagacagtcttgaatcctcagcactagcatagtgcctggtacatgataggtacttaatcatttgttgagtgaatgagagacacagttaaggcaataaggagtcctagttgctttacagcccatcatggtgaaatttttgcaaaggctgaagtcatttctcttcaaaccttaagttccttctgtatgctgctttctgctgagtgttctgatgcagacgggcaagacagtttgggcaaataaatacacctcacatttttgtatagtttacaaagccatctcaccttatagacccagaggccaggtttctgcatactgtatgctacagccacagtgaactctttccatccttcccatgtgtcaaaacctacccatatttgggcactctttcactttgtttgtttgtttgttttggagatggagtctcactctgtcacccaggctggagtgcagtggcacgatctttggctcactacaacctccgccccttgggttaaagcgattctcctgcctgagcctcccgagtagctgggattacaggtgcctgccatcacgcccgcctaatttttgtatttttagtagagacggggtttcatcatcccggccaggctggtcttgaacttctgaccttatgatccatctgcctcgggctcccaaattgctgggattacatgtgtgagccactgcacccagcctctttcactttttaaactttgttcttcagcatagaataaggctagtaggataaaagaagaaaggttatttatttgaaacagggtctcactatgtcacctaagctggagtacagtggcaccatcatagctcactgcagcctttgaactcctgggctcaaaggattctccctcttcagcctcttgagtacctgggactacaagtgtgtgccactatgcccagctaatttttacattttttttcttttttctttttttttgagatggagttttgctcttattgcccaggctggagtgcaatggtgtgatctcggctctccgcaacctccgcctcccgagttcaacctcggctctcctgcttcagcctcctgagtagctggcattacaggcatatgccaccacaccttgctaattttgtatttttagtagagacgggtttctccatgttggtcaggctgatcttgatctcccgacctcaggtgatccgactgcctcagtctcccaaagtgctgggattataggcatgagccaccgtatccagccatttttaaatttttttgtagagatgaggtcttgctattacccctgctggtctcaaattcctgggctcaagggatcttcctgcctcagcctcccataatgctaggattacaggtgtgagccatcgtacctagctgaaagtttagttctttttaggtagatcagagatagcttatctaaaaagatgacatttcacctaattcatattccaatagcaaaatccactgagcttattgaatgttatgtcaagcattctcacagtttatctcattcagttcaaaccacttttcaggcctgctctcagccaggcctagtgctgggggcacaaaggtaaatcaagacgaacatcagccgggcacagttggctcacacctgtaatcccagcattttgggtggctaaggcaggaggatcacttgagcccaggagtttgagaccatgctgagcaacatggaaaaaccttgtctctattaaagaatcaaaaaaattagctgagtggtgatgcacacctgtagtcccagctactctggccagggagggactgagggggaaggattgcttgatccctaaagatggaggctacagtgagcctgggcaacaaagcaagacaccctcaaaaaaaaaaaaaaaaaaacaagcatctgtcttcaagcttagagtctcccacgggagacagacacattaaacaggctaaatggtgcagtctggtcagtgctatttataatttaggaaccttacatattatatccctactctaacctgttaatgttctatagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 38618 - DNA, 18774 bp, Homo sapiens
ggagcggctgggaggttcgcgcgtttctcagggttcggtcggaggcggggaggccggagctgcgggcgtagggacctggcggctcctgaagcgcacgcgggcgggcggcaggtgtgcgcggcatccctgtcacgtggccgaagagcctggggcgcgcggaccctggcagggggcggggcgcacgcaggccacacccacttcaggctcccacccggtcgctggagaggggccaaggcctctggaaggtccaacctggagggtggttcaaaggggtgttgggcaccctcaaattaggggaaaattggggagtacgctctccttccccagggtggaggttactacaatcataagcggggagccggtgcccctgaggaaggagaccctgagggagataagatggaggggctcgggattccggggagccccaagtcccagcttgaaacggtggagtccgggcaaatgagctctgaggacggcttctgggcctggccgtgacccagattgcagtgagagttcccgcaggccccgcctctttctgggcctcgtgtctcccagccgccgggccgggtgcgaggccttacccctctgatctgctgcaggatgggcctctccgctgcggccccgttgtggggtcccccggggctgctcctggccatcgccctgcacccagcgctgtcggtgcccccgcgccgggactactgcgtgctgggcgctgggcccgcgggcctgcagatggcctacttcctgcagcgcgctggacgcgactacgcagtgttcgagcgggccccgcggcccggcagcttcttcacacgctacccgcggcaccgcaagctcatcagcatcaacaagcggtacacgggcaaggctaacgccgagttcaacctccgccacgactggaactctctgctcagccacgacccccggctgctcttcagacactactcgcgtgcctacttccccgacgcccgcgacatggtgcgctacctgggtgacttcgcggacacgctggggctccgtgtccagtacaacaccaccatcgcccacgtcactctggacaaggaccgacaggcctggaatggccactacttcatcctaactgaccagaagggccaggtgcatcagtgcaggtaaggccggtgccagagctcacctgcggaagctgggaccttccccacacgaaccacacaccttgattggccagtaggtatgggaggaatggacgaaaaagggtatttcgcttttttttttttttaagacggagtctcactctgtcgcccaggctggagtgcaatggcacgaggtcagctcactgcaacctccgcctctctagttcaagcgattctcctgcctcagcctccccagtagctgggattacaggcaagcaccaccacacccggctaatttttttatatttttggtggagatgagatttcacgacgttggccaggctggtctcgaactcctgacctcaggagatccacccacctcagcctccccaaatgctgggattacaggtatgagccaccgcacccggccttcaattctatttttgaaaccactctgtgatcaaagcattcttctgcaagccggcaggatccaagtccccagctgccctcccctggatggcgatcctcaccaatggaaggagcaggactttggaatcaagcctatctgtgtttagactctggctctgctgcttttaggagctctcaagccatgggcctgcagggcctgtgcctcctcacctgtaaagcaggccacataccacctccaggttgcttggaggagtcagaaagatggtgcacagatacacttagtacagggcctggtacagaattactgctcagtggatagatgtatctgtcagaggactcagaaaggggaaagtagaatgtcaggtttcatttcatcaccagcagtcatacctggtctgactgctatgtgcaaagttaggtgaattctccatttctcatactgtcatcttctcctctctcacagggcaaatttaacccccagtacagtgctagggaaaatactgtgagctcagggagaggcaagggcagagcctctcaagtgcactgggatgagggcgtaaacagatgaatgaatgaaaaatgaatgaatgaatgtcctattttcttttaggggccggcggttggagccaggcaggtgggtgggtgggtccagggagtggttttcacttagtggtcttatagctaagagactaagccatctttcctctgtccccgcctgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgagacagcagagaacatcttgggtgtcacaaactttatccatatgctcagccgctcccgggtccgtctgtcctgggccacccactacgttggagacctcaggtaggccacatccccgcatgtgtgttctgtgctgggagcccagagtgtggaaagagcctccccaaccctcccctgcccttcctgaccccagctgcactgcccagctttcctctgagtctctctcccctgcattctctgtgggctcagagccatcaacaatggcctgctggatacctaccagctcaagtccctggacgggctgctcgagtctgacctgacggatctggccatcctgaaggacagcaaaggcaagttccatgtcaccccgaaattcttcctggaagaagccaacaccaaccagagtgccgactccatcaccctcccccaggacgacaatgacaactttgccatgcgcgtgccctatgaccgggtaatccgctgcctgggctggaactttgacttctccattttcaataagtgagttccatgcggaaggaggtgggctctcctagcaaaccctcctgacccctccctaggggaacagggtggctgttcagtaggctggcgacagagctctcaggacagcacccaaagaatggatgtgagtgctgcctgatttccctccaggacatgagctctgaccattgagggtcccaggtggccctgaggcccttggtcctggagcaacaccagcagatcttcatcagcattgggagcctccacctgtgagttggaaaggccggctcagagagaatacagaggggaatttgctcgaaggcaatatagcgtagtggctgagagcacaggtgccggaattgtcctgagattctctgcttgccaaatctgtgacctcggcggaagttatttaaccacgctgtggcccagtattctcatgtctaaaatgggattcaaagtttgtttctcatatggttattgcgaggattaacataagaatatgcttggaggctgggtgcggtggctcacacctgtaatcccagcacttagggaggccgagacaggtggatcacttgaggttaggagttcgagaccagcctggccaacatggtgaaaccccatctctactaaaaatacaaaaatttaaccaagcgtggtggtgggtgcctgtaatcccagctactcaggaggctgaggtgggagaattgctggaacctgggaagcagaagttgcagtgagccgagatcacaccactgcactccagcctgggtgacgagactcttatctcaaaaaaaaaaaaaaagaaagaagaatgtgtgcagaggccaggtgcagtggctcatggtctcacacctataatcccagcactttgggaggccaaggcaggcatactacttcagctcaggagttcaagactagcctggacaacatggtgaaaccccacctctacaaaaaatacaaaaattagccaggtgtgttggcacatgcctgtggtcccagctactcaggaggccaaggtgggaggactacttgagcccaggaggtcgaggctgtggtgaactaagatcatgcctctgcattccagcctgggcaacagagtgagaccctgtctcaaaaaaaaaaagagatggctggtcacagtagctcatgctgtaatcccagcactttgggaggctgaggtgggcggatcacaaggttaggagttcaagaccagcctgaccaatgtagcgaaaccccgtctctaccaaaaatacaaaaaattagccaggcatggtggcacgtgccggtaatcccagctactcgggaggctgaggcaagagaatcgcctgaacctgggaggtggaggttgcagtgagccgagatcgcgccattgtggactccagcccaggcgacagtgcaagatctccatctcaaaaacaaaaaaagagagaggagagaaggaaggagagagaggggagaaagaaaggaaagaaagtgctgggagctaggtgcagtgatgagtacctagctactcaggaggctgaggcaggaggatcactggagcccaggaggtcaaggctacagtgtgctatgatcatgcctgtgaatagctgctgcactccaacctgggcaacataatgagaccctatctcttaaaataaagaaagtacttggcatgtattatgtgctcaataaaatgttagttgcttaagttatttatcattgtattttgaagggctattttatgaagcctagattttaaacattgctgccgactacctcgggaggtttggtatcaaagcagcatccagtctttcacttgtcttctgaccagggtgcagaaagacaaaggagaagctggtgtgcctgtccagaccctcctttccatcggcctcccaaagtgctaggattacaggcgtgagccactgtgcctggcctgacttcattgtttgtttgtttgtttgtttgtttgagacagagtcttactctgttgcccaggctggagtgcaatggcataatctcggctcactgcaacctctgcctcctaggttcaagcgattctcctgcctcagtctcctgagtagctgagattacagccattgcaccaccacccccagctaactctttttgtattttttcatagcgacagggtttcactgtgttggccaggctggtctcgaactcctgaccttgtgactcgcccgcctcggcctaccaaagtgctgggattacaggcgtgagccacctcgcctggccgacttcatctcttaaatggagatgataatacccacctcctggggtcatggtgaggtttaaatgagacgagaaatctaaggcactcagtgccagtaataagtgccactgtaataagtgcctcctggctgggtgcagtggctcgcgcttgtaatcccagcactttgggaggccaaggcagacagatcacctaaggtcaggacatcgagaccaggctggctaacgtggtgaaacctggtctctactaaaaatacaaaaattagctgggcatggtggcaggagcctataatcccagctactcgggaggctcaggcaggataatagtttgaacccaggaggcagaggttgcagtgagccgagatcacgccattgtactctaacctgggcgacaagagcgaaactccatctcaaaactaactaaataaataagtgcctcttacatagcagctattttcatgaacagccctttccactgacaggtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacaggtgagcccagctgagaaggcagaactgtccccagacggaaccactctcagcatcccagggtttataaatctactcctatgtccagaagcattaggggattgcttgtcagtagctcattgtcataaattgtcttggggaagtgacaacaggtttttgtggtctgacgacatgtttaggaaagtatcagataaagtgtaaaagtccacgcctgtagtcctagctacttgggaggctgaggcaggaggatcccttgagtccaggaagtcaaggttgcagtgagccatgatgataccactgcactccagcctgggtgacagagcgagacttggtctcaaaaataaaataaaattaagtgtaggccaggtgcaatggctcacgcctgtaatcctagcactttgggaggccaaggcaggtggattgcttcaggccaggagttcaagaccagcctgggcaacacggcgaaaccctgtctctactaaaaatacaaaaattagccaggtgtggtggcgtgcgcctgcagtcccagctactcgggaggctgaggcaggagaatcacttgaacccaggaggtggaggttgcggtgagctgagatcgcaccattgcactccagcctgggcaacaagagcaaaactccatctcaaaaaaaaaaaaaaaaatgtaattggattatatcagttctttttcaaaactctcagtaccaagggtataaattttctgccaacttgagaatgtttacaaagaaaatactaaaatatcttttaaaaacataattctatttattgcactaaaataatccccaaccaaaaattgatacttgtgattttaggagtaaatgggaaataaaaaggaagtgagagagatgaattcacgcatgttgggtgacttcagtgggctgagcactgaacacacgaccctggcagggccgccagcaccccgaaaggtgggtgtgaaatctccattttcctcaagagtgtaaaactctgaggctcagagttttggtgattttctcaccattatgggaattaaactccaaggcccaggagctttcctgaaagacactttctacaaaggtcttctcttctttcatagaaagcaaactggtgccctttctgtggagaggagtctaaaatgttagatgtggccaggcacggtgggtcacacctgtcatcccagcactttggtagactgaggtgggtggatcacctgagggcaggagttcgagaccagcctggccagtatggtgaaatcccacctctacttaaaatacaaaattagccgggcatggtggcgggcgcctgtaatcccaactactcgggatgctgaggcaagagaatcacttgaaccttggaggtggaggttgcagtgagccaagcccacaccattgcactccagcctgggcaaaaagagtgaaactctgtctcaaaaataaataaataaataaaaattagatgttcctgctcctgtggttaaccttctgagaaggacagggtgttggttgaaattcactcagtgaggcatacagtattcagttaggtggttaggtgagtctatttgaaagaatggagtcataatcttacagctgagctttaaaaaattagtattattattttttttgagacagcgtctcttcctgtttcccatgctggagtacaatggcgccatctcggctcactgcagcctcgacttcccagactcaagccatcctcccacctcagccttctgagtggctgggacttcaggcgtgcaccaccacacccagctaattttgttgtttttatttttgtgtggtagagacaagttttcgccatgttgcccaggctggtctcaaactcccaagctcaagcgatccacccacctcagcctcccaaagtgttgggattacaggcatgagccaccatgcctagcctgagcatcaaaaatgtgaaaatgtagggaattacggggagtaatctttatattctgccactcaaagacattcaatatttatatttcttttttctttttaaagacagtaaggcaggctgggcgtagtggctcatgcctataatcccagcattttgggaggctgaggctggcagatcagcttaggtcagaagttcgagaccagcctgaccaacatggtgaaaccccatctctactaaaaatacaaaaattagccaggcttgtaatccctactacttgggaggctgaggcaggagaatcacttcaatccaggaagcagaggttgcagtgagccaagatcgtgccactgcgctccagcctgggcatcagagtgagactctgtctcaaaaatcataatacaaatgaagacggtaaggtggactttattccaggttagaggactacaataataagtgtagggaccactgcagaggggtcttacagtacgggcaaaggattggactcaattctgggagtcggttcctcctggaacccaggaggcggaggtcgcggtgagccgagatcgcaccactgcactccagcctgggcaacagagcgagaccctgtctcaaaaaaataaaataaaaaatatttaaaaaaagaacttagagacagatggatttaggctgtgaaagagagggcgaaatcaaagatttctgtaggcgcgtctctgatggaaacagagctgtgaagggggggaggtttctggggaaggctccgtgttggacttgacgttccttgtgtgaggtggggccggtgggactcccacgtgcagatggcctgaagcaggggcagatggactctggcctggagaccaactccagctgtgctcactcctttgcctgttgtcttggccgcttttacactaggggcagaattgagcagcatcactgagtcgtgtatgacccacaaagcagagaatatggattgtctggccctttccagaaaatacctgctggccctgctctaaaggcagctgccatctcctcccctcatgtgttcaccacctaggcgtttgcgctgggccatggagaccagtgtgtatggcgttctcaggggtcaatgaggcctgggcatccctcccagtgaccagagataaaatggtaagtgcagcgtgccgttcctccctctggctgttccagtgcgtgctgttcaccggctcctggagcaccgccaccacagcgtcacctggcccgccactgagctccccatcacacagctgaccagctccatcgtgcggcgcgtgaatgaggcttctgggctctaccagatgttcggtgtgctggccgatgtcatcctgttgaaggagtgagtagcccgtccccaccctactcccctcggcccagctttcccgacgtgctgcatagcgcttctcttcctattccaggtgtgaggtgcccagttctttcctaagatgaaggctgctgtggggaacatgcctgttctggggaaaaacaatgacattaactctacagacagtcctgtgagtggccacgggcacattagtgagcctctctgagcccttcttcctcatctgcaaaatggggataattgtgcctaccttgcagcagtaaaggaaggagtaaaggtcacttgtggaaagtgtttggcatcacgtggatgagcagtagtcagaggcagccacgtggatctcagagctccctcaggccagggccttgccggccaccatcgtcagagtcaatttagtgataagcagcagatcccagaggatggacagttcctgagaaggaaacggtgcagagcacagaggggtgaggggcggggggagacaggtggcagggagaagcaagggagcaaccttcagtcagagggaacagcccgatccaaaggcagggcgtgctatagcacaccaagttcagggacatgcaggtagtgcagccgctttctgcacaaaaccctcgcatcaccctccatgcccctgcccctcttttttttttcttgagacagtctcgctctgtcatccaggctggagtgcagtggtgcgatctctgctcgctgcaacatctgcctcctgggttcaagcacttctcctgcctcagcctcctaagtagctgggattacaggcacccaccaccatgcctggctaatttttttttttgactcagagtctcactatgtcttgcccaggctggagtgcagtggtgcgatcttggctcactgcagcccacctcccaggttcaagcgattctcgtgtctcagcctcccgagtagctgggattacaggcccatgccaccacacctggctaattttgtatttttagtagagactaggtttcaccatgttggctaggctggtctcaaactcctgacctcaggtgatccacccgccttggtctcccaaagtgctgagattacaggcgtgagtcagcacgcctggcacccctgtctcaacaccccacatgcaaaccatgggcaagtcttgtcacctctgccttcagatgatgtctggagcccaaccagctctcacctgctctaccaccaccacctcggtcccgatcaccaggctgtatcacctgcacccatacaacagccgccccacttggcctggcgtctgttctcagcacagtaaccagagtggtccttagaaacctgaggcatgctgatcccagctctgctcagtcctcccaagcaaccagcagtgtcacctctcgggccagacgactcctcacgtctcgtcatgggaggcgcagccctccttgacctctcaaggcctccggccccctctcctgccctctgcctgctgttcactcccctcagccacgtcggcctcttctgttccttgaacacaaagtgctcacatactcctcagggctttttcctgactgttctctctgcctgggacactctttccccagatatcccattcaggttacatggaattttctggtctctaccccacatgtgcgtgagagctgagctgaaaaagtaatgttaagtgaggggtgtgctgcttgattgacgctccttagagggggagatacacacgcacacacacatgctcacccccgggctgcacccctcacctctgccacagcactgagggcctcccccgcgttgctgttctcccaggaattccacggcctttgagtacctggaggagttccccatacagatgctggcccagctggagacactcacagggaggaaggcaaagcacgggctcttcgtcatcaacatggaatatggcagaaatttctctggccccgacaaggacgtcttctttgatgaccggtctgtggggcacacagaagatgcctggcagtctaactttcttcatcctgtcatctactactatagatacctccccaccggtgagcaggtctctgcccttccccaacctgtgggctcctcagacctcaccgtctgcaaggttgtcacccaccctgaaaccttcacacacatgctcagctgacaggtgggatggctgcgggactctgcctagagaccacttgggcagaaggtccgagaatgatgaacgatgcttccagattctgacacataccgtgactggcacaggccatgcggggggtgtcgtgctctccgccaggcactgtgtagtaagagggacacggccctgctgcaggtctccagaggcggctgactgtggtggggcgggaggggtctgaagagtagagggaactggagctggttaacacagtacagagaaactgggcaaaatccctaggcctgtcattttgtcactgtgtgaccttggaccattacttaacctctctgagcctcaacctcccctctgtaaaatggggattacaacagtacctttcttgtagggttccatgaggttaaacctgacagtgtacacagaatgccagcccactgcaggcacagagtagctaccaataagtgaacaacctcgggaacgcaccccctgcttcagagcttgaagggcagtcaggtagaagagggtggtttaaacaggggttgttcccaaaggcagaagtcgtgtcagcaggtagcagtgacgggtgcaggtctgtggtcagtataaggaggcactaagaggctgggcatggtggctcatgactgtaatcccagcactttgagagaccaaggcaagcggattataaggtcaggagttcaagaccagcctggccaaaatggtgaaaccccatctctaaaaaaacatgaaaaaaatgcaaaaattagctgggcatggtggcacatgcctgtaatcccagctattcaggaggctgaggcaggagaattgcttgaaccgggatccgggaggcagaggttgcagtgagccgagattgtaccactgcactccagcctgggctacagagcaagactctgtctcaaaaaaaacaaacaaacaaacaaaaaggccgggcgcggtcgctcacgcctgtaatcccagcattttgggaggccgaggcgggcggatcacgaggtcaggaggtcgagaccatcctggccgacatagtgaaaccccgtctctaataaaaatacaaaaattagccagcgtggtggcgtgcgcctgtagtcccagctactagggaggctgaggcaggagaatcgcttgaacccaggaggcagaggctgcagtgagccaagattgtgccactgcactctagcctgggagacagagcgagactctgtctcaaaaaaaaagaaaaaggaggcactaagagttaaagctgttcagtgggggaattggtcacctccaaattcaggtttcccagaatagcgacggccaagtcttgactcgatggccatctgactggaacaccacagaagggagcccacaccagggagaagctgaactagatgagtgctgagacccctcgcctctatctgagtcttctcagagaaaggccagtttgaaagcagccacagccaggcgcagtggctcatgcctgtaatcccagcactttgggaggctgaggcgggtgggtcacctgaggtcaggagtttgagaccagcctggccaacatggtagagactagaaaccccatctctacgaaaaatgtaaaatatgagctcggtgtggtggcgggcacctgtaatcccagctactctggaggcagaggcacaagaatcgcttgaacccaggaggtagaggttgcggtgagcctaaattgtgccactgcatgacagcctgggcaatagagcgagactgtctccaacaaataataatacaaaataaaaagcagccacagtagatctcagtccatgtgagtcttagggaaacgccagcctcacgttgttagcttcagcactgccttccgaaaccacaagggaaaagcctagttcctcttcctcatggcagcctttcaaatatctgcaggtggctcttgaacagtctgaccacagcccagcataggaggctgtcgggaaagccgagcacgagtgaacgagggaagtgtttgggctgtgtgggatccgtgctgtgtcggcccgaggaggggaagcccagcctcacagctctgacatggccccctctctcctccccacagaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcaggtaacttaagctcccagaaagacaaagggtctgagctccaggttgaagaaaggtcacagagacccaagacccgtggagtttcaggacccatatctggaaatccaaaccccagactactgttcccgacaatgccgtgggttaaattacaactcacctaaaaataatggataatatgtcttcttttttttttttttgagatggagtctcgctctgttgcccaggctggagtgtagtggcgcaatctcagctcactacaacctccgcctcccgggttcaagcgattctcctgcctcagcctcccaagaagctgggactacaggcacatgccaccatgcccaactaatttttttattttttagtagagatggggtttcaccatattggccaggctggtctcgaactgacctcgtgatccgcctgcctcagcctgctgaagtgttgggattacaagtgtgagccaccgcacccagctgataatatgtcttttcaaaaggattagcagggccaggcgccatgggaaggcgccagggccaggtatgggtgggaagacagagctggagcaggatgggaggcctgtttagagacactccaataaagcttggatctcagtagggaagctgggagccaaaaccctccaaaggaggagatagatgacatgcatggttttggccctagatagagtgggagagaaaaatctctgaaaatattcaaccagtaggccctgcttatgtaaatttggggccaaacttcatgagatcattgagctatagaaatcacagaagcaaatgcacaccttctcaagaaatacacttttaggccaggtgcagtggctcacgcctgtaatctcaacactttgggaggccgaggtgggtggatcacctgaggtcaggagttcgagaccagccctggccaacatggtgaaaccccatttctactaaaagtagaaaaattagctgggggcagtggtgggtgcctgtaatcccagctacctactcgggaggctgaggcaggagaatcgcttgaacccggaaggcggatgttgcagtgacccgagatcatgccactgcactccagcctgggcaacagagcgagactccatctcaaaaccaacaacaacaaaaatgccagggtgtgtgagggagtgaattcccaccctgagttgtgggtcccaccaatgcattgtcccaggccctttagcctcctgtctcccactttctagacactgtttgactgtacaggccactgtgtgctgctgccttggactggagagaatccgcccagcaggcggccagctggcatagtggcagccgtccctctgttactgtagctgatgtgcagctgttagtgctggccccagattctgctgagcatctgagccccctgcagaagggatgatgttgtcagaaggtggtgcctgccaaacagccaccttgctgccctcccagtcttcccgctgtcctcttcctcatctgctctcttacccgcttggagaggcttgccatggcctggcctcccaggggcctccatgctaagagtcagaaataaacaggaagtcatatttctggagcacctttcagcctggtcacccatggaagcctcacgacatcctttgtgctgtgcccatttttcacttgagatagaggggctcagggaggcaagaaggctcgctcagagttacagaaggactccagcccattcctgacactctgtctgcccttgtctctaactccctcagaaggctgagcccatatctgtgtcagctcttctgtttgtttaaagtcttataagtacttggctaaatgactttttctcactgtattagtctgttctcacattgctataaagaaatacctgagactgtaatttataaagaaacaggtttaattggctcacagttctgcaggctgtatggacgcatggcagcatctatttctggatgctggatcacgcctgtaatcccagcactttgggaggccgagaaaggcagatagcttgaggtcaggagttcaagacaagccaggccaacatggtgaaaccctctccctacttaaaaaacacaaaaattagctgagcgtggtggcgggcacctgtagtctcagctactggggaggctgaggcaggagaatcacttgaacccagaaggcagaggttgtagtgagctgggatcgtgccactgtactccagcctgcctgggcaacagagggagactctgcctcaagaaaaaaaaagaaaaagaaaccactcctgtgatgcagtcacctcccagcagccccacctccagcattagagattgcatttcaacatgagatttgggcggggacacagacccaaactatgtcacccgctttccctaccttcattctcattcccacgaggaactcccagacctagcggttgttcctttcagtagcttctctctttgcatggcttcttttggttgtttcttcatatttctttttctttcttttttttttcgagacagagtctctgtcacccaggctggagtgcagtggcacgatcttggctcactgcaacgtccgcctcctggattcgagtgattctcctgcctcagcctcccgagtagctgggattacaggtgtttgtcactacgcctggctaatttttgtatttttactagagacggggtttctttctcattatgttggccaggctggtctcgaagtcctaacctcaggcgatccaccggcctcggcctcccagagttgtcggattaaggcgtgagccaccacgcccggccgtttcttcatatttctacatgataagtatccacagctatcttatgattgaccaaatttgattcatgcaccagctttctgttgtgggacagatgaggatatacccgtttttctttatcccccacactgtttagatcagaactttgcacatggtatttgcaactcaaatgttgttgagggactgcgtctttgcaggcagatctgagctcacagtggaactgaccactgagttcccagccgcaccaggccgagggtctgctcatgaaggtcggagccccgcccccagtgtggttgcctgcagagcccggtgctcagccctgatgtctgggagctgaggcattgctgtggtttgcttttattttggagccttgttcttccagagtgtcaaggcagccccctgccctggagcctcgtggagggtcatgattcatgacctactcaggttggacgtgagatgcccagaaaggtcagctcccagtttcaagggatggaagataccaggcaaggcctgcagtgaagcccccacacctggcattggcagctcccctttctgcacccctccccacatgtcccagcctggctcattctcctcattttgcttttgtgtagagtcctgcttcctgttcgccctcacgcgccagaagttgccacccttttgccagcaggggtacctgaggatgcagggactcgtgagtaccgagagcctttggcagcacagagtggagagcaggctcctgcgggactatgcccccacaggcaggcgcctggaggacagcagccagcagcttggcgaccaagagccactaggttcccccctggctccagggcctctggctcagtccgtcgatagcaacaaagaggagctctgactgtcccttcctaagctgtgggcacagtggccaggcctccccacctaggcccatggtcagtccctctttccccgcaacctcacactcccgccaatgcgtgattgccaaagaccactcagatcatggcagtgtctgcagcaaagccaccagatggcacgtgagggctgaaagtcggggatgcggtggtctcctccctcctgtcagggggcagaagggcatcctctgccaggtgggagctgccttccccagcccagtttgtctgcaatggagctgtcgctgagccccaggccagcccagttctgccccgtctcaagtgctcctcttccttccaagcccctcctcagatgggcctgcatcccgcctgtggagtgcttcacaggggaaacccatccgcatcttaagagtttgtggcaagcgctttaaaacaaaagctctgatatcctcaacaaccacaatgggcaggtgggattgttgccccagatgactgctgaagacaccagctgtgggatgtcaagtaattccagggacccccagctgggagtccccgtctgtgtcacttgccacacactgcctcaacctccccgccccattttcagcagggtttgggcttagctacagagcccaagagggtcagccctgcttatcatcataggcccagcaggctgatctcgagcagcgataggacagctccctgcaaagccatcttagcaactttctcactgagaagcaggattcagagctgctctccccagttgcaccccctgactcatcttccagctggctcttctctcccatcctactcccttctgtctccctgccctctgccatcctgaaccatgccttgcttctaacctgcctggtcaagttttgtgaaacttatcctgctgtctcgggctggcacccatatgtgctcaccatgtgtaaggtgacatttccaaatgcctttgtgtgataatgatgatgaatttggttcctagtctcttcttcattgcccttcctcaccagcaatctgcactttcccatcaggcgtcttagtctcatttgtaagtgcataagataatcacagtgatttttcaaagcccaggatcataagtgattgctttttcactggttcttactaactcttcatgtatccactcagaattccaaggacaatcccagcactctgggaggcccaggcaggtggatcacctgaggtcaggagtttgagaccagcctgaccaacatggagaaaccctatctctactaaaaatacaaaactagccaggcgtggtagcacatgtctataatcccagctactggagaggctgaggcaggagaatcacttaaacccgggaggcagaggttgcagtgagccgagattgcgccattgcactccagcctaggtaacaagagggaaactccatctcaaaaaataagttaattaaattaaattaaaataaaacatgcgctgggtacagttgcttacacctgtaatcccagcactttgggaggccaaagtgggccgatcacctgagctcaggaattcgagaccagcctggccaacatagcaaaaccttgtctctactaacggtaaaaaaaattagctgggcatggtggagcatgcctgtcatcccagctacttgggaagctgaggcaggagaattgcttgaacctgggaggtggaggttgcagtgagcagagaccgagccactgtactccagcctaggtgacaaagcaagacccacagtaaagcccccacaccccatctcaaaaaaat

SEQ ID NO: 38619 - DNA, 15593 bp, Homo sapiens
tcacggtctttaccgctcagcttcccggagtccgcgcaggagcgcgtctgaataggaagcgttttcggacgtggatgcggcgttttgtcgctgccagtggtgtctggagaggttcgggctcgggtgagtcgagttctgggcatggactcgcggcctgtgggtctgtgtaccgatggtgcgtggagcgtcctgattggggctgtatttgaacgcagtcgctgaggaagcggggcgttaatgacgggtcctttggctgtagggatgaagagtctgaggaaatcagcgacgagtccgactctgtctgggtctggggcccttgtgagtcaccctttacgggtgttgggctgggggacggtcaggtctttcccttcccatgaggccctatctcaggctatcacatgggatattatctttcctgaagaatataacatgtgctcttgaaaaaaatgtttattttactgctgttgagtgcagtgttaaatgttcgttaagtctagttggttgataatgttgttcaagttttcggtatccttgctgagtttctatttgttttctttattattgcaagtagggtaatgtagtcttcaattattattgttgaattgtctaatcctctctcattctgttttgcttcatacgtttttaaattatcatattcttatatatacacccttatattattattgccagccattgtaaccattgttgccactcacctaggccttggtgtccagagttttattggatatcagttaacacacacacacacaattgactgcctatgaggctgacttcaatctccagctcctccagatatcaaactaataccacgtggtccaaggtctcccacagtaaatcacattattaggatagacaatttggcatggcttaaattgccctgataaccaaagacagttttatcaagcagcgtattccaaaggcttagagtttgcctcataggaactgtgggcaaaggacaaagctctcttgggtaaagttactcctttagcgcataatgtgaaatgagacagttcttgtgatttgcttagtacattggtcttgacacgaggtatgtatacccaaagagcttacagagactttcgaaccagtacatgggcacacgtggtttttaaagacattcttggagccttccatgtgttctctttcctaaaattgatctgtctgagaattcaccttgaagggggccacccctccacaacctgtgggtgtttcttgtcaggtgggatgagagactgagaaaagaaataagagacaaagtatagagaaagaaaagtgggcccaggagaccagcactcagcatacggaggacccacgctggcactggtctctgagttccctcagtatttattgatcactatctctaccacctcggagagggggatgtggcaggacaataaggtaatagtggggagagggtcagcaggaaaacatgtgaacaaaggtctctgtgtcataaataagtttaaggaaacgtgctgtgccttgatgtgcacgcacacaaacatttcggtacaataaagagcagtattgccaccagcatgtctcacctccagccctaaggcggttttctcctatctcagtaaatagaacagacaatggggttttacacggagacattccattcccagggacgaggaggagacagatgcctttctcttatctcaaccgcaaagaggccttcctcttttactgatcctcctcagcagagaccctttacaggtgtcggggtaggggacggtcaggtctttcccttcccacgaggccatatctcaggctatcatatggggagaaaccttggacaatacctggttttcctaggcagaggtccccgcggccttccgcagtgtattgtgtctctgggtagttgagattagagaatggtgatgacttttaccaagcatactgccttcaagcacgtttttaacaaagcacatcctgcacagccctaaatccattaaaccttgagtcaacacagcacatgtctctgctagcatagggttggagctagggttacagattaacagcatctcaaggcagaagaatttctcttagtacagaacaaaatggagcctcttatgtctacttctttctgcatagacacagtaacagtctgatctctctttcttttccccagacacctgcctctgaggcattgtgctgtgctggttctgctttcccaccttctctataatagtcatgccacttctacttcacaaaagaaaggcatagatttcacacatttagaaccatgaaaacctctgaggcagcaaataaaggaactgttagaaatattagggtcttttatttaaggtaagtgcagagcagcagtgacaatgtctggacccagggttaatgtacactgaaagccattttgtttatcagtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggtgatattttccctttgattttttgatagatttatggtggcctgaagaagtcagttgaacttaaggaagtatatactgggataattgtgttctagggagaaattaacttacattgcttttgggagtagaggtgggggttcattctgccttaagaagtagattctggatcgcttgagctcaggagttcaagaccagcctgggcaacatggtgaaaccccgtctctacaaaaaatacaaaaattagctgggtgtggtggtgcacacctgtaatcccagctactcgggaggctaaggtgggagaagaattgctagagctcaggaggacgaggctacagtgagccatgtttgcaccaccgcactccaacctgggtgacaaagtaagaccctgtctcaaaaagaaggaaaaaaaagtagactcaatatgaaagaatccatgctttgttggtagttcaacttttgaccattacaatgatacatgaatcacccaccactcaagaaggaactatggttgtcattttaatgtacatactccagaccatttttggaatattggcattctttgcatgctggtgcctgccaaccaacttttttaaaattactaatttatttatttatttattttgagacagagtcttgctctgttgcccaggctggagtgcagtggcgcagtcttggctcactgcaagctctgcctcccaggttcacgccattctcttgcctcagcctcccaagtagttggcaggagacagatgccttcctcttatctcaactgcaaaaaggccttcctctttttctaatcctcctcagcacagaccctttacgggtatcccccggtgtcatgctgggggacggtcaggtctttcccttcccacgaggccatatctcaggctatcacttgggaagaaaccttggacaatacctggctttcctaggcagaggcccctgtggccttctgcagtgtgttgtgtccctgggtacttgagattagagaatggtgatgacttttaacaagcatactgccttcaagtgcttttttaacaaaggacattctgcatagccctaaatccattaaaccttgagtcaacacagcacatatttctgcgagcacagggttagggctacggttacagattaacagcatctcaaggcagaagaatttctcttagtacagaacaaaatgaagtctcttacgtctacttctttctacatagacacagtaacagtctgatctctctttcttttccccacatctgacaccagatatgtggggtttttcccacacatcaattcaattctccatacctattaggtattctaaaatttactcaattctgacactaattgtctagacttaggacagactccacaggttgagggctcagtcccacaatactgcccccctgaaaagtgctgggtccccaggttactcacaagttcttttggacttggctaccaattggatgtccccacaacccccttctcagatctattcatctgctagaaggctcaaaaaatgcaggaagacagtttacttactagattactggcttattatgaaagggtacaactcaggaatggccagttggaaaagatgcataggtcaggtaatggggaagggcctcagggcttccatgccctttctgggtattctaccctcccaggactaccctatgttcagcagcctggaagctctcaacctcatccttttattgttttggtgggttcattacataggcataatttattaattcattaactattggtggtaagctcaatttccatcacctctcccttccacagaggtcaggggttggttggagaggtgagactgaaagttccaactgtctgtcacaaggttggttcccctggcaaccagctcccttcctgaggccatggaagagccccaggcaccagtcatctcaatagcatataaaagacacttcagcaattccaaagatttggagggcagagaccaaatgtatatttatttttcacagtctggtatatagaaagtgacacggataagtatatttggtcattgttcccagttcatggcacagtatgcttaaaacccttggaatttcttcctgagaaataggtgtgtcttttgttattcataaggaaaccctgtgatacacctgaatttctgctcatgaggtgactactcatgagacctctagatagtgtcaggatgagactggtccccagaaagaccaagcaattagaggattggaactgaaaggaggaatggactggagagtaagttctataaaaactcttgaacaggctgggcatgggggctcgcgcctgtaatcccgagcggatcatgaggtcaagagatcgagaccatcctggcctacatggtgaaagcccgtctctactaaaaatacaaaaattagctgggcgtggtggcacgtgcctatagtcccagctactcaggaggctgaggcaggagaatcccttgaacccgggaggtggaggttgcagtgaactgagatcgtgccactgcactccagcctgggtgacagagcgatactccatctcaaaaaaaaaaaaattttatttattattattattgttttgagacagagtctcgctctgtcgcccaggctgtgagtttttttctttttttttttttctttttttttttttgagatggcgtctcactctgatgcccaggctggcgggcactggcatgatcttggctcactgcaagctccgcctccggattcatgccattctcctgcctcagcctcctgagtagctgggactacaggcacccaccaccacacccggctaattttttgtactcttgaacaagcttcaggtttgtgaacataccagggtgctgggaggatgccacacgcagagaggaatggaagcttggcacaccctcttccatatcttgccctatgcatttcttcagtctggctgttcctcagttatatcctctattattaactaggtaccataggtaaagtgtttcctgagttctatgagctgttctagtaaattatcaaacctgaggaggggtttgtgggagcctctaatttatagccagttagtcagaaatactggtagcccaggacttgtgactggcatcttaagaggaggcagtcttttttttttttttttaaattatatattctccaatttaaaaattttaattgaaaagtaaactttaatgtcgaaaatgcaaacttggggagggcagaaagatcacacacaaggctgtcacttcacacttggagggtcgcacagcagccgcgcaaaggcgctcctcacttcccagacgttgcgggggccaggcagaggcactcctcacttcccagatggcggcggtggtgtggggcggccgggcagaggtgctcctcacttcccagatggtgggcggctaggcagaggcgcttctcacttcccagacagtggggcggccgggcagaggaactcaagaggaggcagtcttgtaggattgaacccttaaatctgtggattctgacaaagatagtgtcagaattgaattgaattgttggacatctagtttatgtttagataattggagaattggttgttagtgttggaaaacactgcacaaaaacattcagtgctgcaaatcttgccaacacttactatgttatcaaattgtgtattttccatgatctagatgatccagtattattttgccttattttgcattttcccattcaccagtgaggttcagatccttctcatctctttgttgtttctttggattatttattctgtcataaagtgtctttagtctttgttcatttaatttttttgtggtcttactgatttataattgtttatcttgactggatattgattcttttatatgttgcaaatatttttctagagtcttacttctcttttagcttgttcaaaatattttttcccatgcagaagtcattttttttaaagctttttacttatatcatgaacatgttttcatttattccttttttttttttctttatttgagacagggactcgccctcttccccaggatggagtgcagtagcacaattatggctcactgcagcctcaaccaccatctgcctgccttagcctcctgaatagctgagaccacaggcatccactaccacacccagctaattttttgttctttgtagagaatagagacagagtctcactatgttgctcaggttggtctcaaactcctgggctcaaactctcctctggaagtactgtaattacagatgtgtgccccactcctggcctcataagttcttcttaagtttacatcttatattcattgtctattaatacctaagaaattactccaaaaggtagtgacttgaaacaacacttaaaaaaaaaaatctcacactttctgtggctcaggaataagggcatggcttacctggctactttgattcacagtctctcatgggggttgtcgtcaaggtgttagctgggttggaatctgatctgaaggctgaaatggggaaagatgcagttctaagctcacttatgtggttgttgggaggattcatttccagaatgagaaatgaggtagtttagttgaggtcctcagtttctacctgtctgtttgtcaaagcccacttttagttttttgtcacatgcacctcccctatgtgccaaattgtttaatcaaagctagaaaatgacagattctgctagcaagatggaagtcatatagagtgtaatcttaaagtggcatcttgtcacttttgctgtattcttttctttagaaacaagcttttaggccacttcatactcaggaggatggtactgcacaggggcaggaacacctagagtgtaataaagaatttggctagcctttgttttcgttcctgggaggtaacctctaaacccttgtaattacccaagttatgagtgtctctgtcattcatggtgggccactcatatttgatagtttatatctatatgtatagtggtgactcatagtagatccctagataatttatggcaatgacatgactctggataggggctgcccatgccaaaaagcgcactaagtgattagagagttgtggctttgagccatgtaataccagtcaggaaggggagggaactggagactgaactcagctacatgggcaatgcttcaataaactgtgcctacatcatgaagtctcaataaaatctctggacatcaaagtttaggtgcgcctcgctggctggcaagtactcttgaatattgttacacaatgtagtcaggaagatgtaatgccaccaaggattccatgaggagaggacagtcagcagctttgtgtttggaaccttcccagacctcaccctgtgcatattttcctttagctgattctgatttgtgtcattttgcaatagtaaagtgctaattgtaaacacagcactttcttgggttctctgagttgttctatcaagttattaaacctgagggagtcatggtagctccacacatttgtagccagctcgctggagttgagggtggtctgtgtagccttaagcttgcagcttgtgtctgaagtgagggcagtcttgtggaggattgtgcttttaacctgggaagtttggcctaacccaggtagttgatgtcagaagtcactgcagctagagaatgagattatcagaggacaccttagagttggcctgcaagatttccatccagtaataaattcttttggactgtggagtgaggtagaaatttaactttacacttacccagtcgatagacatctcacataaagattttggaatgagataaactgaccaggcttgagcacttgcgcactctcatgagtctactttcttgactatgcagcatcccacacagtaatatagcatagattctcttatcagtatttccttggatcttagttacctctacttcacactctgcagttctctgaaaagttattgtgaagcaggagaatgacagtttagttgacaaacaggtccttgatatcatggttgtaagacagcaagtcatctgctagccatgtgttttaatcccaaatggccttccaaaattggccttttttgttgcaagaattaggactttgaagattgtattccatacgtttctggattctattattgaaatgtcagccatcagtatattttgttatttctttgtaggtaatctgtcttttgtctcttgatgattctatagttttccctttgcatttgatgtatggtagtttcagtctgatgtgtcacaccagttgtgacttcctgctctgaacttgttgggatttctgaatttgagatttgaggtatttagttctgaaatattttaggttttggatatttattaatagatattgcttctctattacactattttcccttttagaaaccataagtgggcatacactaggtcttgcaactctgtatttcatatttattaacttctttgttatgatttatcttttttctctgtactgcattttctgccatttccacttatatattccaattcaccaataatcttcaatgtatctaatatgctgttaatctgtccattaatacacatatgtatatatgtttttctgttagaagtttttttttgctgggcgcagtggcacacacctgtaatcccagcactttggaaggccgaggcaggaggatctcttgaggccaggacttcaagaccagcctggtcaacataacaagaccctgtcactacaaaaattggtagtagcatccacctgtagtcctagttacttgagaggctgaggtgggaaggtcgcttgagcttaggagttcaaggttgcattgagctattactgtgacactgcactccatttggggctacagagcaagaccatctctctttaaaaattaaaaaataaataaaaatctaatcaactttaggggccttttgtgctttatacagatatagtttcatcttttctcttacatttatttaaaagcactattttatgaattcaagatgtgaagtctattcatgacagatccttatattggttgtgaagtcattggtaatgtagggatgttttatttgtcctgatgtcatttgcctacgtttaatatttagaaataggcgctaaaatgtatagatagaggattttgctcctaccaaagtatatttgagaaaggaatatagatgcaggctgtattgtgaaaatttttaaaaaattatcttatacttctatattaacaataggagtttatatcatattgaataggactttgtaattacaggaatcactgaccctggaggatgtggctgtggaattcagctgggaggagtggcagctcctggacactgctcagaagaacctgtaccgggatgtgatggtggagaactataaccacctagtatcactgggtaagaatagtttccctgtgtcacctagaggtgcctacaatgcccagacaccgtcctatgctcacctaatcaaagctttacagtcactgtggtgtttggaagagttacattttcagtcccctctctgaccccaaagtggtataatctcttctaagacagaatgcttactttgaaattgttttcttcatcgaatgtattatttttccatcttgacatactggactccaattcaggatgtttgtgtttgtctttcctcatgaacagggtatcaaactagcaaaccagatgtactctccaagttggcacatggacaagaaccatggacaacagatgctaaaattcagaataaaaattgtccaggtaagtgagaaccagcaaggacagtggctataggagtcttattgtagtcattaaggaaaggtgtcacatatatgaagtatctgagggtacctaagcagctccactatatattcatctccccatctgataacttttttaatgctgttatagctttaaagactttttgtcttttcttggatctgatttcttggatatatttcagcttatatcttcataatttccttttatactgggatcgtagagttgacaataaagagccagcccccagcaaatcatctcataagctaagattttttttttttttttttagactgagtctcgctctatcacccaggctggagtgcaatggcccaatctcggcttgctgcaacctcgtcctcctgggatcaagtgattctcctgcctcagcctcctgaatagctgggattacaggcatgtgccaccacgcccggctaattttgtaattttagtagagacggggtttcaccacattggtcaggctggtcttgaactcctgacctcgtgatctgcccgcctcagcctccccaagtgctgggattgcaggcatgagccaccgtgcccggcctcataagcatttttatctcatacaattctcatggaagaatttgttactctgttctttcttaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggaggtgagaaaacacttctacatggtaagcatgaacgtacgcatactaaaactagattttctgaaaatgcaaaatgtatccatactaaattccaagtcttcaagcatcagaggactcagaaaattgagaaaccccatgcatgcattgaatgtgagcaaaccttccttaggaagtctcagctcatttaccatgagaacatttgtatacaagagaatcctggaagtggtcaatgtgagaaattatccagaagtgtcctgttcactaagcatctgaaaactaatacaacagacaaaatctgtatacccaatgaatatagaaaaggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcgttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtggagatgttttgagcaataatttctgctcatatgtctgaaaagtatacagagataaattctgtgaatacaaagactaagaaaagtcttctgtggaaagatagactttattatcaggtttcatcatagatttcaacgtaagtgagcttattgttgatagaaacatgatgaccatgacaaagtctttactcagaaatatgacctcagtgagtgtcaaagtttacactggaaaataactttaaggtgacagtattgatggcaggatttcagcgacgcactctgcttcatcatttgtcaggagatcacatagaaagtaaaattgttccgaacatgctatcaaataaatgtggaacacctttagcaaactatcaacagctcatgaaggcatgaaatgtggtgaaaatgatgaatatttgagtgctttttcttaataagtataaccttaaacatcagctaatacacctggtgtgcattttcagtcaggataccttaatcctcatttctagttgccttgccaatgattccataatatactgtctcattactgtttatttttactgttgtgtaaaattgtggtataatgagaaatacatttggtctttgttcctggttcctggcatagagctcctaaaacgcttagaatttcatgagtgataagagttttttggttttgttttgtttttgctgttgttgttattcatagcactgcccttttaattacacctgattatactactgaagtgacttatggttgctcccctagacagcctcagaatggggctgttctctaggaagatcaagtaactagaggatggagactttgtgccccatttctcccacctcctggaaggggaggggtgctggagattagattagacaatgagattaagagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaactaagattatagagatgatcagtttataaaaccaccttcaacttaaataaatttgaactcgaaattgcaaaagcagtctagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtgaaatctacatacagcttttgcttttgcttttttttttttaggatttacaatcttaacctcttttttttcttttttaagagacagggtctcttgagaggccgaggcaggcggatcacttgaggtcagaagttcaagaccagcctggccaacgtggcgaaaccctgtgtctactaaaaatacacacaaaaaattagctgggtatggtgctgggctgttgggagccgaaggcccatgggatgtgaccaactcagcattccactggaggctatatgatcaaacagcaaactttatcatgaatgcacgatgtgggcaaactcatgactgcttccgctgccagaaggtttgctgagggcaatcgcttcctggtgctgagctccttgaggttatctactgggacatctagagaatgccatcttgcaaaccctactctggactgagtagctgaccccttcttccacccgccttctcactatctcttttgcctaataaatatggagggctgtgtaaagctcagggcccttgtccactagaggcaaggtgtcccctgatcccttcttcc

SEQ ID NO: 38620 - DNA, 75829 bp, Homo sapiens
acactgcctcggttcggcaagtgggtcagttggctggggctcacttggcaacgggacgcgggaacgaggggcgcggacgcaggcccgggaggacgcggcggcgggaacctgggggcgcagggctagggcagcgggcccgacccgcacggctttcctggaaagcgctgcccctcgccgcggcgatgccctcgctgtggagagaaatcctcttggagtcgctgctgggtaagccgaagcccctcgccgcgagttcgcgggtgccagctccccgggccatgtccagagccgtggagccaggccaggttggctgagttcaggtaggaggaaaagggcgctccgtgcccagagtggagatgcttatcgtcccctgggaacttttcctactgaagggaataaaggaaaagacctagattgaagtcttcaagctgagtctgcgaggcgcccgcgagagaccccgtcgcccgagttcccagcagccctgggattgtgcccaaggagcgcgaattctcctcgtgtcggccttgaccccgcgcggccggtaccgtccccaaagccccccacccgtggcctttaagtttaacttaatacagttcagtgctgaactttaaaattcagaaggaaaggggcacccgttttccccaggagctgtaggtggacactgggcggcagctgctgccgtgggctgggcccaggacaagtggccttggtgtcggctgcacacttgggcatttggcgaaaagcatcagactcgagtctcatctgctctctcaccagctttgcaaaatcccgaggacaattttattggtgtaattctgtcggagctgtgtgagtaataaaatcaaagttcccagacaaacatttgggatattgctagaatccccggttcgttacaaaacaaagatccctctggtctgggtggggcgccttcctgagaacttgattttctgggagctggtaattctcgggagtgcttcagactatttttttctggctcagcctgtatctataagttgggagatgtacagtgcctagcattcaataagtacctcaggtgctaggtactcagtgcacttgatctcatttaatcctcccaacaacactgtgaaggggttgaaagtcctattttgctgattaagaaggggaggttggaaagtcagttggtagaaagttcccacgcccagtggttagaccggctacctttggagccaggctgcttagagttagggcaactctgacatttgctacttgtgtaaccttaggtactcacttaactttctgagtctcagtgttttgtttgttgttttgttcttgcttagttagtttttgcatttataagaggggagcggaaatagtacccacctcatagcttatggggctgtataaggaatgagacagatggtacatgttaatacttagcacagaccctagtgcatggcaagtgcccatagcgttaattatcattattgctcaagattatacagcagctgttggcagaggtacaacttacttcagatctgggtattccactacccagcactgcctcataaggattggactgaaaatggtctactcaagggaacgactgctgcctcactcaagtgcttttgggtgtagtctggggttggaggagggagtcctgctgcttgctgcccttttggactctcacaatatttttcattatacaggggacaacttaggtaagaaaattttgtcagtcagggtcctgacgggatgccaaattcaactcagatggtccaaatgaataggacttaataaagagactgtctacagccatatgggcaagggaaaggaacacgcaagggatgttgagagactcacggcagcaggaagccatcctctactggggcctgatgcgaggagtgggagaatatgtacatttcaccagaaatttcacttctgggtatatatcctacagatatactcagtgtcatgtgttacatagtgacatttcacgaggaaattgccattgcttttctgtccatcagtctcttaagcacaacacagtcagtgcagtgagttctgcggatccctacacaggtgtagagctcttgttttgttccatgtcagtggagacaactggaacccagttcaggccagagtcatgaagaagaatgaccagcccaagcggctggagtggagggacaggactgtcgttagaaacaatgttgaagttacactttctctctttaactttttttttttttgtaggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggtaagatttaaaagagtttctttaagttgttttttttaagttaaaaatcaagtgagattatgtagactgttctttgaatactaaatatttgaatttaaaaaatcaaagatttctcttttccttaccactgccttagaagagctttagtaattggaagactagactgagagtcaatgtgttttacatttccattgttttttccagactagaaagacctaaaaatcactgcaatgagtaggggaaagacaccttaaagaactgatcagctcttgaatacattgtgtttttctttccaactgtgacataacactcaggagccatttaaaaaagtttgttaaataataattcacaagaaatgtgaaaattatgatgaaaaacaccacagtaagcagtcaaacaagaaactaggaaaaatatttgcaactctttcagccaaagggctaatttctcttatatatagagttcctacaaaccaataataaaaagagaccaacaaatcaatagaaaagggggcacaggatctgatcagttcactggaaaggaaatacaattagttcttaaaaatggaatcaaatgtataggtcataaatcatacacatacagatatgtttatctagagtttgacaagtagattggcaaagaacagctgagtcttactgcactgtgcagtaggggtggggaaacaggcactcatacattgcttgtgcgagtgtccattggcacaacctctatgaagaacaatttagcagtattatcaaaattacaaatatgcatatttcaccagaaattccacttctaggaatatatcctacagatatactcacagtcatgcgttgcttagtgacatttcactaggatgttgccatcgcacaacacagtcagagcagtgagttctgtggatccccacaaaggtatagagctcttgttttgttttgtgtcagtaaagatgaagtcttgctatgttgctcaggctggtctcgaattcctgagctcaagccattctccctggcctcccacagtgctgagattataggtgtgagccactgctcatggcctagagctcttgtttttaaaacaactcaggctcagaaggatagtggtaaaaactcctgaaaagtgtgccctttacaaaattggtgtccataggaattgaaagacatgtcaaatggtcttgaaattttcagctccagaaataacaaatgaagtttcctacccttaactgagtaaatattaattgatttcaactggcattggcttacagtatccttacatgaaccaccgtagctccgagtcttgcaagattcatttccttatcacacttcaggttgattttatgggagtgatctcataggtggtactttcttgtcacctttggtgctgcctatgtgggccttacctatagatccacagactgagtagttactgggacagtttccattacttaagtccatttttggcccagtaacttctggtgatggtaagggatgtgatataaaataagtttggggtagatattgtattttattttgatgcttcctattcccttttcactttcttcctccatgaaaacacatccccttgagcagaagtagatttatatttggaaatatggaataggtagggaacattactcagagttgaggaggaagtggccaatctctgctaagtgctgttccaggtgaccattgagctttgttgttgctaacagaggctaaagtaagccacgatttgtcttaaaactcccttcaaatacttcttaaggacatgaaacaactttgtttttagagtcctgagatattcttatataaatacagagaggatctgagcattacatgccatctcacttctggcacctcagatattttaggttaattactgtgtaattaactatgaaaccagttcatactcctatcaatttagattatttttgatccaccagaaaggctataatcaaaaaagacagacaataataagtgttgacaaggatgtggggaaattggaaccttcacacattactggtagaaatataagaaatataaaatggcacagctgctttggcaaagcgtgatagaagctgttatcatatgatctaacaactctattccttggtatgtacccaagaaaaatggaaacatctgttcacacataaacttgtacacaaatgttcatagcagcattattcatgagagccacaaaatggaaacaacctaaatgcccatcaactgatacatggataaacaaaatgtggtatatacatgcaatggaatattatatagctatgagaaataatgaaacactgatacatgctacaacctggatgcaccctgaaaacgttatgctaagggaaagaaggcagtcacaaaaggccacatattgtacaatttaatatgaagtgcccagaataggaaaaattcgcagagacagaaaatagattagtggttgccagaggctagggcatgtggagagaagggaatgagaagtgacctgctaatggggatggggtttctttttggggtgatgaaattgttctggaattagataatggtgattgttgcacgactttatgagtatactaaaaaccattgaattgtatattttaacatggtgacttttatgatatgtgaattgtatttcaataaaaattttaaatacatatataaaattatacatcaactctgtcttcctgagtataaagatggtatcagataacatgcatcaaatgcagatcacggagttccaatccatacttgccagaaatgcttagctctccctattttgtttgtaggcagcatagcctccttccaggctccaaatgccaaacttcgactgatggttcttgcgcttggggtgtcttcctcactgatagtgcaagctgtgacttggtggtcaggaagtcatttgcaaaggtatggttaatgtttcatgtacttatagacaaacaagtataaccagttaccaaagggaaacctggggccaggagttccaggttatagtttttaccttccatatggctttgtcaaagtctccttttttttccttttcccaaaacaaggacatgaatacttgccatcaatctcaataaggttttgaaaactaaagaattatagcaagttgctgaagttgctatatagaggctaaatcacattcattattgcaaattaccaataagactatttcagctacttattctatgaaactgaaattcatgatggacatagtacattgagtccacataaaaagtgtttaaaaatacttttgcacttacaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacaggtaatactgtaacttaggaattttctctttgcagagcttacctttcctatgtgaatgttgcacatcttggaaagaaaatctataaaagtagtctttctgcattatatctatatttcagctttttcttcctctgaaataataattggtgcagccagtgggctatttgctaagcaggaggcacattttccttgcctgtacagacagagggtgaaaataaaataccattactggtttgtagcactgtggcagtgggagacgagaaccaggcctcatatcccagctggcattcagctctgtcttcctccttctttcccctggtcagagctctctaggatgggattctccatcctccacctccacactgacctcagtacatctgtaacactaaggaaagtttctgtcacgtatggctgtcactggaactccctgggttttttttcccagaggtctgaagctccaaatctaagaattgaaaagataagaaaccttgcatatgcatactgactttccaatcacctgtctctcccaggggccagctttctccgagacagaaacatgcccagcttagagtttgtttcataaaccaacccgagactcttctaaaaagaagggagaggtattagtggattctagttaacgtgctcctagctttttgtgtaactctcagtgagtcactgttcttctgtaactacaaggtgaaatctcacagactaatggaagtttagagggtattggctcaccaaaaagtgcttgtataattccccctgtggcccctagtttggcatgaaatgagaatagagggaaattatgtcagtaaattggccttgtgatgttaatagtagaagacttagaactctgtctggtcccctaacttatgttttacattcatatctagaggcagagactcgggcagcccattttgccggtacagcctgataaagatctgaacttcagggtactgtttacatctcctgacttttcttctatctggcctctgttttaaatgtatgtgacccagttcctggctggcagtcccttcctccatttctgctctgtgccttcctttataaaactgactgttcaccctgcaccttctcagcctatctgagcataccaagtattttttgtagtttcctttgaagatttgttgggtcctgggtgggggtggagtcacccactgtaatacactgcattttactcagcaaattcagtttagatggctctttttcctcaaaactctccgctgagcccccagacccctggcctcccttctgtcaccaccgccttctcccattccatcccatccccatagctctcggctctgcccctcctcactctgatcctgttaatgtcagagaagctttcttgggaaattagactgccagccatactgtcagaccctaagaccttccttctgtcctgtagagggctggatggggtcacaaagcatctgcccaataggctctctctgtttctacgaagaagtcctcctgctggcatcttctccagttgttacagttttgtgtgtgaagtcattgctgtgatgaattggacctcttggttaaacagtaccaaagagctacactgcctaagctccaatcccaggttcctaggttatctttactagctgtgtgaacttggaaaggctacctgatctctctgtgtctgttttcttgtttttgagatggagtttcactcttgttgcccgggctggagtgcagtgtcacgatctcagcgcactgcaacccctgcctcccaggttcaagcgattctcctgactcagcctcccgagtagctgggattacaggcgtctgccaccgtgcccggctaactttttttttttgtatttttagtagagacagggtttcaccatgttggccaggctggtttcaaactcctgacctcaggtgatccacctgccttggcctcccaaagtgctgggattacaggctcgagccactgcatctggccctgttttctaatttgtaaaataggattaatagtagagcctacctcataaagttgtgaaagttaaatgagttaatataaagttaatatacagggcttggaagaggggttggtgcacagtggctgcccagtcaatgcactaatattactctgcacccacagagggttagatgagagccctgttctttgggaggaagcagcttgtgtactggaaatgttccactcaatttgtacaacatttgttcacaaacacaaacactttttctgcaatgcgttagcttcacatgaagcaaataattttctgcattttcacctgttgaattccaaaatgccttttctcccttaaaccattccttatctggcctgcatggaattatgtctcccactaaatagctgtcagcatgtttagcttcatattgtagttgcatgtctcatctcctcttccgaagtaagcttcttgaagccaaataccatttcttccttgctaaaagtctgctaaatatagagcgcaaatttccatataactaaactttttccatatatgtatttttaaattctagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttgggtgagtttgggtttggaagcaatcacaaaatcggcagttatgcctggaggaagcaatgcctcctttgtcagacagctaggtctgtgctagccagatatttcataccactctccctagatatcagaatgtggcatgaaattattgtgtgctctggagagaagggcactagaagggtcttttcctctgtgcagaaggattgctgaaaagtagatgtgggaggcccaatggttgtgcacagctaagtaagaggttcccagagctccagcataggcatctcgaggaatgcctgcacagaagagcattctcagtggtgggagaggagcagcattccctggccatttcctccagaccctctggttatggttatgggcatttagtaggataagaccacagtcccctgaggagactaggttggctgcctggggcacagatctctattctcagcaaaggagggcagccccaggagatccctgcatcttctggtactttcttgttccagctgtgggacagggtcacacagggagttagtagtctggagtcaagtgttggtccttgtgtttggtcctttttaactctctctctgctcttcctgacacatcttttctcttgtaactggctccatctcttcttgcaaaaaaattggaggaattcttaaaagatctgcctccgatatcttttctctcttgtagtgctgaattcttacaattgaaggcatgcagctgcctactggatctttccccagcagggatctgggcatatcccacaggcttgtcaacctcagcttgtccaaatctgaactcagtatttcccagtcctccacgcatgttcttcttcccccattcccaggtccattttgtctgtccacctcatcatccaaacctgagaccaagagtttgcccagaattctccatcttcctcattttctccaactcagttctatgacttctcttagattaaccccttcttctctatccctaagttcatctgccttagtggagtcctcaccattttttcattcaggctattactgttgtctcctaattgtctctctttagcagaatcttctccacatggttccagaatgatctctgtaaaatgcaaatctgattccaccactcctttactgataacctctcagcagttcccccccaccaatacctggtggcccccaattctcccatatgaggcaggatctggcccccctacttacctttccaaatgctttctgatcttatcctcctgcttcacctgagtcgaacccacttgcgcttctctggaagtgccagactgttcctgtcccccctctgcctgggcttgcttttctgccttgatgtcctggcaagccctactcccttcaaaacccagcacaaacattttctctgtgaattattctgttattatcacaggggatcctcctttatgccacatactataatactttgagtcaatcaatttttatatatgtgttatatatgtgtacacacacacacacacacacacacacacacacatatatatatgtatctgttagaaactttatattctgtattacagattttaaaaaatgtttttcttcctgtctagacactaagtcccttgagggcagggaatgggaaaaggaatgaatgttgattacttactctgtgtcaggtcctgaacaaggacttttgaaaatattatttcatttagagtctgtatcttcttccatatctgggaggaaggcagagaagaaagaaaggaacaaaaggccagagaggaaggaagaagtttattcctatgtgttaaagcttagtttccaaagttacctgtgaaaacaagcataagttttgtggcagagtaaaggaagaactttaatggtaaatggtgagtcctggtaaccaggagaaactcaccattcaactctgggccaatcatattacatccctggccttgctttactcacaagaagaatgtaactaaacttcagggggaaactttctcacatatataaaatcagcatttgcttttcagacatttcctaatcctgtatgttagaatgagacactgaagacggaactgcaactcacaagaccagcatttcccaaactgtgttctgtgagatgctggtttcttgagatgttaatggttactctgagaaaaagaaaatgcttctacatcaaataggttgaggaaatagtgcatttcaatctccctttctttgtgcttcacaatgcacatcagcatattagagacttttgcaggtttcctaaagttatttgaacatggaattcttctttagaacatctattaatatctgacagaataggtgtgtttctcagaaccagcttgagaaatgttgcattaggccatcatcatgaatagctgggactacaggcacctgacactacacctggctaacttaaaacttttttttttttttgtagaggcaaggtctcactattttttccaggctgctctcaaactcctgacctcaaacaatcctcccacctctgcctcccaaagtgctggtattactgtcatgagtcactgtgcctggccctatctgcattatttattaatggtgtttattatatgtttcccccactggaatgtgagctctatgggagaaagggatcgttgttcattgatgcatcccaaacacctagaatggagcctggcacatagtgggcactcaaaaatatttgttgttgatttgggagtagaaaaagatccacactgtccttcatggcctcttctcatatttggtcttctgtagccccagggtcattcttacacaggtaggagcaggcagtaatgtggctaacagcctcatcccagagcctgaggacaattttagattcttagtcctatgtgggctactgtgtatgacctcaagcaggttacttacataccctttcccccagaattctcctctgcaaaatggggataatattagcatttatcttacaggcacatgagaattaaatgaataataattacaggggaaaatcttaaaatagtgcctggtatgtagtgcatgctatggttttgagcttaatttatgtgacagctacttaaatgagtcctatattctagctattattgtttctgggtttccttctaaagtttagtcaaatttcttttttcctcctcttgcaactttttgccaaaatagcaacagaataaaatagtttgtggttgttttaaaagacacacagctatcagttatttatcaaactgacgctggtcttgggaaggccgagactctaggcaagagcagtattgaggtagaggaaagaaagaaaaaaaagcaaactaaatagaaaccattccaatgacctttgctttttgttcttggcagaatcatttaaaatgttactgaccaacatggactgtactttaatagtctgagaaagcttggttactgtgtttacatgataagttggcagatatcattgatctcatggcagaggttttattccttctctgttctgaatgtgtataatattggcttccagtgggctctcatgatctcactggttgtttcacacacgttatctcttatatgtacccagaggtgggaggtatatttctattttatattcgggatgatgaaatattactaatgtcacatgtcttagagcatgtcctttttcacagaggtgcagtactgctgtgcttggcaagtggattgatgcttccatcttgtttgtggtttcgtggtactggtttgatctggtgggttacaggtatgtggaatttacctgcagatagaacacgactgagcttggttatccagtttgtttgcaagcatgcgcaactcgactgaaagtagatacaaccatacaaatatgtactgtggccaaatgggctgttgtaaacagcaactataatgcagatgtcaccaaggtcaccggtgactacctgctctgagttcctgcttcctcctacctccgcctccccctcctcctgtggctgtgctgctttcctggactacactgccataatactacctactcccaaaaatacataaacaaggcacatgtgttaagtagcagatttataaaaattcttgatttttaattaaagtatattattttatttgtataaacttatgggttacaagtgagattgactgattgataacttttaagttcaggggtacatgtgcaggtttgttacataagtaaattcgtgcaatgggggtttgttgtacagattattttgttacccaggtaataagcctagtacccgttattcttcctgatcctctctctcctcctacctgcctctggtggaccccagtgtctgttgttcccctctttgtgtccatgtgctctcatcattcagctcccatttaatgataacatgcagcatttggttttctgttcctgcattagtttgctaaggatgatggcctccagctccatctgtgttcctgcaaaggatatgatctcattcttttttatggctgcatagtattccatggtgtatattaccacattttctttatccagtttaccattgatgggcatttaggttgattccatgtctttgctactgtgaatagcactgcaataaacatacgcgtgcatgtgtctttatggtagaacaatttatattcctttgggtacatacccagtaatgggattgctaggtcaaatggtaattctgttttgaggaattgccacactgatttccacaaatgttagactaatttacactctcaccagcagtgtataggtgcatagattgggtagtggtcaagtcagagttcttaggctgtccctcacctgatggatacagtgaacccataagtaattctcatcagtagcagattttactgaggagatgagggctgtgcatggccatgttgccagttgccagacctctttcactcttcaagattccttgcttttccgtgtttcaaaaatgccatttagagttccatgatgaagctccatttccctttctcctttacatgtaacaggggagctcccagccttccacccagctgtagggtccatgtctgcttactcaaagacctgacccatctcttcccagttacaccctttaggaccccagaagtatcagtgaagacaatcatgttttgggctgccctcttccctctcccctagtctttgtgaagaggagggagcattgaacttattttcctataacagaattatgccagccctcctcctttcccttaaaaggcaatatttaatgattatagtcaggttttctgactctaagtaaaaaaaaaaccactttattatatagcaaatactatatttggtttatgtgaggagagatgagatgttgttaatacatgttaattaagttggtgattcagagtggtactctaggtgctgtgtgtgggtttgagagactgtatcagtaatagaagatttaggatgacaacatagcaagtgaatttctgtacaccgtaagtgccgtcacatttgcatggaaatgtatgtgtaatccagatacgtggctaaatcgatgaggttggccaggtcctcttcctcctggagctatgtgaacatactgttgcagtcttgttgagctgtttgtattgcttgtgtattttttgataggcattgtatttggagcctgtggaggtttgtgtgtacctaagagtaatctttcttctcatcagagagtttatttgtgagattcctcaggaaaagggccaggaaagtttgtcagtgctgagtttgcattaagcatatacagtagcttcttaatctgcatataacttggaaaaggaaaaagaaatgcattgagcgtttgttcagcatttatatcatgccttttcacataaagtataagcaaagtgcttattgggcaggtagttaacagcttcattttaacctgaagaacacagagaaatagactgttagttaaagaacaggaaagctgtgaacctaccgtcttatgcttatttccccagacaagtaaggtcatatccttgagagtcaaacctaatctagttttgttgtctctctggagtattaaatagtagctttaaagactctaagaaaagcagatttaaggcttctagaaggctgcttgcagtagaagaaagcagggccataattcaccagcttcatcttcctttctgatcacttactcacctgcaataagttggagctcaagcttaattatctggaggtggtgcccacttttcactgtgattcatctctggaaaccacacaataatgcaagctgtggccaaagaaatcctgttttcccattgcacagtttatgttgacaatcccaactggagactcagcatgaaattaattatggcagtgactgaacaatttcatacaagcaaagatacaggtgctttaaatgttgatagcagttaaattagtaaagccagagttctatttttaaaaaaagtctagatatagtaaacatattgataggaccccattgtactatagtgtccagataattttactatatggaaaacttcatttattgaaaacttacatgtcagttattataattgttattgaaatagttaactattacttctgcttgatgtctttgatgttgtacagatttgggggagattattggagggcctcaaacaaaagcagttaaggaatacagttaaatgaaaaaggtaaagtgactaacagtgcgtatcatatactgtcattggtgtacaaaaaggaagggaaatgcatgcacatatgtatttctttgtatgtgtagggtatctctggaaggatgcaatggtaagtgcttacactggattggttgccttcactaaggggaacaaatgggttacgggtcagaaagtcccttttgtagcatttgaattgtaattttgaatttataacctatttaaacagtacaattttggtggatttaaaatatagagcctatttaaaaatagaaataaaaatgataacagtcaagataaatttgagagatgttttcattccctctagataattctctgtagtaaggagaacaatattattctaacgtctttagattagaatatcaaattcgggatcattcttttaaaaacagtcattgtaagccgtaagtaagaaaaattcaacctcactaacagtcaaataagtgcaatttaaaatgtcatagcattttcgaccttaatttggtaaagatttttggtattattacatatatttggtaaagatttttaccaaattaaagatgaaattttggcaggatgtgagaggtgtcaagacttggcaagttttctgcaggaagcaaagacaagtattaggtttcctgaaagctgggtataaggtttcctgaaagttgctttcaggaaagcaactggtcacaagtcatgactttaaaatacttatgccccttgacataagagttgtgttgctaggaatctgttttaaggaaataataggtaatgtggtaagggatcattgacaaaaaaagatgttcatcacactgttgttttaaaagcttgacataggaaccttcacaaatggccagcaataggaaaatgcttacttatattgtggtgtatttatccagtgaagtattatatgtacattaaaatgttttagaaaaaaattatttacactagtaaatgttcctgatataatgtttcataaatagcagcatatagtctttaatatgtggtacaattccatttatgtaaaaatacttctgtatatacacagaagagacttagaaatacacagaaatattggctgtggttatctccgtcttagacaatccttaattgcttcttttcagttctgtatttttaaaatttctaaagcaaataggcattacagttgttttattttaaaatgaaaaaattccattgagaatctaggtatttgaaatctccctatggagttaaactccatgggttgtagaggaccttggaatctagttctcatgctcatctgagagatgttctttttgaagtggggagaaataggcagtcaggcaggtggcattgccctgtgatggtgcaatggaatgtattgatgaacttattgagctatggggcattaagatgctgactggggccactttctgcttcccactcctttctggagttcttggccgaagtagtgaagagcctgctctagctacccttgaagggtgggtcccaattatacaacatggattggaatgtttcaaaaatgccatattttctatggaaaggggttatattgatggtcccaagatggagtggaccctgcagtgctatttcaaagctgatttcacaaggattgggggaaaggttatgtgatctcagcattggctcaataaactaacatttacagagtgcctgctgtggatcaggcagaatgcatagctcctgacacctagcaggctgttgggtaatgaatgaactgattgcagaattgctaaagcagtgagcctacaaatgctatgtcttctcttggggctgtgtggttggaaaagtcaatgtacctcttgtaggacaggtggtagcatttagatggacagaaattccttagaagccccttaacagaggtgttctagaaaccacactctacctgttttctaatgtcctgcatctgattggttaaatgtaatatttttggacatatttttggtattgcagaaattttagtttttattgctgttaggatcttaacagcaattacctaaaaatacccttttcactcctcctgccctttctgaggaaatagcagtgaactgagatttactagatccacattctacctccagttgagacaataactggctgtgtgacattaggcaaatcacattaaccttgtcagatcttagttttctcatctgtctggagattggatcagtatacccctaaggtctgttctggtcctaaaggctataaattggtcatcctctaagctcgactgctttcctgtctgattcttttctctctcacaaacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttgggtgagtacatttgaaaggtctggattaaaataattgctcaaaaatatccttatggactgaccaggatttagcactttatgtaactggtggaaataagcaggatgatctagctttcttggtaaaatagactctcttgattaaaacacaaaacctggagtgatgtctaaattataaattaaaatcaaatgtattaatttaccagcgcatttctgtaatacttattactacaaaggtcttttaaattaattagttgtgaaaagattcagtccatactaaagcgtaaacaatgtaacacttgtgttatacgatgcgttaggaaaaggtatgatcatgatactcatgctgccacttcagtggttggctcgtaaatatacatggggattgtgattttttggggttcccctgaattttatttatgaatgttttttgagatgaggtcttactctggcagtgatgtgatcacagctcactgcagccttgagctcctgggctcaagcgatccttctacctctgcctcccaagtagttgggtctactaggtgtgggccaccacactccactaatttaaaaaattttttgtagagacaggggtcttgctatgttgcacaggctggtcttgaactcctggcctcaagtgatcctcctgccttggcttcccaaagtgctaggattacaggtgtgagccaccacacctagactctattatttttatttaccatatttgtaacaaaaaattcatatatcttagtgtaaatggtaaatctccaagtcatagaacaaatatatttaccattttagtggttatgaatttgcataccaaaattataatttaataaacttagctcagtttaatattttaaaaattgattcacataccaaaattataatttcataaacttagttcaattttaatattttaaaaattggcttctggcaataatacaattattggtgtatactaggcatacataaatcgaatgttgtgaatcattttagtttacataattttagcttaagtaacatgtcaaatacttctacaaagtgtttgaaagatgaggagaaaaaacatgttaataagggatctacttgtttgtttgttcacttattcattaaaaatattaacacgatttcactggttgtctacattttgaaaaaaaatgatcatgtaccttatgttccaggaacagtgccagatactgaagattatttttacacatttttatctgtataaatttgtggggtacaattgcaattttgttacatgcataggttgcatagtggttaagtcagggcatttagagtatccatcaccctgacagggtacattgtatccattaatcaatttctcatcattgccccctttcccaccctctcactcttctggtctactttatctaccactcccagctgctgaaatattaaaaacacccactgtccttgcctacctggagctttagttgaatgggggaaacatcatatataaaacgagacaaatacttaagaaattacagttgtgtgagtgctactcaggagaagtgaaggcttctattagggttctgttttttttttttcttttttttttttttgagacagggtcttgttctgttcctccagctggagtgcagtggtgcagtcatagctccctgtatccttgagctcccccctcaacctcccaagtagctgggtctccaggcacacaccaccatgcctggctgattatgttgttttttgtagagatggggtctcactttgttgcccaggctggcgtcgaactcctgggcttacgcaattctcttgcctcagcctcccaaggtgctgggattacatctacctgggttctgttacagttcccctggtgccctgacagacatccgactactctgcacattttgccatatgcttttctaccccacgagctagacatctgtcaggagaggctggtttgaaagacatattttaaaattacatgaaatatttttgaattaacttggagaatttggtatttctggtaaatactcaagctttcatctaatgagagaaacacattgctgcatttcctccgtggtaaccttggctttgcaaactttgtatttcttctgatttatttcaggtgtgtgtactctctcctgctttgttttcttgtccaatgccctgctttttttcttataccagcttgcttagggatctgccatgagaaaaaaacaaatgaaagtaagagctattccatgcatgagtttgtttctttagaattttatgaacgatgagttttttttttagtttcttctcactacttatggaattgtagaaacagtgcataattacagcttcatacaactaagaactttaaagaaaaataagagtgatgttatttgatgaggccacaaaagccaagaaatgttggtaatattcagagtggcttttaatacaactgagttgaaaagaatatttattatatcagaatttagttataaatttatttcctggattcctcctgctatttcctggaaaattggacaccgctgtttttgcttggcttctgacttttacttgacatttcttaaatgccttaatttcttaatttccatatggcagcatatctctgtttccattcttagtatgtatggttttagatgaagtaagtaaactttaagtgtaagctagtttgttgcatatcccaatttagctccactttattggctggcctgttggcacactgtgatttccagcatgcatcctctgtgaggcctctgtgcccagaaaactcacatcctggggcagaattatcacaagcactgccatattaagagcctacgtatgatccattgtgatcctcaacctggtgcacggaagggctcttattgcatccctatgggagctcagaagacttcactgtcccctgcccaatcaacagtcagtcatgaacacgttcagcaacctaacaactaggaaatactcaagaaattcaaagaaatatgtatcgggaaaaggctggggtcctgtcatttaaagcacgattcctagaaccctacctgatattttccagttatcaaaagcactactagagtaattgtttaggttctgagataaattaaatcagtacatgaatttccagggtatgttcctttcaaggaactctcagctgctggaatacaacattggaaggatttttggatcagactataacatattctttctttctcttataacagggacaatgatgttaattatcgggctgaatatgctatttggtcctaagaaaaaccttgacttgcttcttcaaacaaaaaacagttctaaagtgcttttcagaaagagtgaaaaatacatgaaactttgtaagtatagttttacattcttaaaaaaaattaattatataaaattctaaacgtatgaaattaaagagtataatgatccctcatgtatccttcatcctgtttcagcaattctcaacattttgccatgttgttaatagctatcttctctagtttttttaaaaaattatactttaagttctagggtacatgtgcacaacgtgcaggtttgttacataggtatacatgtgccatgttggtttgctggacccatcaactcgtcatttacattaggtattcctcctaatgctatccctcccccctcaccccaccccacagcaggccccagtgtgtgatgttccccgccctgtgtccgtgtgttctcattgtttaattcccacctatgagtgagaacatgtggtgtttggtttgttgtccttgtgatagtttgctgagaatgatgtttccagcttcattcatgcccctgcaaaggacatgaactcattttttatggctgcctagtattccatggtgtatatgtgccacattttcttaatccagtctatcattgatggacatttgggttggttccaagtctttgctattgtgaatagtgctgtaataaacatacgtgtgcatgtatctttatagtagcatgatttataatcctttgggtacatacccagtaatgggatggctgggtcaaatggtatttctagttctagatccttgaggaatcaccacactgttttccacaatggttgaacttatttacactcccaccaacagtataaaagcgttcctatttctccatatcctctccagcatctgttgtttcctgagtttttaatgatcaccattctaactggtgtgagatggtatcccattgtggttttgatttgcatttctctgatgcccagtgatgatgagcattttttcatgtgtatgttggctgcataaatgtcttctttggagaagtgtctgttcatatcctttgcccactctttgatggagtcgtttgttttttttttcttgtaaatttgtttaagttctttgtagattctggatattagccctttgtcacatggatagattgcaaaaattttgtcccattctgtaggtttcctgttcactctgatggtagtttcttttgctgtgcagaagctcttcagtttaattagatcccatttgtcaattttggcttttgttgcgttgcttttggtgttttagtcatgaagtctttgtctatgcctatgtcctgaatggtattgcctaggttttcttctagcgcttttatggttttaggtctaatatttaagtctttaatccatcctgaattaatttttgtacaaagtgcaaggaagaaatccagtttcagctttctccatatggctagccagttttcccagcaccatttgttaaatagggaaccctttcctcctttcttgtttttgtcaggtttgtcaaagatcagatggttgtagatgtgaggtgttatttctgaggcctctgttctgttcaattggtctatatatctgttttggtatgagtaccatgctgttttggttactgtagacttgtagtatagtttgaagtcaggtagcctgatgcctccagctttgttctttttgcctaggattgtcctggctatgtgggctcttttttggttctatatgaactttaaagtagttttttccaattctgtgaagaaagtcattggtgacttgatggggatggcatttaatctataaattaccttgagcagtatggccattttcatgatattgattcttcctatccatgagcatggaatattcttccatttgtttgtgtcctcttttatttcattgagcagtggtttgtagttctccttgaagaggtccttcacatctcttttaagttggattcctaggtattttattctctttgtagcaattgtgaatggaagttcactcatgatttggctctctgtttgtctgttattggtgtataggaatggttgggatttttgcacactgattttgtatcctgagactttgctgaagttgtttatcagcttaaggagattttgggctgaaatgatggggttttctaaatatacagtcatgtcatctgcaaacagggacaatttgacttcctcttttcctaactgaatgcactttattcccttctcctgcctgattgccctggccagaacttccaacactgtgttgaataggagtggtgagagagggcatacttgtcttgtgctggttttcaaacggaatgcttccagtttttgcccattcggtatgatattgactgtgggtttgtcataaagggctcttattattttcagatatattccattaatacctagtttattgagggtttttagcatgaagcactgttgaattttgtcgaaggccttttctgcatctattgagataatcacgtggtttttgtctttggttctgtttatgtgatggattatgtttattggcttgcatatgttgaacccaccttgcatcccagggatgaagctaacttgatcttggtggataagctttttgatgtgctgctggatttggtttgccagtattttattgaggattttcacagtgatgtatatcagggatattggtttaaagttctctttttttgttgtgtctctgccaagctttggtatcaggatgatgctggtctcataaaatgagttagggaggattccctctttttctattgattggaatagttttagaaggtatgttaccagctcttctttgtacctgtggtagaattcggctgtgaatccttctggtcctggactttttttggttggtaggctgttaattattgcctcaatttcagagcttgttgttggtctattcagagattcaacttcttcctagtttagtcttgggagggtgtatgtgtacaggaatttatcaatgtcttctagattttctagtttatttgcatagaggtgtttatagtattctctgatggtagtttgtatttctgtgggattgaaggtgatatccctttatcattttttatcatgtctatttgattcttctctcttttcttctttattagtcttgctagtgatctatcaattttgttaatcttttcaaaaaaccacctcctggattcattgatttttttgaaggatttttgtgtctctatctcctttcgttctgctctgatcttagttatttcttgccttctgctagcttttgaatttgctggctcttgcttctctagctcttttaattgtgatgttagggtgtcgattttagatctttcctgctgtctgttttgggcatttagttctataaatttccctctacacactgctttaaatgtgtcccagagattcttgtacattgtgtctttgttctcattggtttcaaagaacatctttatttctgccttcatttcattatttacccagtagtcattcaggagcaggttgttcggtttccaggtagttgtgtggttttgggtgagtttcttaatcctgaattctaatttcattgcactgtgatctaagagacagtttgttatgattttggttcttttatgtttgctgaggagtgctttacttccatttatgtggtcaattttggaataagtgtgatgtggttctgagaaaaatgtatattctgttgatttggggtggagagttctgtagatgtctattagttccgcttggtgcagagctgagttcaagtcctggatatccttgttaaccttctgtctcattgatatgtctaatattgacagtggggtattaaagtctcctattattattgtgtaggagtctaagtctctttgtaggtctctaaggacttgctttatgaatctgggtgctcctgtattaggtgcatatatatttaggatagttagctcttcttgttgaattgatccctttactattatgtaatggccttctttgtctcttttgatctatgttggtttaaagcctgttgtatcagagactaggattgcaacccctgctttttttttgctttccatttgcttggtagatcttcctccatccctttattttgagcccatgtgtgtgtgcatgcaagatgggtctcctgaatacagcacagtaatgggtcttgactatccaatttgccagtctgtgtctgggcatttagcccatttacatttaaggtgaatattgttatgtgtgaatttgatcctatcattatgatgttagctggttattcgcccattaattggtgcagtttcttcatagcatcgacggtccttacaatttggcatgtttttgcatggtactggttggcgtgtttttgcaggtaccggttgttcctgtccatgtttagtgcttccttcaggagctcttttagggcaggcctggtggtggcaaaatctctcagcatttgcttgtctgtaaagtattttatttctccttcacttatgaagcttagttataaaattctgggttgaaaattcttttctttaagaatgttgaatattggtctccactctcttctggcttgtagggtttctgacaaaagatccgctgttagtctgatgggcttccctttttgggtaacccaacatttctctctggctgcccttaacattttttcctttatttcaaccttggtgaatctgacagtcatgtgtcttggggttgctcttcttgaggaatatctttgtggtgttctctgtatttcctgaatttgaatgttggcttgccttgctaggttggggaagttcttctggataatatcctgaagagtgttttccaacttggttccattctccccgtcactttcaggtacaccaatcaaacctagatttggtcttttcacatagttccaaagttcttggaggatttgttcatttcttttcactcttttttctctaaacttgtcttctgactttatttcattaatttgatcttcaatcactgatatcctccttccacttgatcaaatcagctattgaagcttgtgcatgaatcacgaagttcttgtgccattgttttcaactccatcaggtcatttagggtcttctctacacgtttattctagttagccattcgtctaacatttttcaaggtttttggcttccttgcaatgggttagaacaagctcctttagctcggagaagtttgttattagccaccttctgaagcttacttctgtcaactcatcaaagtcattctccgtccagctttgttccattgctggtgaggagctgtgatcctttggaggagaagaggcactctggtttttagaatttttggcttttctgatctggtttctccccatctttgtggttttatctatctttggtctttgatgttggtgacctgcagatggagttttggtgtggatgtcctttttgttgatgctgatgctattcctttctgtttgttagttttccttctaacagtcaggtcctttagctgcaggtctgttggagtttgctggaggtccactccagacgtttgcctgggtatcaccagtggaggctgcagaataggaaatattgcagaatagtaaatattgctgcctgatccttcatctggaagctttgtcctagattggcacccacctgtatgaggtgtctgttagcccctactgggaggtgtctcccagttaggctacatgggggtcagggacctacatgaggaggcagtctgtctgttctcagagctcaaatgccgtgctgggagaaccactgctctcttcagagctgtcagacagggacgtttaagtctgcagaagtttctcctgccttttgttcagctatgcctggcccacagagatggagtccatagaggcagtagaccttgctgagctgtggtgggctccaccctgttccagcttcctggctgctttgtttacttactctagcctcagcaatggcagatgcccctcccccaaccaggctgcgccttggaggttgatctcagactgctgcactagcagtgagcaaggctccctgtgtgaggtacccacccagccaggcacaggatggtatctcctgttctgccggttgctaagaccatgggaaaaacacagtattttggcgggagtgtcctgtttttccaggtacagtctgtcatggcttgccttggctaggaaagggaaatcctctggccccttgcacttcccgggtgaggtgatgccacgccctacttcagatcaccctccatgggctgtgcccactgtgcaaccagttccaatgagatgaaccaggtacctcagttggaaatgcagaaatcgcctgtcttctgtgtcgatcatgctgggagctgcagaacagagctgttcctattcgtccatctatttctctacttttttttttgtactttaaagcaaatctctgatatcatgccatttccaccataaatactctgtattggttttatttcacttctaacatagataagagaattcaacatgcagaatttccaaaatgatttgttctaatggttgagactatttactccatttcttgttttccttttttggggagattatgttaatgtttgggatgctgatgaactaaaatctcaaacatgaaattagtttactattcaatatagtaaactcatgtaaaatagactggattaaataaaaatgtactgaatgtatttaatgtgaagacagcgtgttaagtagttgttaagtaggattcaaagatgtgaataatggtctccaccttcaaggacttggtgctttacaaaggagacaaaatattatagtgtaaagatataaaaaacaattaagaagctgtataagttctctatgtatttccaaaagaaatatcacaaaacagaccattatataaaaaccttcatatatgtttcatcttaatttaaaagattatatttggccaggtgcagtggttcacttctgtaatcccagcactttgaaaggccaaggcaggaggattgcttggggccaggagttcgagaccagcataagcaatgtagtgagaccccatctctacaaaaaatttaaaaatcagccatttgtggtggtgcacctgcagtcccagtagtctcagctactagggagggcgagggtgaagtgggaggatcttttgagcctgggaggtcaaggctgcagtgatggtgccactgcacttcagcatggatgacagaatgagactctgactcaaaaaaaaaaaaaaaaagagagaagaaaagattctatttaaacttagggagaaatgagattttttttgtgtgttttcttatgttttggtatatcccttgaaacaaataactagcagtttttgtttttaatcctgacaatctttgtctttttttttgttgttggtaagaaccacaattctttaattcacttatcaaatcgaggcatttggaacagtttatttacagttatttagtcatttttgtgtgattaaaaaaagacaagtttcttagagcaattttaggttcataggaaaattatatggaaagcgtggagatttttccatatgcctcatgcccccacatacatacagcaccccccactatcaaaattactcaccagaatgatacatttgttaaaataaatgaacctacattgatacatcattgtcacccaaaggccatagtttacattagggttcacttttagctttgtacagtttaggagttttgacaaatgtataattacatagatccctcagtgcggtatcatacagaatactttctctgccctaaacatcccctgtgcctcacctaatcatcgattcctcctccaaacccctggcaaccactaatgttttactgttttcattgttttgcattttccagaatgtcaatttttgtcttttaagggtttaatctatttttaccatgatttctgaatgtatatttatctaatgtgatcatcttacttttctttttcattttccactttttctaggtatgttttttcctttttctttttgatatttttttcattgattagggttttttttttcccttatgcccctcctccccactcctctttctagtttggaaattatactttcaatatctattcttttagtagttggttgtttttctcttagcacattgaagatattattctcctgtcttctgctgttgagaagtcagctgtcagtgtaattgtttttccttggaaaataatctgtcttttctctttggcagctcttaagatttttctgtgttttggtgttccgtagtttcactgtgatatatctggatgcagattttttcctccatcttgcttgatagtcttcaggctttatgaatctgaagagtcatgtcttttattatttctggaaaattctcaacattgtttctgcaaatattgcttctttcccattctttctctttctttttgactccaattagatatgtgttggactttcttattctgttttccattgctgttaacctctttcatattttctgcctctatgttttgggctgccccttgaactaactctctattcagctttgtctaatttgattgtctttgagtttctaatttcaattattataattatctttttatttctagaactctatttgatttcttttcaaaattttctgattatttattttagtctcatgttccctagtcatacttttgaataccctcttttatttctgtaaatataataagcatacttgttttatattctgattcagagagttccaacatctgtctctttgtgggcttgattctgcagggtgtttttttctttgtttcctgctcatggaaacttgttttcttgtgtgttttgtgacttatttttactttaagctcatggtccttggaacatttttaggggaaattcttgaaatctgggtttaaagagtggttgatgtacacatgtcacacatgaaaattaaccgaagaactacacatttcccctttgcacaaaatcattggccaataaattcaataattttataaaccttgttattttaaaacaaatttaggtgttttttttccctagtgccatgtgtttattccctcccatgtgagtggttcgcatacagagcacacacaggagtgggcaccatggaagagggcagcattcctggcttctgatgggaggatcttggcctcatggtgtaagaagggagaggatggtttatctcctgccttcactggggcctaggggacccaggagcaaattccaccctttccatctctcagccaaggagaagccaccttggtgacgtttagttccaaccattatagtaagcggagaagggattggcctggtctcaaccattacagggtgaagatataaacagtaaaggaaggtacagtttggatgaggccacaaaagagggcagatgacaccatcagaagcatgtgcaggggaggggcagttactgggcttctgggctgcttagtccattcaccttatctgtgatgacctttgcctgctcgaaaacaaccttctcagtgatgccagcttcccttgcatctagcttcttcccaatgcaggtgattactccaagtccctctgccagagcacgggccactttctgctcaatcagttcatctgactccccaaagacatgccttctctccgagtgccccaggactacccacgtagctctgcagtctttgattatgccagggctgatctccccagtaaaggccccattagtcactttgtagcagttctgcgcaggcacagcaatcttgggatctagcttctgctgggtgaagtcgatataggcagttgggggagagcaaaccacctcagcgtcggctggcaccttggtcacgttcagtgtcaatgagctccccaagactcttcttccacccattcatcttccaggtcctccaagaagaacttcctggagggtgccatggcactggagctgaggcactgaaggtcagtgtcagcaaatttattttattttatttattttaaaaaaacccaattatttcttttttctgtttagttctgtggctgcttgttggtgtgggattgttgggattaggactacggcataaagcctatgagagaaaactgggcaaagtggtaagtaattaaaaaccttgaaatagaattttatatggtatatatatgtgcatatatttgtacaatttaccattctgattgaacctggatctgatgacttcagagccctgggccctatctccttaacccttatgtgccagactgataagatagtgggattattttatgaagttgggttcttggaataggataggcccatacactagaggcaaattgttgatgattttgttttatggagttatttctgccattcatgatttaacatatctgaactatgtgtattagtttgttcttgcactgccataaagaaatacttgagaccgggtaatttataaagaagaattttaattatcccatggttctacaggctgttcagaaagcatggaggtatctgttctacttctggggaggcctcaggaaacttgcaatcatagtgaaaggcaaacagggagctagttatcttatgtggtggagcaggaacaagagagagagggagtaggtgctacacattttttttttttttatttgatggagtctcactctgccgcccggctggagtgcagtggtgcgatcttggctcactgcaacctctgcctactgggttcaagcaattcccctgcctcagcctcctgagtagctgggactataggcggtgtgccaccatgcccggctaatttttttttttgtattttagtagagacgggtttcaccatgttggccaggatggtcttgatttcctgaccttgtgatccgcctgcctcccaaagtgctgggattacaggcataagccaccatgcctggcaggtgctactcactttaaaacaaccagatctcatgagaactcactctttcactattacaacaacaccaaagggggtgttttatcatttatttatttatttatttattagagaacagtaccgagggtgtggtgctaaaccattcatgagaattccacccccatgatctggtcacccccaggccccaactccaacactagaggttaaaattcaacatgagatttggtagggacacagattcaaaccatgtcactatgaaataagcaactgttttatattggattttctgtacttcttggtagatattgctgaatacagcaatgtgagattctttaggaaaactcttacagataattcttgattttgcacattatgggtagcttatgccttgacaggtagtaaaacttttcttgtctctttctttcctctcttgctatctgcagttttaaatgttttaatatccttttctcttttagaacagtgggcagaaataagaataagtaattgaatgttgtgctttctatctgatctgataaaaaatctagtgtgtttcataatgcagtcagagttacagttttggttaaaatagaaattgttgagggttgactttgaattttagcaatctgtactagcgggaacatttttcattttgaataaaaagctacactgagaacacagaccatgcttctcttcttggtctttgtacttccagtaacttacagagtgcttgccaggtattcagaactaagtaactatttcttaataagtagataatagtagaccatcattacatgctcctttaactgtcggtcattattattgcaacataatgtccatcagaaaaggatacctaatgtcatccaggaattctttttggaaggagttatttgaattggatttaatacctgttcttttggtcatttgctcattcattcatttggctaatgattaccaaatgtttctttattacctggtgccagtgatacagatataaacaagttggacaagaacctgccctgccagagtttgcattctagtaggggagaattatagtatttagagaacaaataaagaaatggtctccttttagatcaagctgccatgaaggaaacaggattgtagaatggagggtaactgggtatgggggattagagaaaactgtctgaggaggtgacatttgagatgaaatttgcaagttgagaaaaaagttgtgaggcctgggatgttggcagaaggaacacatataaaggactgagggagaacgacacctggtgtgtttgagggacatcagggtgactggcatggctgaagctcggtgaagagtagtagaagatgacgtggagaggctggggagggccataccagggccttgtagaacacagtgagaagtgctgcttttattttttatttattttcattttattattagtattatttttaatgtcaatagttttttttttaatgttttagatggaatctcacactctgtaacccaggctggggtgcagtggcatgatctcgtttccctgcaacctctgccttctgggttgaagcgattctcttgcctcagcctccagagcagctgggattacaggcgcacaccaccatgcccagctaatttttgtatttttagcagagacaggatttcaccatgatgggcaggctggtctcaaactcctgacctcaagttatctgcctgccttgacctcccaaagtgctgggattacagacgtgagccaccgcacctagccattgtcaattgtttttgggcaggtggtttttggttatgtggataagttctttagaggtgatttctgagattttagtgcacccgtcacccaagcagtgtacactgcacccaatatgtagtcttattttgtgatcacgtttttttcaataggtttttggggaatgggtgctgtttggttacgtgaatatgttatttagtggtgatttctgagattttggtgcagtcatcacctgagcagtttaactgtacccaatttgtagtcttttattcctcactccctcccaccctttaataagcaactgagtctcctgagtctccaaagttcattgtatcattcttacacctttgcatcctcatagcttagctcccacttacgtgcaagaatatataatatttggttttccattcccgagtcacttcacttagagtaatggtctccaattccatccaggttgttgcaaatgccattattttattcattttttatggctgaatagtattccattacacacacacacacacacacacacacacacacatatatatatataaatcatattttctttatccacttgttgattgatgggcatttgggctggtactatatttttgaaatgtcaaattgtgctgctgtaaacatgtatgtgtgagtatctttttcatataatgacttctcttcctctgggtagatacccaggagtgtgattgctggatcaaattgtagatctatttttagttctttaaggaatctccacactgttttccacagtggttgtactagtttaccttcccacagacagtgtaaaagtgttccttttcactacatccatgccaacatttattagtttttgattttttgattatggccattcttgcaggagtaaggtagtatcacattgtggttttgatcaggcatttccctgatcattagtgatgttgagcatttttccatatgttttttggccatttgtgtatcttcttttgagaattgtctattcatgtccttagctcactttttgatgggattttttttttcttgctgatttgtttgaattccttgtagcttctggatattagtcctttgtcagatgtatagatagcaaagatttccccctactttgtgagttgtctgtttagtctgctgattatttcttttgctgtgcagaagtttttagtttaattaagctccatctatttatctttggttttgttgcatttgtttttgggttcttggtcatgaaggctttgcctaagccaattttaaaagagtttttccaatgtcgtattctagaatttttatggtttcaggtgttagatctaagtctttgatccatcttgagttgatttttgtataaggtgagagatgaggatccagttttattcttctacatgtggcttgtcaattatcttagcactatttgttgaatagaatgtccttttccactttatgtttttgtttgctatgtcaaagatcagttgactgtaatcatttggcttatttctgggttctctactctgttccattggtctatatgcctttttttataccagtaccatgctgtttttgtgactagggctttatagtgtattttgaagttggataatgtaatgcctttgatttattatttttacttagtcttgctttggctatgcagactctttttttgttccatatgaattttaggatttttttccagttctgtgaagaatgatggtggtattttaatgggaattgcattgaatttgtagattgcttttggcagtagggttattttcacaatattgattctacccatccatgagcatggatatgtttgcatttgtttgtgtcatctaagatttctttcagcagtgttttgtaattttccttgtagaggtctttcacctccttggttaagtatattcctaaatattttattttatttattttttcagctattgtaaaaggggttgaattcttgatttgattatcactgatcacagttggtgtatagcagggctattaatttgtgtacactaattttgtatcttgaaactttgctgaattcatttaccagttctaggagctttttggtggagtctttggggttttccaggtataccattatgtcatctgcaaacagcgacaatttgacttcctctttatcagtttgataccctttatttttttctcttgttcaatgtgctggctagaactttcagtactatgttgaatataatggtgaaagtgggcatccttgtcttgttccaggtctcaggggaatgccttcaacttttccctattcagtataatgttggccgtgggtttataataaatggcttttattaccttaaggtgtgacctttctatgccgattttgctgagggttttaatcataaagcgacgctggatattgtcaactgctttttctgtgtctattgagatgatcatgtgatttttgttttaaattctgtttatgtggtgtatcacatttattgacttactgatgttaaaccatccctgcatccctgatatgaaacccacttgatcatggtggattatctttttgatatgctggtggattcagtttgctagtattatgttgaggatttttgcatctatattcatcagagatattggtctgtagttttcttttttgttacatcctttgctagttttggtattagggtgatactggcttcatagaatgatttagaaaggatcccctctttctctatcttttggaatagtgtcagtaggattggtaccaattcttctttgaatgtctgatagaattcagctgtgaatctgtctgttcctggacttttttttgttagcaattttaaattgccatttcaatctggctgcttttcattggtttgttcagagtttctattttttcctggtttaatctaggagggctatatatttccagaaatttatccatctcctctaggttttctagtttatgtatataaagatgttcatggtagcattgaatgatcttttgcatttctgtggtatccgttgtagtattgtctgttttgtttctaattgaacttattctttacttgggttatctcactaatagtctatcaattttatatgtcttttcaaagagacagctttttgtttcatttatcttttgtatttttgtttgtttgtttcaatatcatttaattctgctctgatttttattatttcttttcttgtgctgggtttgggtttggtttgttcttgtttctctagttccttgagttgtgaccttaggttctctatttgtgctgtttcaaactttttgatacaggcatttaatgctgtgaactttcttcttagtactgcctttgttgtatcccagaggttttgataggttgtgtcactattatcattcagttcaaagaatttttaaatttccatctgatttcattgtggacacaatgatcattcaagagcaggttatttaatttctatatatttgcatggttttgaaggttccttttgaagttgatttccaatttttatttttattttttgagatggagtttctctcttgtcacccaggctggagtgcaatggcacaatctcggctcactgcaacctctacctcccaggttcaagtgattctcctgcctcaccctcccaagtagctgggattacaggcatgcaccaccacatccagctaaattttgtatttttagtagagatggggtttcgccccatgttggtccggctggtcttgaactcctgacctcaggtgatccacctgccttggcctccaaaaatgctgggattacaggcatgagccactgcacccggttgatttctaattttattccattgtggtccgagagatagtacttgctataatttcattttcttaaatttgttgacacttgttttatggcctatcatatggtctatcttggagaatggtgcatgtgctgatgaatagaatgtatattctgcagttgttgggtagaatgttctgtaaatatctgttaagtccatttgttctagggtattgtttaagtgtttctttgttgactttctatcttgatgacctctctagtgctgtcagtgcagtactggagtccccactgttactgtgctgctatctatctcatttcttaggtctaatagtaattgttttataaatttgggggttccagtgttaggtgcatatatatttagggttgtgatattttcctgttggactagtccttttatcgttatgtaatgtccttctttgtcttttttaactgctgttgttttaaagtttgttttgtctgatataaaaatagcaactcctgctcacttttggtgtccatttgcatggaatatcttttccacccctttaccttaagtttaggtgagtccttaggtgtcagatgagtcttttgaagacagcaggaacttggttggtaaattcttaccagttctgcattctatatcttttaaatggagcatttaggacatttacatttaatgttagtattgagacgtgaggtactattctattcattgtgcaatttgttgcctgaataccttgggttttctttcattttgttgttgtttttttaaggttctgtgagatttatgctttatggagattctattttggtgtatttcaagtatttgtttcaagatttagagctccttttagcagttcttgtagtgctggcttggtagtggcaaattctcttagcatttgtttgtctgttaatgactgtatctttccttcatttatgaaagcttagtcttgctggctacaaaattcttggctgataattttttggtttaaggaggctaaagataggaccctaatctattctagcttgtagggtttttgctgagatatctgctgttaatctgataggtttttctttataggttacctgatatttttgcctcatacctcttaagattctttttttttgtcttgattttagataacctgatgactatgtgcctaggtagtgatctttttgcaatgtatttcccaagtgttttttgagcttcttgtatttggttgtctagatctctagcaaggctagggaagttctcctcaattattccctcaaatctgtttccaaacttttagatttttcttcttccttgggaatactaattattcataggtttggtcatttaacataatcctgaacttcttggaggctttgtttatcttttaaattttttttcctttgtctttgtcagattgggttaattcaaaagccttgtcttcaacctttgaagttttttcttctatttgttcaattctattgctgagattttccagtgcattttgcccttctctaagcgtgtccatttctagaagttgtgattgttttttatttatcctacctatttcactggagatttttccattcatatcctgtatcatttttttttttatttctttaagtctgactttacctttttctggtgcctccttgattggcttaatagtcaaccttctgaattctttttctggcaattcagtgatttcatcttggtttggatccattgctggtgagctagtgtgatcttttgggggtgttaaagatccttgttttgccatattaatagaattgtgtttctggttccttctcatttgtgtagactatgtcagagggaagatctgggactcaagtgctgctcttcagattcttttctcccatagggtgctcccctgatgtggtgctctccccttttccccagggatgggactttctgagagctgaactgcagtgattatttcttttctggatctagctacccagcagagctactgggctctgggctggtacttgggagtatctgcaaaaaatcctatgatgtgatccatcttcaaatctcttggccatggataccagcacttgctccagtcgaggtagcagaggagtgaagcatactctgagagggtcattggttgtatttttgttaagtgtgctggttttgttggcctccagccagggtgtggcactttcaagagcacatcagctgtggtagtataggcaggatcaggtggtgggtggggccatggaactcccccaaaattatgtcctttttcttcagctaccagggccagtagagaaagaccatcaggtaggggcagggttaggtgtgtctgagctcagactctcgttgggctgggccggctgtagctgctgtgggagatgggtgtgtggatcctaggccaatggagttatgtttccaggagaattattgctgcctctgctgtctcacacaggtttccagagaagtgggagaaagccggcagccacaggcctcacccagctctcatgcaacccacagcatgaaaggctggtctcactccaaccgtgcccccacaacagcactgagtttatgcccaggcagccggtgagcagggctaggaacttgccccaggctacaagcctcccagctgagaaagcaagccaactcatagttccttggctgtcccatggaccctgcagcaacaatacacttccttcaaagggtctgtggattcccttggctttcttggcatgttcctgtggtagttcttggagcaaaagttcatggtgtgggtctccgtgtgctgctctctctgttgaagtgggagctgcaagttagttttgcctcctatttgtcattttcctgccatccccaatatgtagtcttttatcctttaccccctcccacccatccctccaagtccccaaagttcattgtataactcatgcctttgcatcctcatagcttagctcccacttacaagtaagaacatacgatatttggttttccattcctgagttacttcacttagaataacggcattcagacccatccaagttgctgcaaaagacattattttgttccttttcatggctgagtagtatcccatggtgtacatatatactacattttctttatccagtcattggtcgatgggcacttaagttggttccatatctttgcaattgtgaattgtgctgctgtaaacatgtgtgtccaagtgtcttcttaacataatgccttctttccttttgggtagatccccagtagtgggattgctggatcaaatggtagttctccttttagttctttaaggaatctctaaactgttttccattgtgattgtaccaatttacattctcatgctgattttattttacttgcaatggaagccactctagtgcctcaagcaggagagtgaagaaaaatgatatatgtcaatttggctgctctgtgaaaaatggattataaggggatgagaacggatgcaaggagataagttctgaggcttcttcagctgtctcatagagagatgatggtgatctttgctggtgtaatggaagtagagttggagataaatggatagacttagaatatattttgaaagtagaaccgataggattggctgagagggtagatgttgttgggtgaggagaaggaaggaatcaaggagacttctatgtttttggtttgagcaactggatgaagggaggtggcatttcctgagaagaatgaaggaataacatattttggagtgatgacatctagaattaattacagatgaatagttgtaagaaaaaggatagcatgataaatataatatgtctcttgaaatctctgttgatggttctcctttctttaccaggcagtcattagatttttttctgtttttaccgttttaaaaattatttaaatttttttgtcagtacatagtaggtgtatatatttttagggtgcatgggatgttttgataaaggcatgcaatgtgaaataagcatattttggagaatgggatatccatcccctcaagcatttatcccttgggttacaaacaattcaattacattctttattttaaaatatacgattaagttattattgactatagtcaccttattgtactatcaaatagtaggtcttattcttctgattttttttgacccattaaccattgccacctccctccctgagttccccactaccctagtaggtaatcatttgagatggatacttagggttgggcagcgcattatctgactcactcacgacctaagagaggaccttgtaaagggggctgtgctcctgggccttgacctttccagtacagcaagggtgttacatcattcataactaggttaaaataggctgaccacttcttcaatatgttgaaggcccctctgtatccctctgtgtgatttatttcccatgcaagagtaaacactatcctgagtattgtgactttttttagcactttcatgaattcctttttattgttactatatatgacagatccctagacaatatttttttctatatgacatctgatgtatctattttgcaacatactttttttttaaatttaaaatcatctttctgagattcctccttgtggacctatgtagccctaattcatttattagggctgtgtagtgttccattccacatagcaccatttgtttattcattttcctgttgatggacagccaggctgtttctaactttttactgttataagcagtgcttattacaaaactcacttttcaaacatccctcctaacttccaaacttaagctagaagttcacagaagactaatttgagaatgccatatagcaaatatctccttattttcatggattaaatgtgggaaaatgtctaaggaaattcctttgctgaaataagaaatttggtagagaggagtggagaaaagtgggtcactgaaactgccattgttcacagtcatcctaaactaccattaaaacaattcctcaggcaccaaccaaagaggtctctgctgccatctggcctttcaggtttggatatgacaatgaagggtggtctagtctagaaagatcagctcacctgctcaatgaaacaggtaagtcttcctggaattagttccaggttttgagaaactattattgttacttttattttcagcagggtcataagccataacttaatgcaggtattagattaaatttatgaccagcagatgatcataaactcacctcaaaaatgctttactttggcacgcagctgcagggggactgagcttctgtaaccactcctgtctttgtttgagagcaattaattcagttgattctgagcaactcctcatactgagtatctttaggggattcatgttgtgtttttgttcttagggatgcctctgctagtagcttctgtcacctggggacccactgttggggaccagaagacttggatcaaaaggcagaatgggttgtagggaaaagaaagagagatcagactgttactgtgtctatgtagaaaaggaagacataagaaattccattttgatctgtactaagaaaattgttttgccttgagatgctgttaatctgtaactttagccctaatcctgtgctcacagaaacatgtgctgtatggaatcaaggtttaagggatctagggctgtgcaggatgtgccttgttaacaatatgtttacaggcattatgcttggtaaaagtcatcgccattctccattctcgattaaccaggggcacaatgcactgcggaaagccacaggggcctctgcccaagaaagcttgggtattgtccaaggtttccccccactgagactgcctgagatatggcctcatgagaagggaaagacctgactgtcccccagcccggcacccgtaaagggtctgtgctgaggaggattagtaaaagaggaaggcctcttgcagttgagataagaggaaggcctccatctcctgcatgtccctgggaatggaatgtcttggtgtaaaatccaattatacatttgttctattctgagataggagaaaaccgccctgtggctggaggtgagatatgctggcagcaatgctgctcagttactctttgctacactgagatgtttgggtggagagaagcataaatctggcctacttacacatccgggcacagtaacttcccttgaacttatttgtaacacagattcctttgctcacgttttcctgccgaccttctccccactatcaccttgttctcctgctgcattccccttgctgagatagtgaaaatagtaatcaataaatacagagggaactcagtgactggggccagtgcaggtcctctgtatgctgagcaccggtcccctgggcccactgttctttctctatactttgtctctgtgtctcattttttttctcagtctctcatcccacctgacaagaaatacccacaggtgtggaggggctggcccccttcatgggtcagagggaggttgatttgtgaagcaaattgctttcaacaggcctagggccgatttgatttgtttcagtgctccggggtgctcatttttgtgtgaagcatctttgaaatctgagagtgtttttggtttgtagaccaactacgggtgtatggagcaggataagtaaaggactaacctgttctggttattcttaatgataagcgtgcctcctgagacatatgagtgtctatatggatgtaataccactaagacatttttttgccccttagcccttttttagtctgattacaggcttccaaggcacacctggtcaagatctaataaagccaatcaacttagttctgggtcagtactatggagctgtttgtgctggaataaaatgctatggtgcaccattctcttgtttctgaacataaattggatatttgagaaatgcattaagattatttgaaattttgggaatgatgttgagcacatttgaaaatttttatccttcttggtagttcctggaggtgtttcatgttttaattgcattctaaacgtggggaaattcctttagagctcagatttgagccacttctctctagtgactcactaataattactttgtttttgggtttatcagtaaagaaaaaaaggttaagggtcaagagtaaagtgttgctaattgttttttgccttgctgtgattcatcactgtatgctacttttttttttctgaacaggtgcagatttcataacaattttggagagtgatgcttctaagccctatatggggaacaatgacttaaccatgtggctaggggaaaagttgggtttctatacagactttggtccaagcacaaggtatcacacttgggggtgagtataccttgggagttaatcccgaagatagtcatgaaaggctaggctgcataggcttggagtggcaagttgatattgtaatatctttggtgaatgtgccccagtgatgcttcttgggggatgaggaggtgctggagatatgcacattctgtaatttttcaaatggtttttctgtggctggatatttccagttcttcagcattataaaccaatcaatctaggagctgaggttgcagcaccaagcatgtctggcctggatgctgtcctcatggagcttaccttccagtgtaagacagaaaatcaacatgtacacaaaaaaataaataaggtacttcacaatcatgataagcgctgtgtagaaaagaaaccactgagggagaataagtgggtgggcagtggccatggaaatgctactataggtagggtggtcaggaaggtctctgcaaagatatcatggtgagcaggacccaggaccagccttgggaagagctgagggaacagtcagggtgaagactgaggcaggatccatcttggtgtgcctggagcatggggggccaaagagcaactggtaagaaaggaagtcaaggatgggaacctgatcatagagagctccattttatccagttgtgattggaagccactggaggattttaaacaggatagtgatctggaagaacagattctcaggggcaagagtgggagccaggaggcagagatgataggtggaatagcacagatgagagatgacaatgggaacagtggagatggtgagaagaggacaaactcaggaactattttagaatagaaccaacagaacttacaatagtttagatgtcaggggaggggaaggaagaatcaagggtgatgtctaggtttttgacctgagtacccgctaagagatgataccctttaatggaatgggaaccatcaggagacctttaggtttgtgctaagtgtgagataccccaagacagtcaagtcatgcccagtaggcagttgggtatggcctggagggctgagaaggacagaccaggctggagatgtaccttcagctatcatcgtatagagatagacctgtctcagagactccatgaaggtgacagagaatgcgtctagctatggaagagaagcctgccaaggactgagctctgtggcttagagtgaggtggaatgccttttcatatgcctataggacagtttttcatttctaattttgtaagttgttactccatgttctagctggcaagattgtaccttcccatatgtgttgattaatattagaattgtttatgcaaatgtgttgccagagtaactgcaaatacaatgggttttttgtattactaatgctgcccttttcatgtgtccatagcacttattaaaacagagttgatggtgtttccttagtgacacagtgagacatgctatcagatgaaatgatctgacaaatggactgccatataagtctctgccgcattgctttgaatgtcccttggtgggatgtgtgcagtgggacacatccctttttaatgcatttgcttagtcccagtgcatggtagaatgggactgacaatgatgcccatgtctcttttcattccaatacaggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgagtgggtttctttggcccacctaatattacacaaatgccaagaaatgttattaacaatgtactttgatttctatgaaatcacctttctcattttcttcttttttacctcccaaagtatttctccctgcgttgctggttttaaaaatcagacagaagcatttaagatgcaggcagccgttagtgctggtgtagggacaggccgtgttagtctgcatttactgagctgtacagtcaattccctgtgcaggggctgtccaaagtgcattactgtgtttgctcttcactctgtgtagggtaagcactcttagagccccgttttgcaggtaaagaaactaggcttagagaggtcagacaacccatccaaccaggagcaagcacacagccagggcataggcagtcccaaacccagggttacaagtgcttgcaaccacacaataaaccagacaacagaaaaagaaatttccttttcctgcaggattactgctacaaatggaagtactgttgggatttgaggttgttaaatgacatctcttctctccctcatgttttcacaaacaacagataggcagaggaatctggaagagggagatcaaaatatcactttgaatactgataagcctatttggacaacctggcttaagtgcccatatggacttgtgaatacatgcctaaatatacacgaaactgactccccctaaatggtgggcctaccctgcttgccctggcaagctctctccttgatggaaagaagaggacggaaaacagcctgtctgcaaactggcagcttccaaggagaatagaaaagaaggatttgagacaagcacgtgaagttaatttcaagattattgaattagaaaagtcctcccaaaaagtaaagaatggggagagaggccagtgatggttttctaaagaagtccctctacacgcaacatgaagagtggggaatgagttttatccccaaagaataacatttacaaccagtgacagtactgaataaatcatgaataatcccagcaatatattgtaaaagcaaacataaaagtatgtaacttatacttgaccatactaaaccacaataatttaaacatgaatataaagagctatgtgctatgacattcacatgcaagctttgcctgcattaatgacatgaggccacagaactttaaagagacatactttaggaaaacaacgttgttgtactataagttttatttaaacaaattggtgtgtgtgccactcttatttccctggttacctcactgtttctaacactattatgtgaatccgtgaaagcatatttgaatattttcttaaaaaactcagatcataaataatataaataaaccatccaaatataattaatatgaaccatttatgaaccagactcttgcttacctccttagaaataagaagagtgtttggaggatggatgatatagatggttcatatctcttaaaaaagctgtttgaagaaatgctttctttttttcccagtgattttcatgtagcaagtacaggcattcagaaatcattcccatgaccttatgttgtacttaacattgggtttatctttaaaaaaaataatactttcatgtttaaaggttgcaagttctcaacctaagaaacagtttaactccttcccttttttcctttgcctttttccccgtctcctttaactctctccaatatatcccaaaatgtaaagaataggtttgaaaaggaagagaaagctaaaagagagccctaggaatatgcttggaaaagaggagggaaggattgccttttctcactttctgttaaccacctacttaaagctctctggataacaccatatcctttacttgctgtcttgctcatttgattcaataataatgacaacaatagcagtaacaataatagtgaacacttattgatgatacataactccaggaatgaaggcagtgtaatttaatgattaagagcatgggattccagaacctggaatcagacaatctggtttgaaatctaattcattaactagctgtgtatcctttgctgagtttcttaactaccttgagctttagttttctcatctgtaaatcagtgcaatagtcctacctatttcatggggttcttgtgcccatattacctcatgcaaagtacatgaatgtagtaagtgctcaattaacactggccattactaaaccaaatcagacaactatgaatataaggtatattgggcagcttaaaaaataatccatttgtcaaacatgaatcaagcatctgacatgtcccaagcacacagctagactcattccttgctttaggaaccactgctctgagccactccccagaagtactgtctgggacactgtagcctcccaacaagcgacataggaaagttaacaccttgaataatttgtgacgtgatcacgacatgttttatttgtctttgttttctacagtactagatacacaaattcttactgtgaataaatatttagagatttcgttttccagtgattatggcatataaatgtgaaaatcctattaggaatgaataatttctaatgcttgtgcatgttattagctgattcaacaagattttaaaaagtactgactgcacaaatatgtcttttacaaccactaaataggaaatagcagcattttttagaagtcactcaggcaaacaccataatgaaaattgatattattttaggtaattaactgagccactaatcaccatttaaagaaatctataacatgcatcatatacaaagaggagagaacacagaatccatagtctgacactatgtgacacagaacctatgttctagatttggttccgtggcggttaaccttggtaagttccagttcttgtgtctctggaaatgggataaaattctcttttccagcttactttatagggttattggaccaacaaaatattaacagataagaaaacataaagcatatgtgagctctctctctttctgtcttgacctctttccttatacatatactttttacttttattactctcactaggtaagatttatctcctgagaaaatgtaaaaccaaattcacagattacttccagttagaatatattggattggaatccaatatattctactaaaatatattggattgaaaacactgcctgtggttagtagctttggaattttctggatctggatttgaatccttgttgtaggtatcagaaggaatagaattccctgcagacctaatgaaagaactacttaacaagatgctggagggacccatggaacaaataagagaggctgaggcactcagacactagttaacagtggggaatcattacctgccttaaggccgaaggaacaggcagagaaaacagtgttcccagagcccagtgagacccagaaccaggacaagggaccacctggcatagaatgcagctactgccagagggactggggaaggaatccctgaatgttgctcttctcccaacgtttaatctcccattgatgcctccgattggccaaacctaactggaaaccagcagagaaggaagtccaggagatgaaatctgcaggggtcagcctctcagggcatagagaaaggacagaggatgaatgtgggctggggaaatgaaaaataaccataggcatattagcctcatttaaaaatagagctaccacctgccttctgttgtgagaattcagtagcaaaggggtttaacaaatggccgtccttttcactcttttatttcttgagacatcttttaatagccctcagctatttttatccaattcagtcctgtcttgagatcctaactcaacaaggtttctccagtcttctcagtgcttggtgatcttctatttttctttgtcattttcccccttaacactcatgtattagctacctttctatgtaaatacctgtgtttgactactgcctatctgttctgggcaccattccttgctcttactctcagctatgcattgcagagaactgcatttcccacagtcccttgccttctggcttctgggtaggtttagccaatgggaggcactagtgcaaggttggagggagtagagaagcgagtgtatttctctccttctctctctgcttcctctggtgtctctgggaggagctgagtctcttctgcggctccagctcttctttgtatggtcccagctcctctgggaagcctcctccattgctacatctcccactagtcggtgctggcttctggactctgataatatcacctcctcttgttttccctgtagctgtagaggtggtactggtttcttattgttattaatctctgattgcctcattgactcctatctggcttcccatcgcctagctaaccaattccctatattaagttcactttgtttgaaacatctagggtgtttctgttttcctggctggatcatgtaaaatatgatgtcctattttcccctaaactccccagaagcttgatgtacccacctaagtatctcagttataggtttacagtgcttagcataataaaagcaccatgttcagctggtgtttgagcaggagagccaaggaggctttcagaaagtgttcagttgggctgggcgcagtggctcacgcctgtaatcccagcactttgggaaacaaggtgggtggattgcttgaggccaggaattcaagaccagcctgcccaacatgcaaaatgctgtctctactaaaaatacaaaaattaagttgggcatggtagtgtgcacctgtcatgccagttactcaggaggctgaggcaggagaattgcatgaatgcgggaggtggaggttccagtgagccgagattgtgccattgcactccagtccgggtgtcagtgtgagactctgtctcaaaaaaaaaaaaaagtgttcagttgaaggagcttaggttacataagcctgatgggctctgtgaatgtcaggattcttcatcttaccagtattcctggctctttttacttttttaaactactaattctttagctgtaatactgatggtgagttatcacgttagtgatttcatttcttctgatgaaaagttgaacaatgctgtatttagagtagatctttaaattgacttgactccaaatgacttgtgaagaaaggtcatgttcttagccaaatgtctgtcagcctattcatttgaagtgctgtatctaggtcttgttcatttgtataatgttaagacagttgcccgagtaggaatgactctgggcttcttcactatatgcagatagtctttggcaacttaggtacctaaggctttttaaagtttgttttacaaatacaataaagggtcatatttttacattttttagagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggtaacataatcttaataggatttctaatttattaagtaaaacatttctttttctttcatgtttttaaaaaaaccaacctcacctaaaaatttcatgtgcagtctatctactgctgcctagaaaatcaccacaaaacatgtgagcttaaaacaacagcaatcatctatttgctcatgaatctccaatgtggacagggctcaatgggggtagctcatctctgttccatgcagggtcaactaggtgtctcaaccaaggactggaggatctacttcataggtgatttataggtcgcaagttgtgctttaggcttgggaccctggttcctcgccatgggctacttaggcttcctccctgcatggtgctggctttcaatagtgaaaatcccaagagaaccagaaaaaatctgttttgctttgtatggcatagccttgtaagtcatatactgttacttccactgtcatcacaattctgatcacattaaattcttgatgggaggaatatcaaaaacacaagataagaatactaatggaaagtgagattttgttgtagccatgtttagaaaacacaatctgccacattatgaaagttaattatggggctgggtgcggtggctcacgcctgtaataacagcactttgggaggctgaggcgggcggatcacgaggtcaggagatcgagaccatcctggttaacatggtgaaaccccgtctctactaaaaatacaaaaaattagccgggcatggtggcaggtgcctgtagtcccagctactcgggaggctgaggcaggagaatggcaggaatctgagacgtagagcttgcagtgagctgagatcgcaccactacactccagcctgggtgacagagcgagactctgtctcaaaaaaatatataaataaattaaataaataaataaataaataataaataaataaaaattaaaaaaagaattgagagtaaaacaaaatgaaatgccacacagagagaatggctaattagccaacagggccccagcagatgacactgaattactctaccttttcaggtctgaaacacttgaatttgtcagtgtaccagaatataatcatgttctggggaactgccacacaaatcaaattctcaggagactgatatatatatatatatatatatatatactgatgtatatatatactgatatatatatactgatgtatatatatactgatatatatatacacactgatatatatatatactgatatatatatacacttatatatatatatatatactataatgccaaatgaattaatttagaatgagaaatatgattgttatgtttagttatgccctatgcagatgtcttggtccctttcattccattttcaacttcatgtcttgagataatatctgcagagaaaaaatcttatccgtcttatgttgattttactactttaactcttcttagggtgtaacattatttacagagtttggatgacaggttaaagagcatggcatgatgagaattttctgcatgtgacagaaaataacagagagtgtatttctttttttttctgatttttttaaaattttattattattatactttaagttttagggtacatgtgcacaatgtgcaggtttgttacatatgtatacatgtgccatgttggtatgctgcacccattaactcgtcatttaacattaggtatatctcctaatgctatccctcccccgtccccacaccccacaacagtctccagagtgtgatgttccccttcctgtgtccatgtgttctcattgttcagttcccaccaatgagtgagaacatgcggtgtttggttttttctccttgcgatagtttgctgagaatgatggtttccagtttcatccatgtccctacaaaggacatgaattcatcattttttatggctgcatagtattccatggtgtatatgtgccacattttcttaatccagtctatcattgttggacatttgggttggttccaagtctttgctattgtgaatagtgccgcaataaacatacgtgtgcatgtgtcttaatagcagcatgatttataatcctttgggtatatacccagtaatggggtggctgggtcaaatggtatttctagttctagattcctgaggaatcgccacactgacttccacaatggttgaactagtttacagtcccaccaacagtgtaaaagtgttcctatttctccacatcctctccagcacctgtcgtttcctgactttttaatgatagccattctaactggtgtgagatggtatctcattgtggttttgatttgcatttctctgatggccagtgatgagcattttttcatgtgtcttttggctgcataaatgtcttcttttgagaagtgtctgttcatatccttggcccactttttgatggggttgtttgtttttttcttgtaaatttgtttgagttcattgtagattctggatattagccctttgtcagatgagtaggttttgaaaattttctcccattctgtaggttgcctgttcactctgatggtagtttcctttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacattgaagtctttaatccatcttgaattaatttttgtataagatgtaaggaagggatccagtttcagctttctgcatatggttagccagttttcccagcaccatttattaaacagggaatcctttccccatggcttgtttttgtcaggtttgtcaaagatcagatagttgtaaatatgtggcattatttctgagggctctgttctcttccattgatctatatctctgttttggtaccagtaccatgctgttttggttactgtagccttgtagtatagtttgaagtcaggtagcatgatgcttccagctttgttcttttggcttaggattgacttggcaatgcgggctcttttttggttccatatgaactttaaagtagttttttccaattctgtgaagaaagtcattggtagcctgatggggatgacattgaatgtataaattaccttgggcagtgtggccattttcacgatattgattcttcctacccatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctattattggtgtataagaatgcttgtggtttttgtacattgattttgtatcctgagactttgctgaagttgctcatccgcttaaggagatgtatttctttatgtaaaagtgtgggcaggtgaatcagcactggaatggcactgtgtggtgtttggaatctgtgttctaccttgtggttccatttgacaaggactctgttcccaaaccagcagcctttaagttctagttagcaggatagaggaagggataaagaaggggccaagagcatatgccagttcctctgaaggcaagtcccagaaactgatctgtaacacttctacttatatttcactggcagaaatttagtctaatggccatactttgctgtacagaaagttgagaggtgcaatgtttagtcctgatggccatattcacagctaaaataccataattttggaagaagggtaaggcagatattaggaagatgagttagtctctgcattttttggatagacagaaattagagtgttaaaacaacagccgtcatctatttgctcatgaatctggacttcagacagggctcaatggggatagttcatgtctgctccatgcaggatcagctaggaggctcaactagggactggaggacctactcagtagatgagtcacaggtggcaaattggtgctttgggctgtggacccgggttcctcaccatgggctacttgggcctcctctctgccttgcagctgatttccaatagtgagtatcccaagagaacaagaaaaagcctgtattgccttgtataacttagccttggagccacagatggatccctgatttctgggtctggtcagagggattatgatactgacatttatttttatagagaatacaaaagaaagaaatgttttacaaggaagatgagttcagctttgggctgagtttgaggcatttgtgggacattaatggagatgtccaataggcaggtgcatatacagatctggaatccagaagggcagtgagaactagagttatagattaaggagtggccaccatgtagggaagcgttgaagccatggaagtgagtggtattgctagtaattagagaagtgcaaattagagtgctagagttagagaagtgcagaaggaagaccaaataaagccctgatgaagtcacattgaatgtggctatcatgggggtgtaggtgaaggaagagaagacagattatttcaggaaagggagtaaggagatttcagaagaggaaaacctggaaagtgtgtaatcacagagactgtatcagttatttatcactgtgtaacaaaccacctcaaaacgtagtggcttaaaacagtaataattgaatattctcatgattctttgggttgactgggtggatttctgttcttgcctgggttctcctatgcagtcatctgatggcttacttatggcaggagggtctaagatagccccacacaggcgtctgggccctggtgctggacctctctctcttctcatggtctgtcattatttactagcctagatgatgctgcatttaccagctgtgtgaccttggggaaagttacttagcctttctgggcctcaagttccacatctgcaaagtggtgagagtgatatctatggaatcatagggttgtttgatgatgaaatagaagataacatctgcaaagccctcagacttacatgacatatattatgtgtgtctggctgtatgttgaaaatcaaataagagaaacgcgtaagtacatggtctatgaagcacaaacgaatattagacaagatgaaatttggcaagtctatgtaaaaatggcatcctaatagggcattcttatatggtgtgtgtgcatgtgcacgtgagtgtgtgtgagggatgtacatggtattaaggaaggagaatttgatttgattttcatctaatcctctcttggtttccactgtcgtgatcaaaagctgtgtcaaaattggtagtggattcttatattgctttctctaggaggaagtttattaatgtggagaagagttttaatcatcaatgcttggatgaacagatttttctcttaaagaaatgagtatttaaattctgcagtcttaaaactttatagcatctttatttttaaaatttttttgcaagtcttacagcatctttaaaaaatctgataaacaaaatgatagttaaatagatttatttatcatttatttatctatttaattattcccaatactaaagttttctattttcccaagacaaaccggaacagtgcttctttatttccttcatcaacattttaaatttaatttaaaacatttattataatttttatgtatacaaaaggtatatgtatgtgtgtattataaacaacaataaagattaatagacatccatgtgtctaccactaagcttaagaaaaaaatgaagaattatataataaattgtgatgtattcttttagtgatctaaaaatgtgtttttaattaaatgttaatagtaaaattcagaagtggtgaaaagtcaggtatattttttatttataagatatttaaacagaataaaatggagatttctttcttcagaataaacacctcatatttatagttttcccaacacatgatagaaaagaatatgtttctgttctctttctttgatgaataataaccctggtcccaagccctcaacatcaaaaagactcatgattgctccccagatgttcttatttccatgattcaatttaagaaacacagatggaacacctgctcaatgccaggttttatgctaagtgacaggttggacaaaagtgattaagattccctctgtgcaggtgtgggaggatggagacatagaaacagatacctggcacgatggcataactagtgtgtgtaaagtactgtacaggatgaccaatgaaggtgcagtcagtgctgctggggatgagagacttggaaagctgccaggagtcaggggctattttgtaatcgttgatttatctgagtcactctccagacctccttcctctttgttttcttagcatgtggtacagaagctagataggcgcacagtaggtgctcaataaatatatgtagaatgagcaaataatttggaccaaaaaagatcagtaggagccaggaagagaaaacagcatgtacaaagagatatttatcatgtagctcacacattttttggcaatgtggaatagagctttgctttttatgctttaaacattctcctctctgctctttattaggatatcgacagcactgatcatgacagatggtgtgaatacattatgtatcgagggctgatcaggtgagcacaggggtttgattttgtttttaatctattattaatgtgatcttttgggtctgtctgagaaggaaaaagaactttatggaagcaattaatttttgttgctttttataaaaagcaatcaatgtttataaacattgatttgactatacagtttaacatctttttcaaggcatagtctcataatttacaaaagtagaaatagctaagcaaattaagtttaattatataagagggtactgtgtaggctattaggcatggtgaatatgtagctgtcaacacatgggaggaatggcaccatttttgaatgtatgggttagtggaaacatcacaggccattggatgagaaagtcctgggcttgagttccagccttgccagcttctaatcaataatcctgggtaagttaactaatttgatggggccattactatactgtagtgagctctataggtaaattgtatttaaaaaatatcattccacataaaaatattacccgagtatatcacatacatgcgtatgtgtgtgtatgatatacttggataatacatatttggatacatagagtcatgtgctgcttaatgatatttttgttcaataacagaccacatctacaatggtagttgataagattataatatcatacttttattgtaccttttctatgtttagatacacaaatacttaccatggtgttacagttgtctacaatattcagtacagttacatgcagtacaggtttgtagcctaggagcaataggccataccatatagcttaggtgtgtagtaggctataccatccaggcttgtgtaagtatgcactatgatgtccacacaatgacaaaatcgccttatgacacatttctttcttttttttaaatatatttttattttttaaatcgacacataataattgtacacatttattgggggggtacaatgtggtattccaatacttgtatgtatactgatcaaatcattataatttgcatatcaattaccttaaacatttatcatttctttgttgtaagaatattcaaaatcctcttttctatttgaaatatatagtacattgttgtaacctactgtgaatagaatataagaacttattcctcctaactgtaacattgtacccattgactaacatctccccatctctcccttctccctgttctcccccattgctggtaaccactattctactctcaacttcttttttatttgtttatttatttatttattattattatactgtaagttttagggtacatgtgcacaatctacatttcttagaatgcattcttgttgttaagtgacacatgactgtatacatacatatgtgatccaaaataatacagctgagattttaaaattcaaatatgtagctgtataaatcagttttgaaggcagtatttgtatcaataaagcaaggaacagtttaatgccaaaaaagagggactaaccattcattcattcattcattcattcattcatttatccaataagtgtttactaaatcctctttatgtactgggtgttgttctcgggagtgggaatataataggaaaaaaacaaaatccttgactgtggtagaacttacatcgcagtggaaggaaacataaaataagcagataagaaatgacaagctatgacaggtggagatatgcatgatgaaagaaaaataataaatccaggtgagaaggcagggtgtgtgggggtggctgtggtaggttataaaaagtgggtgaggaatgatggagtgaaatcttggcagcacctcaagtggaaggagggaccccacctgtgcataccctgaggaagagcacttcaggcaggggaggcggggaaagtttgagaggaggatgctggatgttgcggggtaagagcaaggaggccagtgtcgctggagtagagtgagagaagtgatgtgagtatggcaggtggtggtagatgatgtacacagtgagttgattcacaggttcctctacatacaaagttcttccacagagggaacatgctggagaccttccctgaaacactcaagggttctcctgttaggacagaatctgtctggaggtatttgacctgagccctctaactgccatcttggggacaatgtggggagccctggtgtgggctcctaggactgacttccctgagccttagtcttttctccatatagagcagttcatcaccaaaaggcatcttggcattgcctgcctgaagataggggccgacgttaatggatctctttaagtaaccttatcttctaagatctgtggcctacatttatgagagaaaatggttgctttctgggatgatatagaatcatggattcaactcctctcccagtggggatatggcttgtttggttatgaattatagtccagtgaaagcaaattgttagtttctcttgctctagactccatttgccattcaacaagtatcgatctagcagaatggatgccaggcaatagggataaagctgtaaacaaaacagagaaggatctctatgctggtggagggaggatggacaaaaatcatgataaataattgcaggatgatctattttagaagatgatgagagtggtgggaaaaactaagcaggggaaggagcttccagaatatggaggtggggtgcaattgtaagtagggagctgggtaggtcttactaagaagatgacatttcagccaagattggaaggagggagccatttggccacctggcagaagatacctcctggtagagggctgagctagtgcaaaagccccagtgcaggagtgctgcatatgtttgaggaaaagtgaggttagtggggctggagagggttggggtggagtggggtgaggggcggccgaggagggaaggagagagtgtgtgggcaggcagggaagagaacagatcttgtaaggatctagggatccttagcaagcactttggacattattaagtaaaatagtgaccttactcgttcttggacaactccatggagccatatgcttactgaggtgggccaaggaggcccttgagatgctaagattgttttggtttacaccactaactcagaaactctaaaaggagcatcacatgcccaaatagctgtggaacagatagcttgactataatttggtgtttccaaagtgttacggtaggagagaaggtgctgaagggtgagttttgttaagtattttatatctaagattgaaaacactgtttctgtttaaatatttgttaaagcaattgtttaaatgagatatcggaaattctagaaaacgacttttcatataggctgaaataggtttaatttcaagttttaaaaaatgttgggaaccaaggaacagtggtatttatagtaactggtacccataatagctcattgttgggctctgaaacctttattacctctccttaggagaatgggatggcagagtttatatatatatacacactctgtgtgtgtatatatatatacactctgtgtgtatcactctgtgtgtatatatatatacactctgtatatatatacacacacatacatgtacatataaagtatatatataaaatatgatatcatatatatatttatttatgtatgaatttaatactctgtgacataacaaaataccatagacttggtggtctaaacaacagaaattaattttcttgcagttctgtagattctaagaccaagattaaggtaccagcagggttggtgtctggttaggactgtccccttgggttgccgataactgccttcttgccatgtgcccacatggcctttccttgggttgtgcctgcagagagagagtgagctctctggtgtctcttcttataaagccattaatcctttaggatcaggccccccctgcacttatgacctcatttaaccttaattatttccttagaagatatgtctccaaatatggccacactgggggttagagcttcaacaaatgaattttggggggaacacaaaataggaaggtaattttaaaaattcccacattaatgaagttaggaactagggtttttcagtttctgtccacaaaactaattttgtaagccttcatctcaatcaccaaattcaatgccctacatgtagtaggtattaggtgcttaataaatacttattggacaacaatgggagatcctctgttttaatggaagatttggattgtcagattcttcagtttcaaggcttttggtgtatttttgaaggcagtgtctgttaaatgggtcagaactttgatcttagagatttgggaataaataacctagatttgctaaagacagtgacctagaattacacagaagtgcacagatttaggacttgagcccagacaatgcattaagctgtctgacagctcagagtcacatctgatgttcagtcacagctctacttacctttcccaatgggcagacttgctgcttctgctggtcctgctctgggtttctgtttctattttgcatggagttacaggcataggctttgttttaagtttttctcttctcctgccactcaggtccaagcccccatcatcttttacctaagttattgcagtggcctcataacttgtctccctgctttgaccctttccctgaaggtgattctctacctggtagctgtcacagacctctgcttcaaacccctctgatggattcttatctcactctaaaaaaaaaaacagcaacaacaacaacaacagcaacaacaacaacaaactgaggtcttcatagtggcctgtgaggaaggctttgcatgttccctcttatgcacttcactccggtcatggtggagttggcccgcaaaacaccaagcatatttccacctcaggacctttgcatttgtggttccccttccctaaacaccattcctccagtatctgtatggcttgatccctcccttcgttgaattttttgctatagtgtcactttattgcagaggtatgccctgaccatccaccataatatagcaacctctcctactcatcactgcctgtccttcttacactgcattcaccccagtgcttacttatctatcactacctgacttattgtaaacatacatatgtgtttaatgcatccttccctactagaatgaaagttccatgagggcaaggacttcattttattcacgacttattccccaacacccagaacagtgcctgcatgtagtaggcactccatatatatacatatgtgcttcattgaataaatgaatgactgaagctgacctaagtctttttttctggaagagcacaatgtaataaaataaaatgaattctttgttgttcatggttccccgtgttttccacgagcttctcaaataagaactctttgcataatgtctacaaagtgcattgaatttccccaggaattgaaagctctaagccaaaacgggatatggaattttttcagatatataaaatctttgatttcagacttgaaagtaggctgaaaatatgcatgtggcatttggatttttaaaggtaagaaagaaggtgaacacccctgtcattctgaagagttcctgttattaactcaaaacatgattgtgtgggaggcaatttgtatggctagaatattcattagtataaaaaaagtaaagtaaggttgctaagaatagttacttaattaaatctatgtacatattctttattcatttatatcataaaagcaatattttgccaatatttagattaacaatttaagttaattccagttgtgatatacagagtagagttagaagtgggaaactggtttaataacaaaggggtatcacttggatctcgttagatttctatacaataataaaactgttacaaaccatttctgtttctgctacaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccaggtgagttcctttatgctgtagttccagttatgagctactgcatccctctatggaacctacatattacctcaaaatgagctagaaattatattttgtcctagaggtttattccaggtaagggagactgtgacaaagatgataaaatctggtttgggttgaagttacggtgcttgctttctggaatcaagaaatatgttgtaacctcaggttaaaaaagttcacagcatcatcatcatcattatcatcatgaacatcatcaccatcatcatcactgtcacctccacgatagctagtatttgaatgctcctatgtcccagaccctgttataggtgctttttgtgttgtctcaattaatccttattggttggtcctcttattatccccttttaatagatgaggaagctcaagcttaagaacatgaagtaacttcactggggtcacatggctagtgagtgatggaactaataagtggggagacagcctattagcatcgttgggttgctggtattctcagctctggctgcacattagattcacctggacagcttttaaaaaataccactgcctgggccccaccccagaccaatttatcaggacctcctggggtggtatctgggctgtggaatttaaaaaattatttccaggttattctaatgtgcagttaggattgagactgtggatgatggataattcatttacatcacatgtgaaaaattcattaccatgtgaaatacaatttttttttgagatggagtcttgctctgtcacccaggctggagtgcagtggcatgatctcagctcactgcaacctctgcctcctgggttaaagcaattctcctgtctcagcctcctgagtagctgggactacaggtgcacgccctgatgcctggctaatttttgtatttttagtaaagacagggtttcactatattggtcaggctggtctcgaaagcctgacctcaggtgacccacctgcctctgcctcccaaagggctgggattacaggtgtgagccaccgtgcccggccttgttttgtttttaaaagagaaatctatttgcagcaaaacatatgagttggagtatgtgctcttttctctcccatgactggataatgagaggaaacttctacataaagccaaagacagaacatatcgtatacattattattatttgacatttctaccgcttttaccagctaataaacatttctcatttttttgggggaaaaaagaaatttctccattctctttttcttctttgtccctccttacaacaagaaaaaattgtaccaaagtgtaggtgatgaatatgaggagagttatcaccaagtctagatttgttccaattcctgtattgatcttgccctgtgtaagtgtaatgtgactaggaaaccgcgggccttagggtcatctgtctggttcaaatcctcactcttgccagtgaacagcttggtaactgtgggccagttgcttaacctctctgagcctcaagtgcctcatctaaaaatgggaaaaatagtagtggctacttcctaaggctatgtgaggtatgaatggcacaaaaagtttttagaatagtgcatagtgagtgcttattgtttaacagtagctgcaatagcaacattagtatttgcagtagtaatggtagaagtaaaatagaaggattccctccttttgctgattgagatggtttcttaaatggaagctaaaaaatcagagaagaaaaggattttcttgtgtcgttattcttcacatagcaggagtgcggagaaatccaaataaaatatttttggctaaccacaactgcagattgatccaaaccaactgtgaagggagctagatttgctttcccactcagtttaattacgaaaatagtaaaggcataaatagaaggcatgccttaattttaaaactgtgatgagaatatttaagcaattttcaaatatacaagtaatattaatcacaccttagcaattttcacatatacaatacattattattaactatagtcacaatgctttacaatagatctccagaaatttttcatcctgtctaattgaaactttgtatcatttcaccaacatcttctcaaccctcatctcccccagcccctgccaaccaccattctactctttgcttccatgagttcaattttttcagattctacatataaatgagataatgaagtatttacctttctgtgcctggattacttcacttagcatgatgtcctctaggttcatccatgttgttgcaaatgacaagatttcctcttttcaggctgaatactattccatacatatgtatgtttgtgtatagctgcattttctttatccattcatctgtcaatgggcacttaggttaattatatttcttggctatagtgaaaaatgctgcagtgaatgtaggagtacagatatttcttcaacattaatttctttcctttggatgtataccaagaagtgggattgctggatcatatggtagttctatttttaatttttaaaggaactttggtaatgttttccataatatggctatactaatttacattcccacaacagtgaacaagggttccttttgctgtacatctcctgccagcatttgctgtcttttgcctttttggtactagccattttaacaggtgtgaggtaatgtctcattgcgcttttaatttgtatttctttgattagtgatgagcatttcttcacatactagctggccacttggatgtcttcttttgagaaatatttttcatgtcctttgctcatttaaaaaaatcagtttgctttcttgctattaagttttttgagttccctatatgttttggatattagccgtttatcatatataggttgaacatctcaagtaaaaaaatccaaaatctgaaatgctccaaaattcaaaactttttgagcactgacacagtgctctaaggaaatgcttggggcatttcagattttgtacttttggatttgggatgctcaaacagtaagtataatgcaaatattccaaaaatgaatccaaaatctgaaatacttctggtcccagtgattttggataaagaatactcaacctatatagtttgtaaatatattctctcatcccataggttgtctcttcagtctgttgattgttttctttgctatatagaagcttgttagttcgatagaatcccatttgtctatttttgctattgtttcctgtgctttagggatcatatttaaaaaatcattgcccagaccaatgttgaaggtttttcttgatgttttcttctagtagtttcacagtttcaagcccaaaaatctttaatctattttgagttgatttttgtatatggtatgaggtaagagtccaatttcagtcttctgcatgtggatacccagttcccccaacattgcttattgaaaaggttgtcctttccccattgtgtgtttggggtacctttgtcaaagatcaattgactgtaaatgtgtggatttatttctaggctctctattctgttctattgatctatatatctgtttttatgccagtaccatactgttttaattactacaggtttgtagtgtattttggaatctggtagcgtgatgcctccagctttgttctttttgctcgtgattgcttaggctgcttgaggtgttttgtggtcttatacaaattttagggttgatttttctattcctgtgaaaaatgtcattggaattttgataaggattacattgaatctgcagattgcttttggtagtatgaatattttaacaatattgattattccaattcatgaacaccagatgtgtttccattaatttgtggtcttcaatttctttcatcattattttgtggttttcagtgtacaggtgtttcacctccttggttaaatttattcctaagtattttttgatgctattgtaaatgggattgttttcttgatttctttttcagatagttcattggtagtacatagaaatgctactgatttttgtatgccgcttttgtatcctgcaaatttactgaatttattaattctaacagtttttcagtttttttcagtggagtttttagggatatatatatatatataatcatgtcacctgcaaatagggacaatttaactttttcctttccaatttagatgtattttattccttttacttgcttaattgctctagctaggactttcagtactgtgttgaatagaagtgctgagagtgggcatccttctcttgatcctgatcccagagaaaaagctttcaacttttaatcactgagtatgatgttagctgtgggttgtcatatatggcctttgttatgatgaggtctatttctgctatgcctaatttgttgagagtttttatcatgaaaagatgttgaatttttcagatgctttttctgcatctattgagatgatcatatgatttttgtcttttaccctgttaatacattgtatcatatttattgatttgcatatatttaactatccttgcatcccaaggaaaaatcccccttgatcagggtgtatgatccttttaaggtactgttgaattcagtttgcaggtattttgttaaggattttctacatgtgtgttcattagggatattggcttatcattttcttgtagcatccttgtctggctttggtatcaggctaataatggcctcataaactgaatttgcaggtgttccctcctcttcaattatgaaagagtttgagaaggatgggcattaatttttctttcatttttttttttttttgagatagagtctcactcttgtcacccatgctggaatgcaatggcacgatctcagcttactgcaacttccacctcccaggttgaagcaattctcctgcctcagcctcctgagtagctgcgattataggcgcctaccaccacacccagctaatttttgtacttttggtagagatagggtttcgccatgttggccaggctggtctttggtcttgaactcctgacctcaggtgatctgcctgccttggcctcccaaggtgctgggattacaggcatgagccactatggtcaatctaatttttctttttttcttttttttttttttattatactctaagttttagggtacatgtgcacattgtgcaggttagttacatatgtatacatgtgccatgctggtgcgctgcacccactactgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcatttttctttagatgttttgtagaattcaccagtgaggcaattgggtctgggctttttgcttctgaggaggattttgattaccagttcaattttcttatgcattattgaactgttcagattttgaatttcttcatgagtcagtcttggtagattgttactatgaactggtccatttctttcttttaggctatccaattttttggcatattattgctcatagtagtcacttatgattatttgtgtttctgtggtatcagttgtaacatctccacactgatttataattttattaatttgattttctctttttttcttagtaagtctagctaacactttatccattttatcttttcaaaaaaccaactcttagtttcatatttttttttatttttctatcatctatttcattatttttttctctaatatttattatttacttccttttgttgacttcaggctttgttctttttctactcccacaggtataaagttaggttgtttgatgtctttattttttcttaaggtaggtgtttattgctacaaaattcccttttaaaaccgtgtttgctacatcctgtaagttttggtacattgtgtttccatttttatttgtctcaacataatttaaatctttccttttgatttcttctttgatccattgtctgtttaggaaagttttgtttaatttctacatatttgtgaattttccaattttcctcttattaatttataatttaactattgttgttggaaaggctactcaaaatgatttcagtattcttgaatttgttaaggcttgttttgtggcctaacataagatttgtcctggagaatgttccatgaacatgtgaacccccaaaatctgagacagttctcagtcaatttaggaagtttattttgccaaagttaaggatgcacacctgtgacacagcctcaggaggtcctgacgacatgtgcctaaggtggtcagagtacagcttggttttatatattttagggagacatgagacatcaatcaacatacataagatgaacattggttcagtccgggaaggcaggacaactggaagcaaaggcaggacatctcgaagcagaaaggaggctttcagttcatatgtaagagacaaatggttgcattcttttgagtttctgattagcctctctgaaagaggcagtaaatatgcatttatctcagtgagcagagggatgacttcaaatagaatgggaggcaggtttgccctaagcggttcccagcttgacttttccctctagcttagtgattttggggtcccaagatttattttcctttcatttgcacttgaaaagaatgtatactctgcggctgttgggtgaaatgctctctatgtatgttaggtcgatttggtctatagtgttgttcaagtctactgtttccttgttgattttctatttgaatgatttatccattgttggaagtgggttattggagtcccctactactattgtattgctgtctagttctcccttcagttctgttaatattttcttcatatatttaggtgctctgatggtgggtgcacatatatttataattattatattatattgatgaattgagcactttagtataatgaccttctttgtctcttctgacagtttttgacttaaagtctactttgtctaagtagagccatcccacatctcttttggttatcatttgcatggaatatctttccaaaccttcgctttcagtctatgtatatcctcaaagctaaagtgagttttttttataggcagcaatttcttataacttatttttttcactctgtcttttgattagagaatttaatccatttacatttaaagtaattactgatagttaaggacttagtattgccatttaaagaattgttttctgactgttttacagttccttcattctattcttcctcttttcccttatgatttgatgagttttttggtaacagtatgctttgattgctttctctttatcatctgtgtatctactataggttttttatttgtagatactatgagtcttacataaaacataactatttattttaagctgaaaacaactttgtctgctgcatataaaaactgagatttagcttttcctcccactacattttatgttattgatgtcacaattcatgtattttatatatcatgtacccattaacaaatttttgtagatatagttattttaatatttatcttttaacttttacactggagttaaaaatgatgctgcatcagcattaaagtattaatgttttctgaatttgattctattattacctttacaataagttttatactttcatatgtgttcacatttttaatgtcctttcatttcaacttgaaaaactcccattagcatttctcataaagtgcatctaatgatgatgaactcctgcagcttttgtctctttgggaaagtccttacctttccttgtccctgaaggacagccttgctacatagtattcttggtaggcagttgctttcttttagcactttgaatacatcatctcaatttcttttggcctgcaaggtttctactgagaaacacactgatagtcttataggtgttcccttgaatgttttttctctttgcttttctcttgttgcctgcaaaattttctttttgtctttgatttttgaaaatttgattataatgtgtcttggtagcactctctttatatttaatatatttgggagttatttgggcttcatggatctgcatgtgaatcttcctctccaaatttggaaagttcagctgctttttttaaaataagctttctctccctttttccttctttctctgcttcttctgaaacaccaataaggtttacttaatgatgacctataatttctgtaggctatctccactttttcattcttttttctatgactctggttgggtaattttgaatgaccagactttgagctctctgattgttctccttgattgagtctgctgttgaatctctttattgaatttttcagtttagttatgatgttccttagctctagaatttctgtttggttcttttttgtgatttctatctctttattgaacttttcattctgtttatgtactcttttttcttattttgtttagttgtccatctgtgttctcttgtagctcacttagcttcaagatgattattttgaatttttcattatgctgtttttcattagcatcagttacttgtgctttatttgttcctttggtagtatcatgtttccttgattatttatgatctttatggacatgccctggtatctgtacatttgaaaaagtgggcatctcttctagtctttacagattggcttggcagggaatgcctttaccagttggctggtccaaagattctcagtgggctatctagctgggctcatgggtggacttatgctagagttcttgggccaacttgcttggtgcctggatcagcaagtggataggctttgtgcctgggtctctgggggccagcctggtgctggggtccattgggatgggcctggagcctgtgtcaatagggactggacttgaagtctgggtccatgagagccaacctgattcctggggtagatgtgtggggttaggccttcagcctgagtctgcaggagccaccctggtgctggaatgaacctggtgcctggatccattgggatagatctggaacctgggcccatggagcctaggcctcctatgttaaactcagtgctggggtctcctccataggtgtcctatgggcctgtactctggaattggtggagcaggcctagattctgttacctgggctgcagggactggtctggagctcgggtgggttaaagcctgggttcacagggccagtctagaacctggaactggcaatgctgtcctggtgcctggggttataaggggtggcctggagctggttgcataggggccagcctagcaccaggttgggcttggagcctgggtctgtgggtattgctctggaggccaggtccatgggcactggagtcagggaccacagggctggcctggagctggggtaggcataaaggctgggtccatgtgttctggcctggaatctggggcttttgggggtggcccgaaactgatgccagtctggagccttgggtggggatggagcctgaatttgctagggccggcttagggactggggttgttggggctggcctggtgtttaggtgggcctggaagcttggtctgtgggtgccagcctggtgccaatgttcattggcctggacctggtgctggagtctgtggcaaagttgggtgcttacttcactcattttaccctatgcagagagtatctatctctctacttactatgctacctagtcttgggggaggagtgatagaagtaatgtgaagttgtccttcttacccttctcaatgagacttttcttatttctctaatacattcaaatgctataatctctcatctgaaatctttagctcttgtgaagatatttttgtgcatggatagttgttcaaatggatgtttctacagggacaagcactggaaagtcctattttgccatcttgctgacacaactcttatatatatctatacatcacacaattatccttcttttgtaaatgtatgacacatatatgtatgtgcgtatatctgtgtgtatatgtgtgtttttgttctatttgctaatctgattctttcatccaaatagtatattatgaacttcattccataataaagtattcttcttaaaatatgttttaatcattgcataatatttcattgtatggatgcaccaacatttagctaatcgattttgttatttttgcatatttattattttattattataaaaagtcttctaaggaattcttatctgtttgagcataaccttgattacttccttagggtctagctctagaagtgaaatagcagaatcaaaggtgatgttaaatttgatattccttgttattattcttttaagatgacaaaggaagcaggtctcctgtctcttacattatagaggttagatattatggttgcttatgaagaaaaggaaggaagtggcctcttatgtgcaagtcttagctttcttcctagtgtcttttgtattctatcatatcaaccagagctgtataattaaatagttattcatgtgcaaagagttaatctgcagcacattaacacatgtagacaatttagaagttctgccaaaatagatttttatatgcataaatgtaacatgaatagcatttcaggcttaatggcccctttgcctataagagaatattattcaaactcaagatgaaagagaaaatctggacttatttttcagcaatgctagccaataattcttaaacagatgtgcttttggaattatccataaccatggaaagaggactttgggggttaaaattttagtttgcctttcctatatgcatgaatcttttttatttattcatttgctattttattttatgattgaaattttacataagaacatacctttctgaatggtttttacatgccaataactttttatttattttttatttttttagatttggatcctacaaagaaggacacaattatgaaaacaaccatcattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctct

SEQ ID NO: 38621 - DNA, 75829 bp, Homo sapiens; identical to SEQ ID NO: 38620

SEQ ID NO: 38622 - DNA, 104991 bp, Homo sapiens
aggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttagtaagtagctcccggaggttcgccgagcggcgcaccggagaaacctgggtgggggatggaatgggggacacttgggacgccccgcgcggtctcccttctctctttttggggccctcagcggtagccgcgcggtccaggccaccttacttcccgcgggagcgcgcaccgagtcacgagaactgccagcgaggaggcggcggatcaagaccccaaagcggagagcagaggcgcagggctgccggctggggggtagatagcgccctgtgccctgccagccgccctccccgaggggtaggcagagtgcaagcggccaccccgcggcggcctgcagccattagccggcccggccgccgttcccggttcacacaactcagtgaggaagggaaggcagagcccgcccacacgccggccttcctagaggcgtaagaaacctcctactgcgggagctccctgacgtcggagaggcaggcggaactttgcggatgcctaatccagcgcgtcttctttttttggagggactctgatgaaggttctttccccagaagcttgacttggtacgcacaagtttacaccctgagtgtgatccaccatccaaagcctcgttggttccggagcagccccttttcctccccaagctgaacaagcccagaaggctaagcgacttcgggggggtccctgagttgccgagctcagagaaaggacccaggtcttcgtgactcattgttccgtgtaccccattgtttcactgtgtacgttaaccgtaacagaaaatagcgatgtcggtcgcttgccttcactccccactgactgcagagccttggagtggtagtatcaaagtgggccttgcattatcgctccccttttcggagcactggctctggaggctttcagttctaagcaggccctcgagttcttcacgtcttaactctgtgaccccggacgagtttaagttgctaagccttgttttttctcatccgtaaaatagggctgcaagtattacatgacattatatatgtaaactgattagtcacagggcctaaaatataaattactattgttaataccgataatcattatagatatttgtaatttatgagagatttgcagttatgctacatgagtttagggtcgaggattattttgtgggaaagaagagtttgcctaaagtcgtgtgattataatgcaactagtactagaatttctattttcttcaaaattggttgcagttttcaccctatgccacatattttcttctatctttggttaagactgatcaggtgaacaggaagtctcaaatttctgaatggattatgttctaaaaggttaccatgtgatgattaatgggaatagtcagaaaaaattatgaagtggcagttcgctttttaagcagattgaaaaaaggcctgtctactgcaagtattctagatttgcaataagtacggtaattaatagatacccaaataataaatatttatgaagtgtgctagacactgttaggcatagtacagagattcacaatattactataattatggaaaaagtaaatacactggttgagcaaaaacaggcttgagaagccaggagcgcacagagtagttgacccagtaccggatttggaatggggagtcctaggccataatcttggctctgccgttaactcgctgtgtgctgttgggtgggtggttacttcagttctttctcacagagccagtttcttcagctgtaaaatgaagcttttgaccttgaaacgatgatcctcaaggtccttctcagcactggtattccctgaaggcattggatgaataacggagattctaacagtctctgttaagacaggatgtcgaatgggggcatttttgggagtatgttggcctcttattgttggtttgtttctttagctgcaaatgtacttaggactcatgatttttctgtaactagagtgccacaaataaaatacgtttttcattcagttggataaacagggcaggaaagaagaaaacccgattttactaaggtaaatgggcaaaaactggaagaaaggggagtgtggttttggagagggtcccgatggtaagatcctgattggaaggtgtgttggttaaacaatttctgaactaaccgccagatggcatcactggccaggactgtttactacctgctagaaggggtagggcaaagtgaaacgaagccactctagggcgaatggggtaaggggaaagcaacgaataaattgccctttataaagatgatcacagattggatatttattactcagtgtgtctgtatgcagtactagggtggactaatgtctcacttcaaaaaaaatatgagtgtagtatacttggcctaaaattgttactcagtgttactaaagtgtaatcattttccacatctccaaatatattccaagtctctgaaatactagtgcattgggaggtagaacattttcgagcttcatgtctgtaaatggtttctctttactgtcattcagtaaaatcagaataaatgattgatgtaatacttaaaaaaaaattggtgttaaactttgtagaaagagtgagacaggatgattaggggaaagggtatcctgatgggaatcatcaggcctccttggtgccagccctgaccctgttagtatcttgctgtcacttcacctccctgcatctcattttttaaaaccatggaatgaggagattggaccagatgatcattttccagactgcttagttgaacacaagcatcccatggtatattattaggttttcgttaaaacagagggtttcatggtttaataaattagaacacttcccattttattacttttttgaagaagaatttgcctatttaagttctggaaaattcggatgtaacttctccaaaaactgaaccacagagtacttatttctcagaacatttgttaacatcttagtgacatcagggttatgatttctgcaacttccagaagcaactgtgctgtaacagttctaaactaatagtcaaaccacttaagttgtagtcctgactttaccgtcttggacaagtcactcgactgaattaaccagaggcatcccttaccttcagatgacatccggtagctcagtttctccgtaaataaaatggggatagcactagtaattttatagaattgctgtggcagttaaatgagactatgtgtgtaattatcagtgtctcacacgtgataggtatttaataaatgttatttatttttcccttttgactttaagacattagactaaaatccttattattagattctgtgaagggagaaaataaggtgatgtgattgattattttgaagtgttcctgttaatttataggtttcagaaggttttttgttgttgttgtttattcattttatttttatttttttggtttgtttgtttgtttagagatggggtctcatacttttgcccaagctggagcacagtgtgcaatcacgactcacagcagccttgacttccccagctcaagcgatcctctcacctctgtctcctgggtagctgggactacaggcatgcaccactgtgcccggcttcctaggtcttaaagttttaatgggtacttgcagtcttttaaattaactgtgaaatcataatgaagttagactcacttatattgagccaaagacctaatgctgcatgccagtattcctttgatatcttgcgtgtttttgtttgttttgtttcgttaataacttgaaattttattttagatttcatactgttctcataggatagggaaaagctatgctttccataattaggaattttgttattatgggataggcaactggtttacttagagaaatagtgctgtggataattcaagttgcttttatttagtctgggaatgaaccaagcagttctttaaaattaatttgctttgtcacttatagtaagcatgtgcttgtgttgaaattactgtaggttttctttatgtcatttgggtagtaggaggaatctgccattgaaagtgctgtatctttggacttaaaagagaacttcccgtgaataatccacaaaatttgtttgagtcttaaatatgagtttctgtaactttttaaagttggcctatatcatagaacttcaactgatataatggaacacaatgggttttgtgtgaatatagaaaaagtattttatttgatttttcagtccttaaaaccttaaacgttttctatatcagtgctgtgaaataggaattgtgtgatctatatggaacagaggaagcatttttattgaagtttttaggctcctttacatttcttaatctttttatcagaaaataaaacaaagttagctttagtcattgctgaagcttccagtaagaatctctataagtggttttgtagtcgtgtgtaatcatatgttggtatatggcatacatttagctgtctggtatagatacataaaattaggtatggttttcacattccattcaattttctcacttgctctagtgtaagtaataaactttcatcctgatacaacttgctcttgtgagagaaagaatcacatagataacttagaaaatgctagaataaaatctgatttcagaccagttgaagggagaattttgaccactgtttggcaatatcgtgtagattgatgggcctgatagaggttagcaattaatgcctaaggacacaatctgatttttgacgacagtgaaataccatggcaaaaatgacacagtgactacaatcatttatctcttttcccctataataaatatcctattaaagtgatagtaagtgaggataagaaagggtaaccctaaaacaacagataaggagccaccaaagcttgagattttgaaatatgtataaaagattaaaaaaccaatggagatatggttattaatgaagcagtgtggaagaagtcccagcttaagtatatgtgttcaggggacgtagtttagggaaaagccgagctgctgcagaacctcagagaggttgtgggtgtgttgatataagataggatagagagttagatggatgtagaacttaacacagggggattagtttaagttgtactacaaatagtacacaaatgtttcccatgcaggtctaatgcatgagggttgtgttagttccaactgtaaaagtgaatgaagagctgagagggaagtaggacccctgatggtgttggtgccccagcagtactctgcatgctggtatttggggaccccagcataacagccagcctcctacccattcatctctgtgggaacacagagttcccagtgattttttctagtctttttaatataaaccaaatagtcaaggatcacctaacttaggctttcatcgctactgttctaccaactgctttttgtcagggctacctgtcacctccatgctgcgaccttaatggtcagtttgaagtcctcatatgacctatcagcagtactttttacagttcatcactttctctttgaaacactttttttgtctttcccagaggaaactgctttcctctgggatgcactttgtcttagttttgatgcttctccttcacattctcccttgctgaacctttgtcatatttccgaactctagcctttgaaatgcccagggctcaatcctcagcccacttctctatctatactgcctctctagggcaggtgttggcaaagttttctgtaaagggccggataaggaatactttaggttttgcgaaccattcagtctctgtcacaactactcagctctgccattgtaacatacagccatggacagtaaaagtatgactgtggttatgttccaataaaactatatttacaaaaataaaaccaggccatgtgacagatttggcccataaagccagagtttgctgaccattgctgttgctctgggtgatcccatcaggtcccatagtgttagacgctgtttatgattccccaatttataacattagccgcatctcttcttgaactcagaatttacacatccagctttctactctgtatttctacctaaatgtttaagatacaactcaagattaacagcacaaaacagaactcctgactccccaccctcaccgaacttgtttctctctttagttgctaacccataacctgggcattcttcttgtcaccttttactcttatcccacagctaactcattagcatatttttttgaaatgtaccaaaagacaattccttctgtccacttccacccttctcactttctgtttcaccatcatctttcccttgatcagttgtaacctcctgattcttcaccctgcttccacccttagccctgtatagtctactttccatacagcaatcaccttcatccttttaaaatgtaagtcagataatgtacaagctctgctgaaaatgccagtggctttccatttcactcaaaaaattttttgaaatatgtaccatagcatgtaaggtcctactggatctaatactgggctcctctctgaattcattgcttgccacttttccttttgatcagtgtcctcctgccatcctggcctccttgctgtttctcagacatgccatgtatgttctttcctctgcacacctgtgctttttatgccttcagtgctcctccctagaggtctacttgatctcttccctcacttcattcagatctgtgctgaactgttacccaccagagagatcttccctgaccattcaatatcaaatattactccttctgttacagtaggtagctagtcaggcatgagcagggcagaagagggctcccctccctcaacacacaccaggaatgacaggcaaacatcaggtgatggtcaggcagttgttaactgtttctctaaaatattaattggttgcagcctgcaccagggaaaggcagtctccaaataaacagaagcacctgaagctggtgatcagcagcttcccatgagatctcaggaactgggtgagtgggctcaagcgtttgcactaagaggcaaaatggcagagtttggtatgtgacctcctagggacattcgactggtaagggaagaacacctcaagtgaacacgcgtacaactccagtaaacacgttgcacatggtccctttcccaagtgctgggaggctactgtgtgtgcagacagcctgccccaagggaagaatcaggggagatgggacacaagatcctggaagtatgctaacatataaaaccccaagttgaaaggtcaaaccgtgcatttgtcttttcaagttgcccactttgccctcttccaagtgtaccttccttccctttgttcctgctctaaagccttttattataataaactgattccatctgtaaaattgcctcagcctctccttctgccttctgcccctcagttgaattctttcttctgaggaggcaagaattgagattgttgcagagccatagggatttgccattggtaacgcttccattattcattcttcactttccctaatttgttttcctttatctttatagtgcttatgatatgtgatagaataaacacataatcattgcttctgcaccccaactagaatgtgatttccataggaacagggaattggaatttgtatctagtatctagaaccatgcttagtacagtgcatatattcaagaaatatttactgaatgaatttaaggaaaacttaaaaattaaatgggaaaaacaagaaacttgaattttagaaggtcaagtgggtgttctctattacatctgctataaaaaaaaggaagagttggctgtgaagaaatggcaatcaagaccaagacctctttagcaaataacttgttaaaacaagtaagtcagtagaaggtgtagtgggttgaatggtgttctgagacacgaagtttgtggtagtttcttgcagcagtcctaagaaaaagaatatagatgaattagaagataaggtaaatctatcagaaagtagaacaaaatgtcagagatagaaaaaggaggcaagaagaagtgacgtagagattgaatccagaaagtccaacatttgactcatatgggtttcagaaggaaagaacagacaaaatggagaagaaattgtaaaagggataatagaaaaaaatctaagaattgaaggacccaagttttctgacccccccagtcacattattatacagctattgagaggatcccacatgtcttgctggggggtggtcagctaacaggcctgcaacactgaatgctcgaagactggagtaatgcctttgaaattctgagagaaaagagttttcctcctagaattttctacccagccagctgtcaatctggagtgagaacagagtaaagacattttagacatttaacaacttgagaaattggcctcacatgcaatccttcttacagaacacttattagggatatgcttctgcaagacaagtaaaccaaaaaaacgtgaatgcatgggatccagaaaatgatagatctacactggagagcaaagaagcagtcttaggatgcccggaaagcatccagttcatattgcagcctgaggatagagggttcctgaaggagctgtttgggtaaagagaggattccataattttgatgatatccgtgaggcattggaataacttatagacgtgattatgacaatgtaagaaagataattagaaacacgaagaaaaatagaagctgaaccaaaaaaggaaatttaattatagcagcatcctcaccaaaaataaacacatagacaacgcttctcacacacctgagtgtaagaattatttgggatgtttgctaaaaatacagatattcatttctccctccttgagattttgattcactagatgtgggatggtggttcagggatctgcattttaatgagcattccaggtttttcttatctaagagaaatttttgatatatataataggaaatgcatagaaaattcagtatgattacagaacattctatcagccttgatatgaaaaaataaatatgcagaagacaaaaattagaagaatgaggaaagggaggtaaaagtcaggttattgatgttaagaaatactgtatatttgtattagtttgttttcatgcagctgataaagacatacctgagactgggtgatttacaaaagaaagaggtttattggacttacagttccacatggctggggaggcctcacaatcatggccgaaggtgaagggcatgtatcatatggtggcagacaagagagctagtgcagggaaactcccccgtatataatcatcagatctcatgagatttactcactgtcacaagaacaagacttgcccccatgattcaattatctcccaccaggattcctcccacaacatgtgggaattcaagatgagatttgggtggggacacagccaaaccatatcattctgcccctggcccctctcaaatctcatgtcctcacatttcaaaaccaacatgccttcccaacagtcccccaaagtcttaactcatttcaacattaactcagaagtccgcagtccacagtctcatctgagacaaggcaagtcccttctacctatgagcctgtaaaatcaaaagcaagttagttacttcttagatacaatgggggcacaggtattgggtaaataaaacattccaaatgggagaaattggccaaaacaaaggggctacaggccccatacaagtccagaatccagcagagcagtcaaatattaaagctccaaatgatctcctttgattccatgtgtctcacacccaggtcacgccgatgcaagaggtgggttcctgtggtcttgggcagctctgcccctgtggctttgcagggtatagtccccctccttgctgctttcatgggctggattgaatgtctgtggcttttctgggtgcatggtggaagctattggtggatctaccattttggggtctggaggacagtggccctcttctcacagctccactaggcagtgccccaatagggactctgtatgggggccccgacctcatatttcccttccacagtgctctagcagaggttctccatgagggccctgccactgcagcaaacttttgcctgggcatccaggtgttttcatacacctgaaatctaggcagaggtcccaaacctcaattcttgacttctgtgcacccgcaggctcaacaccacttggaagctgccaagtcttggggcttccacccgctgaagcaaaaacccaagctgtaccttggccccttttagccatggctggaccacctgggacgcaaggcaccaactccctaggctgcacacagcagagggaccctgagcccagcgaaaccaccttttcctactaggcctcagggcctgtgatgggaagggctgccgtgaaggcctctgacatgcgctagagacattttcatcactgtcttggggacgaacatttggcttcttgttacttatgcaaatttctgcagctggcttgaatttcttctcaaaaaatgggattttcttttctctcacattgtcaggccacaaattttccaaacttttatgctctgaatgcttttaacagcacccaagtcacctattgaatgctttgcttcttagaaatttcttcctccactagataccctaaatcatctctctcaagttcaaagttccacagatctctagggcaggggcataatgctgccagtctctttgctaaaactgtcaagaatcacctttgctccagttcccaacaatttcctcatctccatctgagaccacatcagcctggatttcattgtccatatcattatcaacatttgggtcaaagccacttaacaagtctctcgggagttccagactttcccacgttttcctgtcttcttcagagccctccagactgttccaaactctgcctgttatccagttccaaagttgcttccactttttcagttatcttttcagcagcaccgcactctactggtaccaatttactgtattagtttattttcatgctgctgataaaggcatacccaagactgtggaatttacaaatgaaacaggtttattggatttacagttttacatgggtagggaggcctcactatcatggcagaaggtgaaaggcacgtctcatatggtggcagacgagagcttgtgcaggaacactaccccttctgtaatcatcagatcttgtgagacttactatcatgagaacagcacaggaaagacttacccctatgattcagttacctcccactgagtcccacccacaacacgtgggaattcaagatgagatttgggtggggacacagccaaaccatatcaatatatttggtggaataaaaaggtgtattaacattagccaattaagaacttatgtagaatagattgaactaaactatctctcagaattggaatcagtaggtaatttctacaattgataaacaaaaactactaaatatgctatttagaaagatgaaggtaaccactaggcctaatacaaagagttgaaaatgggttgctctcaggagtggaactagactggggagaggtagaaactattattttttcagtcatggacctgcattgctttggcttaacaacagcaaaatagatgttttaaaaagcaaattggcaatagcttgttttcaactgttaagaaacaagcagcctgagcttcggataagaaagttctaacctaagatgtatcactaatatattctgtggttctgaggaagggctgtctgatgtgtgcttcagttctaccacttttttttttttaacctagtgctagataagttctactgtctttaaaaataacggcatgtgttgccacagcgcttgttccatataccatatccctctgtctgtagcgcatatgtaccatatagattatctcattcattttatagaggatcaggatagatactacatatctttaaatccacctttagagaattttaataccctttaaatggaacataatagcatatcaacatgattggccctggaaaacttttaatgagttcttatccttttgcactttagggaaatgttcagttttctaacagtgctgagaggatgcctttgtgtttaaacttactaggtgatgatgatgatgacagtgatgtaacgtgtcttgtcttagctatgggcgtggatcactgtgtagcacttgtctattccaaaatctagtacaattccttttcatgtgaaacactctgtaaatacatattgcttaatgcaagaaactattgagaaaattaagcttcagagaaattgagtgactgttgagaaataaactaaaattctgagcccctcagttgactgaatgggtctccttttggccaagggaaccctagagaaaccttgaaaactgagttcttggccacgactggaatggggaggtcaactatgcctgcttataccctttccctcactaactgccattaagttttcttccctaagggctaaatagaaaccagccctttcgaaagactccacagatgctgataccaaccgaaagtctgactgctgcccctcccttttgtggtttccacaaaacaactgaccagcgttccctcctgataagagtggttctggcgaatctatggagaatgtgcagtgagggttttcatgttttccacttcacctttcgacatcagagagctgaaaactccaccctcagatcatgctaacaccaccgttttttgaacatgggtcccgtggagaagcatgaagctcaactgagcatgcttgcaggttgcagccctttatgagaaataaagctctgctttccaaatttatgagcctcatcattcagttgccatttttatgaagctgagtaactagaagtcaggtttttggcctttctagtcattgctcctgtgcaaatttatagatatattgcccattaaagcattattattatctgagatctaaggccatatttgttttctagaagtagttatatttttactctttttcttcactattacatttttatttattaatactatttcatgaaatagcttctagtaggtatggttatgtaagttagtaaatacagaccattcactcatttgtaatctttttaccttccaaatgacaattagaaaactatatatatatgtgatcttacatcttaataagtattgggcttgtccacagttaacaagagcattggatctttggggaaatttaacaccaaatcagtgtcctagatttatttactcttaattacaaaggcagcctggcttttctgtcaagtttcttttacccccatgataacaaacttcccttgtttgtgtaacttcctggattcttagagctgaaattattgttcatttctatcacaatgataggtcccaaatgaacgttgaagtaatctgttaaaggattgtattttttttcttttcagaattctaccttttttactttagtgacttgaagagaggacaatcacagattgatgattgttcttggaataagagcttccatttatacattacagttgtccctctgtatttgcaggggattggttccagaaccccttggataccaaaatttgcagatgttccagtccctgatgtaaaatggcgtagtatttacatatgacctatgcactcctcctatttttttttcccttatgggtgggggagggtggaaagaaaccaagagaaaggaaccctcttgtctacttttaatcctctttgaattacttacaatatctgatgccttgtaatgccatgtaaatagttgttatactgtattgttttatttgtattatgtttattgttgcatttttattttttaaagatttgcagaatattttcgatctgcgattgtttgaatctgcagatgcagagggcttactgtgtatgtcttcttaacctcctcctagttgtctttcagctccatatttacttatttttaaaattacctacagtaaaatttactttttttgtggacacttctgagttttgacagaaagtagatttgtgtaaacagcatcacaaagtacagaacaggtctgtccctccccaaaaaattttttgtggccccctttagggtcaaccctactctcttaccatcagcccctggcaaccaaccagtgactgcactttatcctatagttttgccttttccagtatgttatgtaaatggaactgagttgagcttctttcgcttgatacagtgtatttagatgcatccattttattgtgtgtatcaatagtgcattcctttttattgtggaataattaataaacattgattaaaagaccactatatgagtataacatagtttttctccatttaccagttgtacatttgcattgtttacagtttttggtgattccgaataaagctgctgtaaacatatagagatttttgggtgaacatgtttttatttctcagttaaatacttagtgggatttctgggtcacatgctaattgtatgtttaactttacaagaaacagccaaactgttttccagagcaagtgcaccattttcagttcccatcaccatattttattttaattgaaaacatgtaaatgtggcccactttagtatctattacatttagaaaagtaaataatcatgtaaaaaattggtaattttgttttttgtgttcttgtgttactcatagataactttgaaaatcgggcagagaatttgaaatctgatgtaatatatgaaagagaagttttttttaagtgcatccctttactgatgaaaagagctttatagaccatagccaaagttttatgtacttgccatttgtgtgctctttctcatttttatccttacgttgtgcacacatccttcaggaattaccttgttgctagggtggggaaataaaaattatgttaacagtttaaagggaaaaataaaatagtaatagagacatttatctaacagatatttgctcagcaagtatatattggatgcctattaagtgctaggtactttcccagatgctagagatccagtagaaagcataacagaacaaacaaaaatgaacaactacaaaaactccagaacttaattctagtgataagtgctaaggtaaagcacaaagcatggtagggggaaataaaatattggtgggaattaacaatttcattgttaagttacatgcctttttttttttttttttttttttttttggaggtggagtcttgtgtcgccaggctggagtgcagtggtgcgatttcggctcaccgcaacctccgcctcctgggttgaagctattctcctgcctcagcttcctgagtagctgagattacaggcatgcaccaccacgcccagctaatttttgtatttttagtacagacggggttttgccatgttggtcaggttggtctcaaactcctgacctcaggtgatcctcccgcctcagcctcccaaaatgctggaattagcgtgagccatcgtgcccggccatgcctctgtttttgttgggcagaatccagggcttatttgttgttgttgttgtttaataaacttcattttggaataattttagattgggttaagctgcaaagttagtacaggattccagcatactccgcaccccagtttttccctaattttatcatcttaacatcatttaccattgccattgtacatttttcaaaactaagaaactaacattggcacatgcccttaactaaactccagattttatttggatttcactagtttttccactaatgtcatttttctgttccaggatctagttcagcataccagactgcatttagtcatcatatttccttactgtctaacaatctgttacggtttctcaatcttggatttgtttcttctctctcatttattttatcatttgtttgtattagtgtggattcatgtatatttgttttatattttgttgctcaaattgttccagctttggcctttggggactctttcagattggttcacatttccctttaccatacctccagtcttctgatgtttgagcacttggttgccttctgaccctacaagatgctccaggctcatcttgggtattctttgctccagcattagaatcaagcctttctccaaggaggcctagttccttttattggagaatggcattttgaaaccaaaatctgggccaggtgcagtggctcacacctgtaatccctatacttcgggaggcccaaagtaggtggattgtttgagctcaggagttcgagacaagcctgggcaacatagcaagaccctgtctgtacaaaaaactttaaacttagctgggtgtggtggtgcatgcctgtagtcccagctactctggaggcttgaggcttgagaccaggagattgaggctgcagtgagccatgatcatgccactgcattccagaccctgtctcaaaaaaaaagaagaaagaaaccaagatgtggttgctggtgtgctcattgctattgggatttagccagtctttgttttattttgttaaatattcttgaaatctaaatttgaaaattatgccaaacaggtagcaggtcagaagtaaaacagcctgatttaggaaattacaaagtgaaaattttgtagggctctattaagcttagcttttggaaacagatgtattccagtaaaagtgcattgtatttatttacaaggcattgtgtttatttaaatattgaaagtatttaaaatacacattttggtatacaacttttaaggtaagatagtttctgttattgaagtttgtttttgttctaagcttaccttagtattagcatccttaccacattgaatggaaacaatatttcttttcttttaattgaataggaactttggacttttcttcccatggatagtaggtagaaattgggaatactattgttaagtttccccaagggaaattgacatcagttttaatagaattcacttagtaatgagtttctttttcaaaagtgatgtttttttttttaatatgtattttgggttttagtctattgtagatattttctgctttggatattttaagccacagggataagtaaattatttcagcaacccaaatatggtttagccggtatatatttcttttcggtccttagatggtggcaagttttaaaagttgaattaactttaagttgggagttaaagttagctttgtaaaaaatgcgtaagtttaaaagtggataaggatgtttattattgctgtatagaacaatgtgtctattgctttaattctgttttgttttgtttgtttgtgtctttgcagagaatgtaactggtcactacatttccccctttcatgatattcctctgaaggtgaactctaaagaggtattgttttgacttgttttgggaatgaaaacgtgtactgccagtatcaccattagatgctttttggaagcaccttgaaaggaaaaagtgttgttggaagtcaggaggacaaacaggagttactataacagggtcataagcctcctatatgaattaaaagttgtatgagaataggattcttccatgaggaattgggagaaaggggtgttactggtacataaaacttagaattcggtaggaaataaagatttaagggtagtaatttaggaaattaccaagaggtttatttacaataatcagctaacgtttgtggattattttttatttgctagccactatgtgaacatgatgttatttaattgttatgagttgctatttttctttccaaggacactgaggctcaaggcatttttatagacttgtctaagatctggtaagtgccagagctagttttggaattagcttctgaccacaaagcttatgctctttaaccactctatgaaacaggtgttagagaaataaagcaggggtaaaaatggtggtgtttgaatagctgttctcttagaactgaaaatcacttgacagttgtcagggtgtgaaagatgccaggagaactgatgctatcaaatcaaaattgttggggtgtttcgagatctctcatgattagttggtaatatggcatatttggtagtattcatgatcatcattaagttgtaggttatttccttaaaatccaagtagtgaattaccaaatttttaagggggtacaactattaagtaaataaccaggaccacattccatgttgaaattatatgtaactcgttaatttggggttgggttttctaggatgtggggtgatcaatataggggcagaggccactgaagaactgaggaggctacttcagatgcaagggttgtttgaccctggtgttacctcagaggctgaatattatgcatcatagtgaggttatgggatgtgaagtaggatttgtgctgcttcccagctcttcagaataaggaactggcagtagaataatatcaataatttatcaagtgcttgtggtacttagccagcactgtgttccctgcttgatatggtttatctcaatccttctggctttacatttagtacccttattttgttaacgaggctaagtaccttgtccatcatcacaaatctcgtgtgttttggaggtgggattggatttaggtgctctaactccagagtttgtactcctcacttctcttgtgtaatgcctccagctcattacttttaagtgtgcagctccaggacaatagaaggaaaccagaggcaaaaggaactctatgttactgtgtgtgtccatgcgagtgtgtgaaagtgcgtgtgtatatgtgttcctgtgttttgttttggccactgaactttcaaacctaaatatctcatgtctcccaacacttttctttgcttttggctaaaagtgcatgcattcacttattcattaatttattcattcaatcaatagtcattgaatgcttattatgagccaggcactgttctaggcactgtgggtgtagtagtgaataagataggtatagtccactcaattggaggagtcaaccataaaacaagtcagtcagataatgttaagtgctataaaaatacaacagggaaaggaaagataaaatgtgactggtgggtagtgttgtcaggggtatgctatagcaaaatctgtatacctcatcataacaacaataataataaagctgtatttttgagagtcgtgtagtagatagaggtagaggtggaaaagagtaagctagaaacatgtcagtgagaataacattttgtctaaggaggatgggttttgggaaatgtgaaattagagattaggcaaaattgatgatagggccagcaaatacaacaggatatgccagtgaattctggagatatggaaatggatacgcatggtggttgtgtaaataggtttccctagatctcagccagtaatgattaaaactcgtgctttgtactttgggatgtggtatattaagaataaaaataatggctgggtgcggtggctcttgcctgtaatcccagcactttgggaggccaaggcaggcggatcatgaggtcaggagatcaagaccatcctggctaacacggttgaaaccctgtctctactaaaaatacaaaaaaaaattagccaggcctggtagcgggcgcctgtagtcccagctactcgggaggctgaggcaggagaatggcgtgaacccaggaggcagagcttgcagtgagccaagattgcgccactgcactccaccagcctgggcgacagagcgagactctgtctcaaaaacaacaacaacaacaacaacaacaacaacaacaacaacagcagcagcaaaaacaaaaataatgtttcagagctgatttggaaaaatgattttgtttgttttgttttcttcattagtagtcattttggtgtataaacgttacatatgctggttgagcatttgtgaatggcataatttttcttcccaacccaccacgaagtcagttttaatttaaaagtgcttggtttaatgggaaaagaaaaaagaaaaaaagtgcttggtggaggcctagtaatcacaccttggtagaattcacaggcaggaggtgcagctgagtactttcacagcttgttagtcatgctccctggagcttcatttcaataatgaaatgactgttttaagcataatcactggaaactaccagtcttttcttaaagactgaacagagcctttgcttactttataaaaactgggaaaatatacgtgaaagaggtttggcttttctgatcatttattttatgaaacactttgatgctctattctggggatacaaatgctcaggggagaacgaagtgggcatttggtaggttctctgttgactcagatttctggacagtctttgtgtagaatgtctatacaatagtcatatttttattgctatgcagtgccactgtatactttcatgaaatattgcagtctttcaccatcttttcttttataggaaaatggcattcctatgaagaaagcacgaaatgatgaatatgaggtatatccaaaggtttttatttttgtgaatcacttttatattgtctgttaaataccttgatgatagtttgcatttgtaaaatgattctaaggtttttacccctgcaagactttcatgtgcattccgatgtttttctttaaggcagctagggcagctattgccatttaactttttttattgtggtaaaatattcataacataaggtttaccattttaacttttttaaagtacaatttagtggcattaagttctttcacattgttgtggaatcctcatcaccatccatctccagaactttttcaccatcccaagctgaaactctacacgttgagcaacttctcatttcctccctcccccgaggccctgggaagcactattctactttctgtcttatgaatttgactgttgcaggtatttcatttccacttcattttacaatgggaaaacctgagagaattagcacaggaacccagattttaataataagttaattatcttggtagatggtctaaagtaaatgtacttcattataaatgaaatatttcactttaaattataagagagaagatggtttgagaggctgttttagaacccaggaacaataatcttttgggagtagaggagaagaaaaacacttataccaaccgtatgctaaaatgaatatattctaaatatatatattctaaatgtatgctaaaatgaatatattctaaatatatatattctaaatatatctaaacaaatatatgtggctgtcaaacctttaatagttcttgacttaggaccagaacatttgattgatgtctgtcattccatctcctgctacaagtgtccttttatccctctgattctgatgccaggcagcttttcctgctgctttcctgtctccttttacctttccagcttcatttccatttattctctaccccaactgaaacttacagctccagcatttgaatctacttccaaacatacctgtgggggcctttaaattcctacaacctttgcctgctatctgtcttctatttttctaagctggtgtgattcttgaaccatctacactggaaccacttagagtgcttgttaaaaattcagattccgtgccccatctcctatttactaagtcagattctccgctggatagggcctggttaatctaggtatttcacaagtattctaggtgcatcctaaacgtgaagtttgagaaccactgccctagatgttgagtgaacaagggtttccagatccccaggggacttagtgtattaacctgaaacagttatttcaggttaatgaaatacattagtgggaaaaacatattctgagcccagacattcaaattaaaatttaattcttagaacacagtttttatgttagagactgtctgatttgagtttatttgaaattttcaggattagagaggaaagaagagtgatttcttcctgtcttttccccatgtatataaaatgtactgactgctttttcatacatcttattagtttttctattttgacttctgcaacaaaaatacaaggaaaaaaatggagagaaagaaaaggactgaaggagtagttcacagtccttgccacatacacaactttctggtttgacttgtgctccttttatcttttttattttcagataaaatttggcagaccattgttggtttataattaacattaatcttaggaaaaccaggctaacattggctttaaaaaattaattacaggacaaatgcatcttagctggagagaagaaaggcaggttggaaataagctcttagtgattacgagcaaatgaagagggagaatgtggtttgcaggcttaaaattcaaacctcatttattgttcatttggcctaattcaagtatctgtgagtggttttggtaggtgttattgtgtaaaacgattgtcaccagcttggtcttcttggtcacctctgagtattcatctgcaagcatttgttcccgtatagccaggctttcagggatgaataaattatgtggacatctgccatttactttggtttttctttttaacagctacttcagacatatttaaacaggtgcaggggtacctcatgaaagagcatagaaaatgaaacataacagcaggactgtatgtaaggttgctaagataggtatgagacatacttctaaggagcagctattgagaatttattctcagctttgttgtttatctcattatgggcttgcagctttgccatttgtaacctttagtcttatgtagaaaaacttaatataaatcatcattacttttatggctcaatatctatctacatttaattgtgtaaatagcattctttgaaataacagcattccatgttacactagaaaacctctgtgatactcttcagcaatgctttagtccagctttggctgcatattaaaattgcttggagagcctataaaaataagcagtgccctggctccacccagagcaatttaattcagatagatgagagacggggctctgggaaactttcttttttttaattggttgaagctggtgaggtggtattgatgtgtggcatgatcgaaaataagtatgttaaatcacttctcaaatgatttgggatgaaagactagttttttggctggtttatttctaattggttgtaaacagatacttaaaaaaaatgcaatcaacatgaatcgttagaaaagtgttggcagggcgcggtggctcacgcctgtaatcccagcactttgggaggccgaggtgggcggatcacgaggtcaggagatcgagaccatcctggctaacacagtgaaaccctgtctctactaaaaatacaaaaaattagccggaagtggtggcgggtgcctgtagtcccagctactcgggaggccgaggcaggagaatggcgtgaacccgggaggcggatcttgcagtgagccgagattgcgccactgcgctccagcctgggcgacaaagcgagactccgtctcaaaaaaaaaaaaaaaaaaaaaaaagaattccagaccagcctggccagcatagtgaaaccctgtctctactaagaatacaaaaattagcaggcgtgctggcgggcacctgtaatcccagctgctcgggaggctgaggcaggagaattgcttgaacccaggaggtggaggttgcagtgagccgagatcatgctgctgcactccagcctgggtgacagagtaagactccgtcttgggagaaaaaaaaaaaaaaggaaagtgtaattcagattccaattttttattattagatttaacagatataaaaattgctcttttaaattgctacaaatgtttgtaaatgagccagtaacaatcggtttgcagactggccctggtctttggctacacttggagtacagtgttttaaaccatcgttgtttccttgataaattgttagttattgatgtcaaaatgtgtgcaaatcaactttaaccttaagactttctctttgtaaggcaaactgtagggaattatttttactcatcattgacctagggtctcctttggtttatgcattctacaaagttcagaaattaaaaaaaaaaagtgaagccatagtgagtttgtaactttagggagtctgaactcaccagatatgcaagctaagtctggaatatttagtgtagctctttgtgaactctgtaatagctgtacttacatcctgaattttacactgtgattgtaacttggatttaattattattttatcattttaaaatatattttacttcataattttctgtatattgtcattgatctttgtaacaacctcatgtggtgagtgggacagagatgatcacacttactttacagattggaaaagtgagactgaatccttacatgagggactggttctctcacttctattttagttggaaaataaaaattgaaacacatttcttgactccattctagttttgtcactactcatcaaagatattctcagactcgtaacctctgacactgtgtgtaagtgctcaagtgacatggtggcctaaatttggctgtgttttagacaactctaatttctagaaaaaatttaaggcataggtagatgtatgatggagactcaacattttttttgtcgggggaaaacatctaaggtattcttataagggaggtaacggaaaaaataaaaggtaaaatttttaatgttctctctttgttttgtttttaactgcagaatctgtttaatatgattgtagaaatacctcggtggacaaatgctaaaatggaggtaccgatatactttattaatatgaaaccgaaatgattataatgatataaaactttgttgcaagttgtttggcataatattttaaatttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggccaatattttaaatttgagatagttcagaaaaatactcaaagctaagtatatacgttatagttttatagagagtttttttttcaattttgcctgtcagtttgttatatacatattaattttctttttttctcctttgaaaatggcaaatacttttaaaggttgtttaagtagattctgagatatatttggttcatagatggaactgaaacttttatttggggctgatggcaattttaatttattaggactcaattctcctttagattttattctaccaggaaataaatcatttcctggttaactcaatttatgactatcacagagcatctgctatttttctggttagctttttttttttttttaaatttttccgggaaatgaacctataagaacttcctttttgctattcagaattttcttgttctttcttcagttagctatagaagcttatatataagcttccttatagttctaagtgaaatttaatttacgttactttgtttagttatataaaccttctataactttgggtgtgatagcaaatattattttaagtatttaaattaggcattattatgtaggtgtatatttttcagaatttatatttggaagagaattgtcagtactatcaccaggtcctggcagtattttttgttaacactttagtaggaaaaggtaaagatattagattattcttttggtgttgtttcatgtataatgtttcatcattcttgctagtctacctcagttaggtggaggatgcaaggatctatgagaatctacctaacttaagcagtgtttcttcattcaacatggcttatttttttgtttcctatatacataggttttaaagatagcaatgtgaatatacatgatagaaaactaactttgaggccgagtgcagtggctaacacctgtaatcccagcccattgagaaaccaaggcgggcagatcacttgaggccaggagtttgagaccagcctggccaacatggcaaaaccccatctctactaaatatacaaaaattagctgggcacaaatttttgcatggtggtgcatgtctgtaatcccagctatttaggagactgaggcatgagatttgcttgcttccaggaggcagaggttgcagtgagctgagatcacaccactgcactccagcctgggtgacagaatgaaactctgtctcaaaaaaaaaaaaaaagaaaaaagaaaactaactttgaaataaaatcagttggtgagaatctcttttttggtgattttttaactttattgtatattgacaagttataatcgtatatatttatagggtacaaagtgacattatgacttatgaatacagtatggaataacttaagctaaataatatatctgtcacatcaaatacttaccattttttgtggtgagaacatttgaaatttactcttagcaattttgaaatgtacgttattaactatactcatcaagttgtgttgtctcaacaataaaacatcttattcttcatgtctgagattttgtatcctttgactatcatttccctattccccctacccttagcctctgtaactataattccactctctgcttttatgagttcaattttttagattccacatataggtgagaacatgagatatttgtctttctgtgcctggcttatttcacttgccataatgttctccagtttcatccatgttgccacaaatgacagaatgttctgctttttttaaggccaagtgctattttattatgtatatataccacattttctttatccattaatctgttgatggacacttaggttgattatatattatttccaatgttttttgatggagtctctagagttgtctatatataagatcatatcatcagcaaacagtgacagtttcacttctttctttcctactttggatgccttttactgttttctcttgcctaattgctctggctaggatgtccaatactatgttgaataaaagtggcaaaagtgggcatccttttctttttccaaatcttagaggaaaggctttcagcatttcactattgaatatatggtaggaatctttgagttagttttattatcataatattgatgataataaagcctgagattagtaacaaaaggcaagttgattaatctttatcctcttgccatctcaatcattttattatttgtgttagaaataatggagtacataaataatagagtgactaaatatatgatctggtgtttcctttccaaacaatttttctcatatagtgctataaattagtaataagagctggcttaatttcttttaaagcatctttgatcattaagttgaaatatgaatgtttagtctgaaaatagcagatttttaaaagtactatttggacatagaattaattatttcttatcccatctccttttcttccttctgtgatttgcttagattgccaccaaggagccaatgaatcccattaaacaatatgtaaaggatggaaagctacgctatgtggcgaatatcttcccttacaagggttatatatggaattatggtaccctccctcaggtaacatttttgttacaatggtaaaatgttcctgtcttctgaaaaaattgccttataaatcctgtgaactactgaatttaaattggttctgaggacatgtcatttggagaggtttgtaaatttggaatttattaacgtggatggagttttagtatatcaataaattttgttttaaaccatatatatgtctatactcaagttcttggagtcaggcatatggaatgttcacatttgacattttgaatacatttttttttttctggtcttgcctattaagtgtcagtgaaaaacttttaagcgaggctttatctacagtcattcctttgaacatgacaagttatgcttttatacacattcatatatgatagcacaaattttatattttaaactttaacagatgaatgtgttaaattattaactttttcctggaactcattgtaaattgaattgcacaacttatttactgttatgagttaataatttttaagtagaaagcagagaaaacaagagctaaataatgataaggtagcattcctgttggagaataacaactatttgcttttcttcctttctttacctcttttggttttctctcatgtttcctcattcccaggaagaggtaactcttccagattatttagtgagtaaaactcagaatatgctgaatcaaaattctaggttttggggacacagagaaccatctgcctttatgtttataaaaaccatagaccatctgtctggaaatttaatttttatatttttatttattttaatattttgcatgaaatttcaagatggtattggggaaatatctgagaagagaggtcttgttttatccaacatgaaaaagcagctgcccgtgtagaataaacattcacaggaaaatttaaaaaaaaattgttttctaaagagtcaggctgtctctgattcagttagatcacccacatggatacattcttggttaaaatgggcacttctaaagtgatatgctaagaatgagaatgcctgtggaaaccatgaaagcaggttttctaactctccaggtacttaaataggtatgctgtttgacccaacagcaaaaggttgaaaaagttctgtaaagcttaggggatgcagcctgtaggaaatgtgtggatgagggtaatgctgaagaagccaatgaattagagacagacaaaaacagagacgtaagtagaggagctagagaataaactaaggtgcatgtatttatttctttaaacatttattaaggatttatgtgctaggcaggatattaggtgttgggtatataaagacagatgggatatagatgtgacatcaaggcctcataataagtgactggaaaatgtgggtttgggagtgagattgtcactttctagtaatgtgaccttgggccttgggaaagatacttttcctcattttcttcatctgtaaaatggagaacataaaatatctacttcttatctttgtgttgagattaaatgagttactgcatttgaatagtgtgtaacatgtagtaatcaattattgttataattaagactggtacttttattatcgtatggttctttccctaaagttgtttttagtctgattggggcaatcaagaactaaactgctggttatgatgtggtataataggcactactaattcatctactaatttaaaattatgaaaaaaataaaaaagcaaacctattgacaggaaagagagaaggggaggaacggaggtaaaaacaaaagaagcttctgtagttttccatttaaagtcctgccaaacttctgtgctcctctggatgtgtctggatttccagatgttctgcagtggtattaatctggcaggtacggtagttcttctactaataaaacagaattagactgtggtagtcccttaattcattattcaccctgcattcaccattgcctacctaagtttcatactccatccaatatccaaattgatatttttaaaacacaaatttgcagatgcttttcttgtacaagaacaccttaatggtctcctgttgcttaaaagataaaatacaaaattcttaacattgctactcaaccctgtgtgatctggcctccgcttacttctctatcctcattttgcagcattccccctttctcacgtctatccaccacaaagtcttcttcagtgtttctaacttacctcattgtgtcctcaccaggccttcaccaaactgttcattcattcagtacatatttattaaaggcctgtatatttgcaaggtgttcttgtaagtactgcaggtaaagcagtgataaaaagtgacagatatttctctggagcttttattttagtcagataaacagacaataaacaaaataaaccccaagtaaaatgtcaggtggtggtaagtatgtcaaagaaaagttaagcagggaatgggactaggggatattaggattgttgcaatttagacagggagacgatctcagtgaaaaggtgttatttgagtaaagatctaaaggaagtgagggaacaagtagtgtggacatctagaggaagagcagtccaacaagaaacagcaagtataaaggtcctgaggtggaaataggcctagcatgtgtgagtatcaaaaaggaagccagtgtggctagaatggaagtgaaagaggaaatagacctgcattctgtctgccattttcaattagagatctgtactacttttttaaacctgactgatcttggagagagagagagaaaaagagagagagagtctgtgtgtgtgtgtgtgtgtgtgtgtgtgtgtgtgtgtgtgtgtgtgaatacaccataaattgcatataagttagttatttatcaaagaaaataactaaattgaatgatgtttttaagaatgctgaaatcatgccaattgcttatgggatagcttatggaatagctctacctgattttttttttttttttttttctgcttgatggttgatgttcagacatgaccctgttaaaatgaaagccagcccctggtcccatttatctttttaatctcatctccaactctccttctgccttctgcttcttcacttccacactggcactctggtgctcaaagcacactgatgtctcaagccctcaccttcactgtgtcctttcctgggaacactcctttccaggtatgcacatggcttccttaggttgcctttaactcatcttcttcatagtatctgccaatcatcctttaaaacttttaaccctactcccattccccctctcatactttatttcccttttctataacacctgccaaattgtaacctgctgtataatttatttattatgtttattgttaatttctcccagctagaatgcagacttcatgagggcaggtattctgtctcttttgttcactgatacattctgactacccagcttaatgcctgccatggagtaggtgatcaataactgtgaaatgaataaattaatgcattgtgtatgtgtgtcacatttgtttcataggcgtgtgtggatactttagctgttctatgattcgtcttgtaacagcaagaaacttgttcagagcagttactgagccaactgtgtacttagaagaacatttaagcagcagaatactgtttaagtagtagtctatccacttagcttgtgattcatcagtataccatcattattcagaccttcagctgtctagaccgttagcctgaatagcatctcccgcactcctaataatgccttcctcaaagtttgagcttccctgggcaaaaattcatctcgtcttcccaccagtttattcatattgcccacatgtaatgggttatttcagtgttacatctcattgagtgaatatttagaatacctgtctggaaaatattaaaagactagattcagtttaaattcaaaatttcttcagtcttaatgtagtattgatatgtttattttgtgcttaattataaatttggttcattgacctccccaatcaaatatatagtcctacttattagctttataacctgagacaagtgactaaatctctctaggcctgtttgtttatctgtatgatcatactacctaccctacaaggttattgtgagtattgaatgagttgatcagaggtgtttggccccatagtgagttcttaataatattaactcaatgatgatgattgctactgatgttagctactagtagtaaaaacactggtagaggcttttgctccaaattaaagctgggaaagcataggtgatggctcatccctgtaattccagttctttgggagcccaagacaagaggatcagttgaggccaggagtttaaggttgcagtgagctatggtcacaccactgttcttcagcctgggtggcagagtgaaaccctctcttaaaaaaaaaaaaaaaagtgatggtagtgggaaagtcaaaggtcttccttcgacttgtgataggaatgctggttaatcaggaagatattcttaagaaccacctgtatatatggctttgtatgattcagggattttttaagagacctaaggaccagagtgtggtgattagaaatgtattggccattacttatagattgtaaggtaataatcacaaacacctgcatgaaaatgagaaggatttgttttagggtataacaataatatgtgtattctgatttattcatttttatagctttataatcatcttttctataatactgttttcctgttgataggttgtttgtagctttcttgggtccatgctaaagttttctgtatagatagtaaatatacttatatacctgttagtcaaattttgagttgtataactattctatagatagtatatatacttatatacctgttagtcaaattatgagttgtataactattttactttactaagtatttccagattgttataaaagaagttgtgacaatttatactcctgccagcagtatatagggttccagtaccgtatatccttactaatattttagattataagatttttaggtttttgaaatagtatcttattgtgattttaactagtatttttctgatcagactaggtatcttttcttaatttataagtcattcatgtttccccttcttttaattacctgttcatatcttcaacccattttagttgggttgccctttttcttatttagttgccaaaactatttctaaagtctggaagctaatcttttgtcatttttgtgaaaccaatattaagattttgaacttctgcttcttgatatttcttctccagtgtttgttcttttctagttatttgtctgttaatagttacacacataagactccacaagagggcataaccaaagcttaaatttgtcaagatttcctttcctgttgaagttatactgtattttcaagttaaattagaggtgagttagtgtgtctttttgtagtaaaaactaaggcctgtagatgcagagtattaaaggttggaaataaagagaaccagtctggtatttttgctggtaaggaaaatcatgaagaattggccctaaacataacaatattgtagagtttaagaattttctacttgggtacttaatttctcaacatatggaaccatattgctaggtaatgttgaaattggagttctgaggaccaaccaaccaacagaaatagtcaccacaactaagttaatgtcaagacagtctttgtctctgtgtgaggaatgacttaaaaaaaattaatgctcatcaaaattgtcataagtaggtcataagtatgtgggcttcatgttcactggtagcattcatgcagattgtaaatgagcactaacaatctcagcattttagggctagaatgtgtctaaagatcctcttattggccggcgcagtggctcacgcttgtaatcccagcactgtcggaggccgaggcaggtggatcacgaggtcaggagattgagaccatcctggctaacatggtgaaaacccgtctatactaaaaatacaaaaacattagctagggtggtggtgggcgcctgtagttccagccacttgggaggctgaggcgggagaatcgcttgaacccaggaggcggagcttgcagtgagccaagatcgtgccactgcactccagcctggtagacagagggagactctgtctgaaaaaaaaaagaaagaaaaaaagatcttcctatttaagcctttcttaatagctgaagaaacagatctggatagtttaatcaagatagtttgtggtagaatctagatgttttcctttaggccaatgggacttctagcttgtcgcatttgttctcttgggagtgggagtagggataagcaaaattatgagatgggatttctgcattagcaaggaggaacctctcagatattttctgattctgcagtaggttgtttgattctgattatacctgggtgtcccatcctggtttccccagcacgttaagattatcattctcagcaaactatctcaaggacaaaaaaccaaacaccacatgttctcactcataggtaggaattgaacagtgacaacacgcacacaggaaggggagcatcacacactggggactgttgtcgggtggggggaggggggagggatagcattaggagatatacctaatgctaaatgacgagttaatgggtgcagcacagcaacatgacacatgtatacatatgtaacaaacctgcacgttatgcacatgtaccctaaaacttaaaagtatcataataattacctttattgcatttgtcacaaatgccatgccatttattataataataataattcttattacctttattgcatttgtcacaaatgccataccatttattaacatgacactctccatggtattgactgtttcctataaatctctgttactggcccaaagtaggtactcaataaatgttttactgtatgaatgaatgcctgttaatagaaaaaaagaagcagtaacgggaagactgggaaagaacagaacctctctaggaaagttacttaggagattgctcagagtaagagaaggtatttgaaagaagagaaccgtgaagtagatggggttatatttgaaaataaatgccattcaattgttatcataatttgcacataaaaaatgattagtagcatgagttctaatacaatctttaccatatagaaaccatgagtttgtgcaagtttaaactctgtgtttcaatttacttatctataaaatggaattcgttatggtatattattcatgtggtatgtatgtatatatgtgtatgttgtgtgtgtatatattagctagaaagtgtttgtcacctatgaccagtatgtaagattaacaattgtggttattcttatattttcttagtagtattagtatttggggcagtgaaatgttgttggacttcatttattgatttttttttttaagataaagttaggccaggttatttctgaataaactaattagtactagaaggaaaatattggaatttctctaatgcttagctgtaaataagtttgtttgtaattatctatataaaattaaaggaaataagcttagataacctgaaatcttagataataatgataatctgattcttgggatgacggtctctgtatcccttttagtttgaatttaaagcaaataattttagggaacttctacagttccatttagaatcaggcaattctgaggctttttgggagagatagtgcctaagggatctttaatcttactagcaaatttctattacagtcttcatttataaaaattcctatgtgtatattttgtaaccaacagggtataatcttgccagtaaactaaagaattgatgtcttttcatgtttttatcaaggtccttgagatttgacaggtagaggattttttaatggaatgaataagacaaaataggtttttattttctttagtagtgttttgtcctttcatttataaagggaaaactggattccttttagtaatttagatccatgtgctgttaccgggtcaaaggaagcggtgaatgacggaagccacagttgaggcagtcagcggaaacacagaaacaagggcacagacagtgggaacatccactgaaactctaaaagtgaatgtgaatttattccctgactgaacttggaagatgagtatgtctgcatataccacccacttgcagatgcaattataccagcaactgagagatggaggaaatactataaatctgttttaaatattatgatccttagggacatactggcctgttggccttgggcctatgtaatttctgataatgttttctttggattattgttatctataaaactttgtgattatgtggaaagattaaagtacattatagtattaacttacatttctgcttttttttaaaaaaaaaattttagacttgggaagatccccatgaaaaagataagagcacgaactgctttggagataatgatcctattgatgtttgcgaaataggctcaaaggtttgttttatagactgtattaattctaacgtgagttttggtttattcatgccataaaatttcattttagcctctagttcttcaactcttcagagttcaagcctattgatttctctgttatcagtccctccttttatcttcactttcttgtcttaaaccaggggttggtaaattatagccctgtaacaagtcaaagccagcctaacacctgtttttataaataacgcaggtatgcccattcatgtacatactgtctatgactgcttttacactacgacggtagagttgaggacttgtagcagagattgtatagtctacaaagccttttattattattttattattttatgtctaccatctgaccctttatggaaaaatttgccaagtcctgtcttcaccttccttgcctattatttagataaaaacttcaattctcatgaaagtcatctgatactttttcattttttgtgtgcctgcttccaggttgccacatcctactgaataaaaacaaaatccacaatttcagagattgatgctccccatcaattcttctatatgtctttggtcagttctttcttctattttctactacgtttattgttactatttcttgttctctgcagacattcaactcttctcccttttttctcactcctagaagaacatcttacctttaattttgtagagctcagaaaccagcacataaaaactttcaatgtggtttaaatttgtatttctctgatgattagtgatgtagagcatttttcatgtgtttcttggccacttatatttctttttttgagaaatgttggttcgtggcctttgcgcactttttaatgtttttcttgttgagttgtttgagttgtcttagtcctttgttggaggcatactttgcagattttttctcccattctgtaggctgtttattttgttgattatttcttttgctatgcagaaggtttttagtttaattaagttaaatttgtctatttttgttttcattccatttgcttttggggtcttcatcataaattctttgcctaggcgatatccagagagtttttcctagattttcttcaggaatttttatagtttcagatcttaacatttaggtctttaatccatcttgagttaatttttgtatgtggtgagagataggggtccagtttcattcttcagcctatggctagccagttttcccagtaccatttattgaatagagtctcctttccccattatttttttgttatttgttgaagatcagttggttataggtatgtgacttcatttgtttgttctgtgttttgttccattgatctatgtgtttatttttgtaccagtaccatgtttatttttataccagtactacagctatgtggtataatttgttgctgagtaatgtgatgcctccagatttgttctttttgcttaggattgctttgactattctggcttttgtttggttccatataaacattaggattgttttttcctaatgctgtgaaaaaatgacattggtaatttgataggaattacactgaatctccagattgctttgagcaatattggcattttaacaatattgattcttccaatccatgagcatgggatgtttttccctctgtgtcatctatgattcctttcatcagtgttttgtagttcttgcagagatgttttacccacttgattaaatgtattcctgcggggtgtgtgtgtgtgtgtatgatgcgtgtgtgtgtgtggctgttgcaaatgagattttttaattttgttctcaacttgaacattattggtatgtagaaatactattaatttttatatatagattttgtatccttaaactttatcgaagttgtttaacaagtctaggagtcttttggaggagcctttagggtttcctagctacactatcatgtcattagtgaacagagatcatttgacttcctcttttccaatttagataccttttatttccttctcttgggtgattggtctggctaggacttccagtactatgttgaatgggagtggtgagactggacatccttgtcttattctggttcttagggggaatgctttcaactttttcacatttggtatgatgttggttatgggtttgtcatagatggctcttactattttgaggtatgttccttcagtgcctagttcgttgaaggtttttatcatgaaggaatgttgaattttatcacgtgctttttctgtatctattgagatgatcatgtggtttttattcttagttttctttatgtggtgaatcccatttattgatttgcatatgttcaaccatccttgcattcctggaataaaccctacttgatcatgatgaattatctttttaatgtgcttttaaaggacacaagaacaccagtggagtgttgaagcctcccactagtgtatttctcaggttcttaggtttagtagtagtttttttatgaatccgggtgctctgatgttgcgtgcatgtatatttaggatagaccttgatgactgtgtgccttggtgatattcatcttgcatagcatctctcaagtgttctctgaatttcttgtatctgggtgaaaaacatggaacaattcatgaattcacatatcatccttgcatcttatagccagagaagtttattcctttaattaataagacctgaaataatacttactaaatatgaaataaatatatgactaccatctaaaaaatagttctcggttaggggtatgctcctttctttcatgcctggctatgagatgagtggttgaatcagctgtaagaaacatagtggtaggaagtcacttttaacaccgcattgttaatgggcagagggaaagaagcagagtcctggaagttggtaacagacttagaaccacagatatagaaaacttgaatgttctaagtcccttgagggattttgtattgttcatttggtgtctaagaaaactaaatgttatactttcagcacagatttgttgaattgatttagattgaattgaagcgtggtggttttgtaagaattctaccatttattcctaagcatctagtttttggtttgattgagttttcctttccagtttttaacggtgttacagcaaaacactgctttgtttgaaataaaactgtgcctttctgttgcatgtgaagtcaaagagtgtgtctcattctgaggcaacttggtaatctgggcatgcttccttgcttgctttataacctatacatgtcttatctgttcttatgttgtttgaaattttaaaataaattttgtgaataaaaatagataaaacaatttagaatgtgctttttaaaagctatatgtgatttccaggaattcttataccctgctgccagagtcatctacaggatttcttaactttgacactattgatattacagatggataattctttatgagagaggactgtcttctgcagcatcctttgccttttcctactagatgctagtaatacctcctccccagttgtggcaacccaaaatgtcttaggatattgccaaatatcccctagagggcaaaattgcctttggttgagaaactctcatttagtgtatccagtgtgaattaaccagtatagccaactttaaactggcaattatgtgataacttcaaatttgaacatttttgttttataaaggatcttacacatcttttggtccaatgtgccataccctcctgaagacttctgttctcaaggctttttattctagttgttccttatctgacagtttctagattattttccactctggttccttttcactagatcatctctgttaatgcccatgttagaatggagcagtctgggtgcagtggctcatgcctgtaatcccagcactttgggaggcgagctaagaggatctcctgaacccaagagttcaagaccagcctgggcaacatggtaagactgagtctcaaaaaaataataataaataaatagaataccatactaccacagctaaacgcccttctctaaatatgatccagcctgtataagttagcaattacatatgcagttgtaaaatttttctatggagtactttagttttgatgtatattcagagctgcaaatatcatccatatctttataatcacttgtcatatgttccttttgggcttgagaatctagaatttaagcaaccagagtccaaacttgaggacatgtatcagaaatactttgtgattgcagctggtaagaagcatgccggagggcagggaatgggaaaggaacagacagtatttcagacaattgagacctcaactgtagagggaaattctttgtttataatgtctcttcccgtggacagtgttgtcattatatttccttcacagatgtagctttagctattaacccctggaggcatgcacaaagagcagctgagctaaacacacagtggcttctgtgagttggcaccaatatcagttcagaggagcccatataaatctgctcatctcccattttccatctccagagccatcgtttctgtaatttttcaaatgggagtctaattttggagtggaagcagcttagttgtttacctgtaatttggagactaaggaagatgaaacttctctttctattaagaaatagaaaagcaggttaagaaatcagaggtttggtgtttttttaagaatgctgtaaacaatggttacatgcccttttatagaattagatcactgtaggaaataacatataaagtgtccctcagaaaatctgattccttgtctttgatcctttaggatattcttcatgaggtgtatacttttcaaaaaaaacttctcctagcctttttgtttactgagaatggtaaggggaaaaatgaatgatttcctttaggaacccaaaccttaatactgatgcttatagtaaagtactagtctataaaccattatttgaggtgctctataagaattatctcatttattcttaaaactgctatgctgtgaaacaggtatttttattttcaaattttacataaaattatattccaaggaagttaagtaatttccccaaacttacattgctagtaagttggcagaattgggattgaatcccaggtatcttgtactggagcctgtgttcctagtctttacaccaggggtgtccaatcttttggcttccctgggccacattggaaaaataattgtcttgggccacacataaaatacactaacactaacaataactgatgagctaaaaaataaataaataaaatctcataatattttacgaaagtttatgaatctgtgttgggccacattgaaagccatcctgggctgcatgctgcccgtaggccgcgtgggttggacaagcttgccctatccccttctgcctctactgctaatacttgtgagaattgatccacatatttatatccatcctatttatattctttagaatttgcaggttatagccatatgatttcaacttttattattcaaaatgacagaattctaatttttgagatttactttattaagatatgtttgattaaagtcttgatttaaatcagctgcattgcaacaagtttttctgcataaagtttgttcttttgctttaatttgataaatgtttgtatttttttgattgacgtttttaagaaattatctgatcaattttgtagttaaacacaaaaacgtaagtattttgttcattatagaataaacttgaaggtaggtattggaaagaagcgaaccattcacttaatgataacatagtttcaggagagaggacttaagggataggagctgttttattatggttcattttgacatgtatataacaacctccaccatcatcaaaaataatttgtgattaattttttaaattgaggtacaattcacataaaattaaccattttaaagtgtacattaaaattagtggcagttaatacattcacagtgttgtacaaccatcacctgtatctatctagtcccaaacatttcatgacctcaaaaggaaaccccatccccattagcagtcactccccatttcattctctaactggcccctggcaaccactaatttactgtctctatactataggtttacctattctggatatttcatgtaaatggtctcacatgatatgtaaccttttgtgtctggcccctttcacttagtgtgcttttgagattcatccatgttgtagcatgtatcagtacttcattcctttttatggctgaataatattctgctgatggataatattaccttttacttatccattcattagttgatgggcatttggcttgtttctaccacttggctattatgaatagtgctgctatgaacattcatgtatgagtttttgtttgaatactcttatccatttttttcacctaggaatggaattgctgggtcatatggtaattctgaatttactctttgaggaaccaccaaactgttttccccagcatgttaactccaacgaacaatattcaaggattccagtttctccagatcctcaccaatactcattattttccctttttgttttttaacaatcatcctagtggttgtgaaatggtattgtgatttttttaattaaaacaagcttacgtctgattttatcttaaacaaatgtggataattattttatccaataaaataatgcatttaaaaaaatagttttagccataaatgtgaagtagatttttttctagctttgttgagttataattgacatataataaactgtacctatttaaagtgtacacaaattgatgatttttgatataattacatgcaaaattattatcaaaaataagaaaatgaacatatttatcacccccaaatgttttcttacacttctttgtaatctcttcctttgacactcccaaccctctgtcctcaggcaaggactgatctgctttcttagtacagtttggcaggagaagaagctttggctcagtttggggtatgaatcccaggtcttccattcactagttctgtgatctcaggcaaaaattatttaaccgttgtgaatcccagtatctttgtttccaagacagggataatatctacactgtacactagtttttgtaagtgaagaataaaatgatacccatagaagacatactgtagtgcccatcacacagtgtctgtttggtaaatcattttcttttctccttgtacactatttgtttttccttataaatatttcactacccttatctagactatccactgtcatgtccctaatctagatccaaattacctcatatctatagtgttatagtcttctgatttgttagcctctatcttgtccttttatcatattagagaacctaccttgacactctgttgcctagatcagggcagtggcattggaaatgaagaaggcacagctatgagaaatgatgcacgtagtgttgatattacatgtttaaactcacatgtgttcggtcttatatgctgttcggccctggggtgtctaagtcacccaaataagattgtaaatccttgagaacaattcattctttctttaatacacagtgcctaatatagagccgagtacttaatagaggctaaacatgtgagtgtctaatataattgtgtatattcccttggaattcagatttcagtttagtttatacaatcactttagtcagttgtgttaactaattacaattccatgcagatttatgttaagattttagaatcaacttccaaatattctgacaggatttatttgactttatgacttgaaattctagtattttttccctcaaaataaataatttcaggacacagaagtgacttttttctacataccttgttttctaaatgtaaaactgcattttgaattctgagaaatttattctgaagcatgtgttcaaattccaggtttacagtgaaaatctatagccaactaaacctttaaaagtaaaaggatatatacaaagaatgcatgcatataaacttgacgttggcagcttgagggaacctcactgaaataactttcttaagcacatggaacatctgcttaagtcacgctatttctgggtttctcttaaaatatttttgaaatattttatgaaacctgttttgtcaatatcatttattattttcttaaggctttactctattatgttttacttttcactagtaaccgataaatgtggtttgttaaaaaggtactatgaagcaatgtaaaaggattctcaggtctcttttcccctcaagcagcaggaatcaagtttatattatgtaatggtacatacaggtttattttctatttagtgtgagtgtctaggcctagtagataccttaaatttcaagatatgtaaataacttcagtttcagcacaaattgcaataggttgaaactgtaaacaggtccactttcttggtgcctaattttttaaatatatggattgcttttacttacataatgtgatgagattttgatttgttaattaaaaaattgtccttagaccttaaaatgacttttttcttaactttttaattttggaatattgaccattatatgaaactttgcaggtaggcataagggaataagttatattcgtgctgaaaatctcagactcattgatgatagctgccagtgacaggagtagtgttgccactgtaagatacgccatctttgttagttactctcatctactcgtttcttgtattctgcctcttggtcatctttgattctcatttatctgcaaattttcttggtaataaaataatgcacttctagccaaacttgcctatgctctcttatgtccataattttggggcttgttttggcagtagaatgaaattaaaggttttgcttcaacttctgattcctctagatggaagaagaaaaatgatcccctttgtagatttagagcagccagagaaattccctccagaatagagaaagcaaaatatggaggagaaggtcaagatgacaggcaactacctattgtgtgagaattctgcaaacactaagcagggatattaatttaaaccacaaggtatttatattatgaatgagcttgaacatctttttatacccctaaaggctgttttcatttcttctgtgaattgcctgttgttcatggtttcttccatttcaattgagtttttttcagtttatttatttattttttattatacttaagttctgggttacatgtgcaaaacgtgcagttttgttacgtaggtatatatgtgccatggtggtttgctgcactcatcaaccagtcacctacattaggtatttctcctaatgctatccctcccctagccccccacccccaacaggcctcggtgtatgatgttcccctccctgtgtccatgtgttctcactgttcaactcccacttatgagggagaacatgagttctggttaaagtctgttttatcagagaccaggattgaaacccctgcttttttttttttgctttccatttgcttggtagatcttcctctatccctttattttaagcctatctgtgtctctgcacgtgagatgggtcttctgaatacagcacactgatgggtcttgactctttatccaatttgccactctgtgtcttttaattggggcatttagcccatttacagttaagattaatattgttatgtatgaatttgatcctgtcattaggatgctagctggttattttgcgcattaattgatgaagtttcttcatagcatcgatcatctttacaatttggcgtgtctttgcagtggttggtaccggttgttcctttccacgtttcttgcttccttcaggagctcttgtaaagcaggcgtcgtggtgacaaaatctctcagcatttgcttgtctataaaggattttatctctccttcacttaggaaacttagtttgcctggatatgacattctgggttgaaaattcttttctttaagaatgttgaatattggcacccactctcttctggcttgtagggtttctgccaagagatctgctgttagtctgatgggcttccctttgtaggtaacctgacctttctctctggctgcccttaacattttttccctcatttcaaccttggtgaatctgacaattatgtatgttggggttgctcttctcgaggagtatctttgtggcgttctctgtatttcctgaatttgaatgttggcctgccttgctaggttggggaagttctcctggataatttcctaaagagtgatttctcacttggttccattctccccatcactttcaggtacaccaatcaaacgtagttttggtcttttcacatagtcctatatttcttggaggctttgttcctttcttttcactctttttctctaatcttgtcttctcgctttatttcattaatttgatcttcagtcactgatatcctgtcttgtgcttgattgaattggctgttgaagcttttgtatgcttcacgaagttctcgtgctgtggttttcagctccatcaggtcatttaagctcttctctacactgttgattctagttagccattcgtctaactttttttcaaagtttttagcttccttgcaaagggttagaacgtgctcctctagctcggagaagtttgttattatcgaccttctgaagcctacttttgtcaactcatcaaagtcattcttcatgcagttttgttctgttgctggtgaggagctgcaatcctttgaggagaagaggcattctggtttttggaattttcagcctttctgctctggtttctccccattttgtggttttatctacctttggtctttgatgttggtgacctatggatggggttttggcatggatgtcctttttgttgatgttggtgctattcctttctgtttgttagttttccttctaacagacaggtccctcagctgcaggtctgttggagtttgctggaggtccactccagaccctgtttgcctgggtatcaccagcagaggctgcggaacagcaaatattgctgcctgaaacttcgtcccagagggggcacctatctatatgaggtgtctgtcggcctctactgggaggtgtctcgcagtcaggctacatgggagtcagggacccacttgaggaggcagtcttgtctattatcggagctcaaatgccatgctggaagaactactgctctcttcagagctgtcaggcagggacatttaagtctggagaagctgtctgctcccttttgttcagatgtgctctgccccagaggtagaatctagagagggagtaggcctgctgagctgtggtgggctccgcccagttcacacttccctgcggctttgtttacactgtaagcatagaactgcctattcaagtctcagtaatggctgacacctctccccctaccaagctcccacatcccaggttgatctcagactgctgcgctagcagtgagcaaggctctgtgggcatgggacccgccgagccaggcacgggaggggatctcctggtctgtcagttgtgaagaccatgggaaaagcatggtattttgggcaggtgtgcaccattcctccaggtacagtcactcatggcttcccttggctagaaaagggaaatcccctgacccctggcgcttcctgggtgaggcaacatcctgcccttctttggcttgctctccgagggctgcacccactgtccaaccagtcccaatgagatgaaccaggtacctcagtttgaaatacagaaatcacctgtcttctgcatcgatctcactgggaactgtagacgggagctgttcctattcggccatcttggaggcaacctcctatttttttaactattaaaataaactttaagtcattatgtatatatataaaacatatattacaatagaatatactcattttaagtatatggtgagttttgacatatgtatacacacacataacctcctccttcaattaaaatatgaagcatttccatcatcccagaaagttccccctttcccctttgcaaagtctttatgactcccggcattctaggttggtagcgtttttaagaattttaaagatttcatttctttgtcttttggcttacattgcttctaaagagaaatcagctgtcattcttatcatcgtacccttatgtaatctttttttcccctctatctgcttttaagatttactctctgtcactatcactggttttcagcactttgattatgatgtgcttcactttggattttgtttgtttgtttattctgatgggtgtgtgtgtgtgtgtgtgtgtgtgtgtgtgtgtgtgtgtatgtgcatgtgtcctttctcaatctgtggggtttatacttttcatcaaatttggaaattttttggacgttatttattcaaatattttttggcctcctctttcccattctggaattccatttatacatgagatagaatgctgaatgttgtcccagaggacactgggattgttaattttttcttaacctttttgtttctgtgcttcactttggaaagtttctgttacagtgtcttcaggttcactaattttctctttggcaatgtctattttgttgttaagctcattgagagaatttttcttttcagattatatatgtcttagctcttaaagttctatttggttttttttgttttctatttctctcttccatattgtcatgtttttctttaaatctttgagcatatttacagtagttgttttgaggttcctatctgttaattccatcatctaacatttctggaaatgtttctgttgaatgatttttaattttttccccatttagggtttacattttcttgcatattgacaggatcttggatgttgtgttatgtcgagtgcctggatgttgttgtcttcctttaaagaatatttgtttttacaggtagttacttgtgagtcagtttagttgtatccaggcacttttaaaactttgttaggacaggtctagagtaacctttgtttgagagccagtttagtcctaccattaatgcatgcctattataggctcactaatgaatgccccttgtggtaaatgaggttttcctgggtggttggaactcattttataggtctctggccattattctttgccttgacttataaagtctcatcccatgaatgcacaggttagtgtttaatccgtgtctcaaaggaacccctatgtatattgctgtagttatttcttatttctagtaccatgccctacaaattccagctgcctcatcctccatttttttttaacctcagtgagatccctgtcctcttactgggttcctttctctctgctgtggtttggaatgtgtattgagcagaaaaccagggcaatcacatctcttctcatttgtttacttctctctgggatcacagtcctgtactgcctgttgtttaatgtctgaaacgagtgatttcatatattttgtccagttttttagttgtttgcaatgggagggcaagttgtttatctgtaaaataattcagtcattggtgaaagtggaaattttgagaaagttaactctaaagggacattgcaaggcagactttggctattttcatattatttttaattattgaggctttgttacatttcagtctgtagttcttttaatcttttatatggattttgtgatatgtgagtaaactctccaaagccttgcaaatagtgaatttcttttttctttaaagattctttcttgtggagaagttattcatgtgaagatccttggaattttggctcttattgatgaaggtgaaacagattggaaattaattgctatcaatgcgaatgatcctgaagcctcaaagtttcatggtaagactgttactttccagaaagtgaaagcaaattagtgtgtcattggaattctgagaacttaaaagaagttcacataggggagttaaatgtactttttaaaaaagagagaggaaaagatgtagatagacaaattatattttaaatgaagaaagtacattctactggtttccctctattccctttttcttccctctcctgtcacctctctttcactttcttcctcttcctttcactccttccttccctcctttcttctttccttacttccatgattttgatggtccaactgctgttgggaactgttttgaaagcatcctttgactaggaataaaagcatacgatactggcatttttaccctgaaatctcttttgttcatatgactaacaagaagaaactaaggaaggagtgttcatcgatgacaaaagctatttctgcacctagtttttgtctcttcttgtacaaatgaagggaaaagtaactgccctctaacgaaattttgatgtcctagaaattttaagttctggaaatagcttggcatgatttaattttgtttggagtcagacagacttcagtttaagttctggctgtgctacttcctggctgagtgactttgggtagatcattcctgaatttcagttgctcatctctaaagggagatgattatacctacttgtaaagttgttggcaatataagaaacgatttatttaaagcatctggctttcacataccagtgttgaatatatgacaactattattattctttgaccaatttttcctctatttttctttcctgttttattcttgctcaggatcctctttacttgtaaacctcgattctaaactggaagatattaccatttctaagatgactgaacctcattaacaatgtattaatcttagtttatgtacctttttttgcacttgaaacaggaagagatttcttttttgtcattcttgtatataactgagaaagggagaggtctgatagcgtgaagtgcatgtaacctcaggatcaaaagtaaaatgtgaaaactacaattaaaatatgagctcaagtctataaaccatatatattccttatctcattattttaccctgattttttctatttttatacttttcatatacatatatatgagaacagtaaataaattttatttagttaaaaacattttttagcatcttaactgctcctcaaatgagaattgataaggtaatagtcccacaggcagccgaaacaaatcatccacctaattcatttgtgatctgctacactaaagtcatgaaactgtgctaagggatgcccctttaaactgaaaaagctgagcacctgaatgaaaatgaaaatattatttagagagtagtagttcagtactgttggagatgtgatttaacattttaaactctctagcatataacaagcgctggtgcctgttatagtagatattgttcttaacttagaagatggtcagagaatgtaagtgacttgcccacctttgcaaacatgtaaatagtacacagtttgaactcatttctgtctgattctaatgtgtgaattgctcagtactgtattgagcaatatatagcccatctataatattataccaagcaattcatccttgattctagtaatttatatatttgtaactagaggtattgaaactagatcacataagcctagcatgactccttgagtttcgtaagtgttagaataaaaagttttaactctattcattttatttctgttgcgtactcagaatggagatgactttgcactttggacacctttctaaattcctttcatatttgcttttatgaagagatatgcagaaacactaaagccagttgctgatttgggttgagaagaaattattgaacttgagtagttaaaacaagatgttattgttttagaacaccaatacatttatcattgtattaaaagtgaatacatgtattattttcatcatgaaaaatacaacaattcttattcataatatgtttttgaactcctaaaagaatgagtaaagtgtatggggaaaatgaaaattgtttattttaaggatatttgtatattgttctcattagttagtacttaaagtactcttctcctatatctagattttataaaataagtttggtagtttttttttgaggcagtctctctctgccttccatgatggagtgcagtggcacaatctcagctcactgcaaccaccgcctcctaggtttgagtgattcttgtgcctcagcctcctgactagttgggagtacaggcgcgcgccaccacacctggctaattttttgtattttagaagagatggggtttcaccgtgttaaccaggctggtcttggactcctggcctaaagggatctacccgcctcagcctcccaaagtactgggattacaggtttgagccaccatgcccagcaagtttggtagttttaagaatcacacatttttttctcattccttttacctacacattatcgttaatatattctgcatacctttgttgaattttcttctttactttacagagaccgaggaaaaaaattgatgtaggcacaaattgaaaggaagaagagattgtagtataaatgttttttatttttgaaaaattatttttagtcaacagtgtttaatcctaaatcaagcaacttttaaaatgttttggtatttatgtctttcatatttaccatctaaaatcacaaacacaggattttagatggcattttaaaaattataaaattaattttatacatggaaataaaaactcagaagtataaaaaaagtacataaaatgaaagtaaagtttttcttcctacctcccacctcatcttctcagatcttatcacagatgttttttgttcttttgaatggttgcttccttctgtaaatgatgtgcttatatttcttaatttatgcattttccctgttgactcaaattattactttggaagacaaggaacttaaattcttaaacatttatcaactgtgttaccatatttctactattaccctaataactctaagttgtatatttggagctggatttattgcttcattgactttgaacaataactcttaactgcccagtgtagaacttagagcatttggtttctacatttttatccttttctgtcccttacaacctaacttctctcagctacactatcaattctacagtatcaaaatttataatgtttaaattatgttaagtataattgtttttcctattttgcttcatggttgaatctgaaaattaaaaactaagtagcatttacagtattgttatgtaaatattcatttagtttatcatactatttattaagtgatcatctttgaacagactgttctctgaacctcctgcatagctatcacctgcgggtttcttttcaatgcttggttagttctacttacttaaattctaccattccctctttagttttcccttttcattgttggctggtgtccattttccaaaaatatctaatgcagtaactttaaatataaattgctgtgtataaattgaaatttctattacaaaggaataagtgattttatattttatgaccgtttaaacatttgtcatctatacttcttggcatatttgtcagtcagataaacgagagaaatttaaaaacacttaggagagggcagctatcaggaattttctttttaattgtgtagttttctgggtatgtgtgtaatataggagtatatagagattttttaaatttcctatacgtttttattgttattaggcatttaaaaagtaaatccttggccggcatggttgctcgcaccagtaacccaacactttgggaagctgagacaggaaggtcacttgagtgcaggaggtgagaccagcctgagcaacgtagtgtgacttcgtttctataaataaataaataataaaaattatatccatcctattagtttctactatctttagaaaaagaggccaaggcaggcagatcacctgaggtcagaagttcaagaccagcctgacccacgtagagaaaccccatctcttctaaaaatacaaaattagctgggtgtggtggcacatgcctgtaatcccagctatatgggaggctgaggcaagagaatcacttgaacccaggaggcggaggttgtggtgagccaagaacacgccattgcactccagcctaggcaacaagagcgagactccatcccaaaaaacaaaaaacaaacaaacgaaaaaaaaaaagaaagaaaaagaagctgttatttggcatggtttgtcagagtttttcttttttgaaaatgaagctcgttttagttcatagtatgtccttatgtatgtgtattttctttttactctattcatatagacacgtttaagttgtgattcttcaaagacattttggggttgttttaatttgtgaacaaatacaataacttttattttttttgatataaataaaatgaaataacttttttgatcctaattaacatatgtacagactttggtagactatatatccctgttttaatacttacagtttttacctatgatgactgaacttaaactagccattgcatcagataacatttttcaattagtaaaaaaagtttttcttgttatagttctgtaattttaacattactgttttaagtcttctagtttcaccttctaaaaatggagtagccactgtaaaagtctaaaaaatgtccaaataacatttgaaatgaaactcgttgtattccttgatacaaaattggtcacttcagcaggctcattaacaaaaagccaaacaccacatgttctcactcataggtgggagttgaacagtgagaatacatggacacaggatggggaacatcacacaccggggcctgttgtggggtggggggagcggggaggaatagcattaggagatatacctaacgttaaatgacgagttaatgggcgcagcacaccaacatggcacatgtatacatatgtaaccaacctgcacattgtgcatatgtaccctaaaacttaaagtatacataaaacaaaacaaaacaaaacaaaacaaaaaaacagagcactaagaccattttatgccctgtaattaggtttcatgccctaatgctcttattggtaccctaatggcctgaaagagttaataagactcccaggacacctaaattgttactagaaaataccttggccagtgtgaataatagctttggttatgaaataaccaagtttagagctttttaagaagattgaaatgctagggcatgtgtaatttttctcgtggttaaattaaccaccttctataatgtacagcttcagatactcaccaaacagatgtttgtgcctcttcagaactgccactgatgcctaaggaccttatgtcaggagaactaatgtcacgaggagctaatttaggcctagatgctatttcaacttgcagagcaatgaagatttcttttgtttggcctttaaataaatgaaaactattgtctgttgtgctgcaataactgtttacctgtgcagtgattttatagttttaaaaaatgaaagatttaaaacaatcgaaatcagaatagttatattgatatagatacattgtggatgaataaatcatatgagcaattatttaaaatgagaccgttctgacattttcataggccggcatcacacttgtcctaaaattattaaggtatgtcttttgtatatgtagaatttcagcttatatttagagaaatttaaaaataaaaactactctctttcaaggcaaaaataaatatgttgagacacaatctatttggcttaaatgttcatttgctaagtaaacacttccagtgcttctgtaattattatttaaaaataagcaaattaatgtagtgtttgatttcctttcttcctaaaacacaacttaatactgtcatttaggggaataaaaagaatagcatagtgatcttaagggaaaatattcatgttttgtaaccagaaagaatagagttcaatttgtgtgtgttagaagacagcagaatgtactggcttggaaaggggcttgcatatcagcatcatcaacctaagagctctaacatttgtcaaacaattgcaatatgcctaagaagaaactatgctaagtgcttcttttggaatatgtttaatcttcacacaacttcaatgaagataagttattctctttttttaaggatagagaaactgaggcaccgcgtggatggggcatggggcatggttagtaactagcctaaatcatatggccagtcattccactccagtctggctccagagtccatgttcttcattgctgcattacatcactcttctgaaaaatgccgggttagtcagctgtatttgtggccttggaccttgtcgctttctaagattgctgaccatttgctcttaagtaatttaggcatcagtgggacaatgatagagattccagtgaaaagttagctcttttgatcatattcctcttatttcattaatgggtgtaggtatgtagggatgggttgtaggaggaggcagttgaggaacaaggacaaatcgagttaaaaaattataattgagatggaattaaattaccgagaacctgctgtctcttttttgaaccttgacctcttacagttttttttttttggtttcagtcattcccatgatatggtgaagtatgggggaggcctaaattctaaaatcctctttttgtttattaattatctgacctcggaaaagtcataacctctcaaagcctttgtttctttatttcttaaaattgtagagtggatcttctgatcactaaaagatccctagggtttttcccatctctaaatttttgttataggaaatatttttaatctattatttttagcttgttgtcttctgttagtaaaaagacctaaattatcttcaaagttagtgctgtgggaaacccagtttaaattaaaggattagatgatttcttggggacattggcacgtttttaagtgctttagggtaactgttaagtgatgaagctggaagttcaatggaggtcagtctgacctgagacctgtgcatttagccactttgttatatgcttcaaatcaaaattagattagaaatatttgaattccttccatatacaaggcagctgtatggttttcattttactggtcatgtgaaattacttgtaaactggtaatgaatgtctatattttgagaaaaatctaagtcttttctgagaggtttttctgctacagtgcatatagtctctatgtagaattaccttgtttggtaatactcactttgacatgtgttaattccattattttttcatgatgttaatacacatttttagtacaggttttgtcttggtaagagtacaatttatgaaaaggagaatggagaaggaaagggcaagaacaatgaaagatactcttcattagcccatgaatgttaaacgtagatatgcagaacagtttggaaacatgaaaatcttttagagattctgagtaagcataaattattaagaaaatcagttctctttgcagggacctctatttgtgatacagaaactacaatgaatgttattaaatgaaacttgtttcttgtgaatgtttataagtcattaaaaacacatgttcttgcttcccacagagtttctttagagggtactagttgtgcacatgtttagttctgtgggagcaacatttatagtactgggatgagagtgttgtgcaaatgaatcaacatcacttcctttagtaaagtggaaactcctttttcatttttcttttttcctcccctttggacaaaattttagcataaggctatatcctggtgtcttttttccccttttatataataagggcaaagagatagggtattacttttatgtcactggtttttatctaaaaataaaaaattctcagccgattgtatgctttcttcactttgtgttatggctgggtggagataatccaggtaaagcagcattttaatgttttttcgtcctaacatttgtggaagtatatgtagccctcaatttgtgaaagcggatggaatgtttagagatgtgaatttatatagtttgataaagctccctgggtaattctgatagatttccttcaaattgagaaccattccattaattaattcttttctgctggttggacattctagtcctggatgtagaataattggtaacaattttgatatttattcagttagaagaaggtcttaagatgtaattacctaattaactttgatatttgcctcacacacacctgtcactccatttttaaagctaatattttgattccctttgagatcttgagcaaattacttaaccttttagagtcctagtttactaatttgcaataaagagataaataatacctcatttacaagttgtgaagtttaaatgacatactattgttggcagcagtggcccgtctggagcagctgctgcaaagactggctgcagccggggaggcacagccaaggctgcacactccaccgggctacaggagccaggaacaggtgggagccccacccccttccgagttggcagggtgggatcaccaccttcctggacacagctgcagccacacagccacagctgtggacctgggcatccctgcactctcgggggcctgagaagcccccacccacctctgcaggctcggaagtgcctgctactgctgcctggcctctccccactctgattttggagtgaagtcgaggccgatcctgggtgctgttgcaacgcagccaggtgtgccctcactcatagtggcactgacacaccagccccctgccacctcggccccctctggacttttggcgctgacgagcatgggagggaggccaaagaggtgctgagggtggcttggtgcaggcctgtaggtgccgcttggcacaaacagcctgggtacagtggatgatgtatagatagcgggaggcagacaggctcctgggcggaaagaggtgggtccacagtgaagccccaccttaaagccagggatggcctgaagcctggggaccaggctgtctgttctgggtgaaatctgtggcctggagtgagaacctaaggtgcgttttctgggcctaaccatggctgcccatgggccaatcagcacacacttcctccctcctgagcccataaaaaccttggatttaaccagactcgggaggacgggacaacctgcctgcgttaggagctacccgctctggatgtcctctctgctgagggctgtagtctcagtgggcctcaggctcaatgggatgacctacctgtggataggagctacccacttctgatcttctgcgagctgtactgtcagtaaatcaccttgccttgctcaccctccatttgcccaggtacctcattcttcttctgtacgggagaagcactcgggaacacccaaatggcgaaactgaaagaaccctaaggcaaacaaggctgaaacatgccacctcctgatcctgctcgccacattgcaggcaacaaggagaagagaagagctgggccccttcagggatcccagacctaatggctccctgagccagggctgtgacaccctctttggggctctgcacttcttggtgcctccaagcttctaagtgccaccgtgtttcctggagcctctagtggaagccacttgcggggtttgcctggtccagctgcagcctcgcagggagccggtgcctgtgctggtgcccggagttgcctgccctttgccactccatacctggcttgcccttggcatgcgtgggatccaggcttagcacgagcggagcgcagcctgccaggccgagtgggtggaaggagcccagcgggccgagcaaaactcgggaaaaggcgccactggccacagaggtttccagctggaaaagcgacagctgaagaatcctgtggcactattactgagccataggtttaaagtatttcaaaattttactagatattatcaaattgccttttgcagtgattgtatcatcagtgtatgagagtaaatgcttcctaaataatagtttattatttttttgccaatctgatacataaaagatgattatcttgttttaattctttatttttctgcttactactgggttggaacatctttcttgtatttctattggcttatttgtatcttctcttctgtgaattgagtatgtaaattgtttgccccttttctattggggttgacattcttttggtataccagagtttttgcatattaaccctttattatttaggttgcagacattctatttgcagagatgctatattgacttttggcttacagaggttttaaattttgatgtattccattttatcagtcttttttaatacatcactttagtgttttgattcctgtttaaagatttgttacctcttggtcagaaagatgtttttattttcttttcactcttgtattttattatctttacaatcgagtcttgaatttatgtggaatttattttgtctgtgtatacaatttttctaacactgctgaacagaaaaagtcattttcttcctcctgttttggaatgtctttcttacacatttcattatacaggagtctgtttctggattctatatggtgtcagtgatagaatcctgtgccagcatcatgttattttaattatgaagacttctaataaggcatatatgagactaatcttccaccttttgttctactttttcaaacttgatgtttcttatgcctttattcttttttttctttttatactttaagttctagggtacatgtgcacaaagtacaggtttgttacataggtatacatgtgccatgctggtttgctgcacccatcaactcgtcatttacattaggtatttctcctaatactatccctcccccagtcccccaccccccaacaggccctggtgtgtgatgctccccaccgtgtgtccatgtgttctcattgttcaactcccacctatgagtcgtgtttggttttctgtccctgtgatagtttgctcagaatgatggtttccagcttcatccatgaccttgcaaaggacatgaactcacccttttatggctgcatagtattccatggtgtatatgtgccacattttcttaatccagtctatcattgatggacatttgggttagttccaagtctttgctattatgaatagtaccaataaacatacgtgtgcatgtgtctttatagtagcatgatttataatcctttgggtatatacccagtaatgggatctctgggtcaaatggtatttctggttctagatccttgaggaatcgccacactgtcttctgcaatggttgaactaatttacactcccaccaacagtgtaaaagcattcctgtttctccacatcctctccagcatctgttgtttcctgactttttaatgattgccattctaactggcgtgagatgatatctcattgtggttttgaattgcatttctctgatgaccagtaatgatgagcatgttttcatgtgtctgttggctgcatacatgtctttttttgagaagtgtctgttcatatcctttgcttactttttgatggggttgtttttttcttgtaaatttatttaagttctttgtagattctggatattagccctttgtcagatgggtagattgcgaaaattttctcccattctctaggttgcctcttcactccgacaatagtttcttttgctgtgcagaagctctttagtttaattagatcccatttgtcaattttggcttctattgccattgcttttggtgttttagtcatgaagtctttgcccatgcctatgtcctgaatggtattgcctaggttttcttcttagccagttttcccagcaccatttattaaataggggatcctttccccattgcttgtttttgtcaggtttttcaaggatcagatggttgtagatgtgtggtgttatttgtgaggcctctgttctgttccattggtctatatctctgttttggtaccagtaccatgctgttttggttactgtagccttgtagtatagtttgaagtcaggtagcatgatacctccagctttgttctttttgcttaggattgccttggctatgcgggctcttttttgattccatatgaactttaaagtagctttttttccaattctgtgaagaaagtcattggtagcttgatcggcatgtcactgaatctataaattaccttgggcagtatggccattttcacaatactgattcttcctatccatgagcatggaatgtttttccatttgtttgtggcttcttttattttgttgagcagtggtttatagttctccttgaagaggtccttcacatcccttgtaagttggattcctaggtattttattctctttgtagcaattgtgaatgggagttcactcatgatttggctctctgtttgtctgttattggtgtataggaatgctcatgatttttgcacattgattttgtatcctgagactttgctaaagttgcttgtcagcttaaggagattttgggctgagatgatggcgttttctaaatatacaatcatgtcatctgcaaacagggacaatttgacttcctcttttccttatcgaataccctttatttcattctgttccctgattgtcctggctggaacttccaacactatgttgaataggagtggtgagagaggacatccttgtcttgtgctgattttccaggggaatgcttccagtttttgcccattcagtatgatattggctgtgggtttgtcataaatagctcttattattttgagacctctttgtaggtctctaagtacttgctttatgaatctgggtgctcctgtactgggtgcatatatatttaggatagttagctcttcttgttgaattgatttgtttactgttatgtaatggccttctttgtctcttttgatccgtgttggtttaaggtcttttttttatcagagactaggattgcaaaccttgcttttttttgctttccatttgcttgatcttcctccatcctttattttgagcaaagtgtgtctctgcacttgagatgcatcttctgaatacagcacactgatgggtcttgactctttatccaatttgccagtctgtgtcttttaattggggcatttaacccatttacatttaaggttaatattgttatgtgtgaatttagtcctgtcgttataatgttagctggttattttgcccattaatttatgctgtttcttcatagtgttgatggtctttaccatttggcatgtttttgcagtggctggtaccggttattcctttccatgtttagtgcttccttcaggagctcttgtaaggcaggcctggtggtgacaaaatctctcagcatttgcttgtctgtaaaggattttgtttctccttcacttatgaagcttagtttggcttgatatgaaattctgggttgaaaattcttttctttaagaatgttgaatattggcccccactctcttctggcttgtagtgtttctgcagagtgatcagctgttagtctgatgggcttccctttgtgggtaacctgacctttctctctggctgcccttaacattttttccttcatttcaaccttggtgaatctgacaattatgtgggttgggtttactcttctcaaggagtatctttgtggtgttctctgtatttcctgaatttgaatgttggcctgccttgctaggttggggaagttcttctggataatatcctgtacagtgttttctaatttggttccattctcctcgtcactttcaggtacactaatcaaacgtagatttggtcttttcacatagtcccatatttcttggaggctttattcatttcttttcacccttttttctctaatcttgtcttctcgctttatttcattaatttgatcttcagtcactgatatcctttcttccacttcatcaaatcagctgttgaagcttttgcatgcgtcatgaagttcttgtgctgtggttttcagctccatcaggtcatttaaggtgttctctacactgtttattctagttatccatttgtgtaacctttttcaaggtttttagcttctttgcgatgggttagaacatgttccttaagctcggagaagtttgttgttactgaccttctgaagcctacttctgtccactcatcaaactcattctccatccagctttgttccattgctggcgaggagctgcaattctttggaagaggagaggtgctctggttttttgatttttcagcttttctattctgttttctccccatctttgtggttttatctacctttggtctttgatgttggtgagctacagatggggttttggtgtggatgtccttttttgttgatgttgatgctattcctttctgttagttagttttccttctaacaggcccctcagctgcatgtttgttggaatttgctggaggcccactccagaccctattcgcctgggtatcaccagcagaggctgcagaacagcaaatattgcagaacagcaaatactgctgcctgatccttcctctggaagctttgtcccagaggggcacccacctgtatgaggtgtctgtcggcccctactgggaggtgtctgccagtccggctacatgggggtcagggacccacttgagaaggcagtctgtctgttctcagagttcaaacgctgtgctgggagaaccactgccttcttcagagctatcagacagggacatttaagtctgcagaagtttctgctgccttttgttcagctatgccctgcccacagaggtggaggctgtaggccttgcagaggggcactgaggtccacccagtttgagcttccaggccgctttgtttacctactcaagcctcagcaatggtggacgcccctcctcccaccaggctgccgtctcacaggccgatcttagactgctgcgctagcagtgaacaaggctccgtgggtgtgggacctgctgagccagacacggaagggaattccatggtctgccagttgtgaagactgtgggaaaagcgcatatttgggtggtagtgtacagttcctccaggtacagtctgtcatggcttcccttgcctaggaaagggaaatccccgatcccttgtgcttcccgggtgaggcaatgccctgccctgcttctgctcgccctccatgggctgtacccactgtccaaccagtcccaatgagatgaaccacgtacctcagtttgaaatgcagatatcacccatcttttgcgtcaatctctctgggagctgcagaccagagctgttcctatttggccattttggaagtgactgcctttattcttgtgtacagattttagaatcctaattgtcaaggatttttggtatctttaaaacattaatttttacatcagttgttgatatatgtttcccatttattcaggtattcttgtttatcttttatatcttgtatatcttttagcacagtctgaaaatatcttaaataggtgtgttttaacttattttaaagggagaaagcattcatttgtacttggaattttgccatttttaactattgcagttgtgttttagtcatatatacattctaaactttgtcatcttgttcttcagtgatctttcttattaagttggtaccacagtttgtcaccagattccctcaatttgacctcaaatatctttcagtccattccctccttcttcctattgtgttaaactatcatatcttgcttttccattgaatcaatgttaacatttctctaattagcctcctgacacaaaaatctatctcccacactgtttaccagacttattttattttaaagaaaacgtatttaaaaaaaggttttgactcagagcttacagaaaaatccagattctctaacttagtaaatgcttttttttcctagccatgcacactgtttatccaaagttcttaacacactgagcttttcaccctttcttatatataccaggtagttttgcaccttagtggttttatcttttgagaaccagtttaaatatcatctctcagtgaattctctttgactctgcaaggcaaaggcagttggttaattgccacttttttcactcccacactgttttgtttgattctgtgaaatgtctttgatttcacagatttataattgtttgtttccttatctacccgcctatctagattatgaactctttcagggctgggactctctctctcttttatattttttagcccactttgaggtataaattacatccagtcaaattcaccccattttaagtatccaattcagtgagttttgataactatatagtcttctagcaactatcacattcataatacaaaacatttccatcacccccaaattcccacatacccctgtgcagtcaatcccttcctcctaccataggccattagcaaacactgatttactttctgtcacaatagtttgccttttctagaattacctatcaatggagtctggcatcagtgattattcacatggctgggtatatgacttttttctcttgcctaatgttttggagattcatgcatattgttgcatgtatcaggttagttcttcctaatttattattgaacggtcttccattttttagatataccacagtttatccattcacattactgttggaaatttgggtttccagttttcagctaatgtgaataaagttgctctgaacagtgaaattacaagtcttcatgtgaacatgttttcatttccagtggggaaatactcaggaatagttttgctgagtaagatggtaattatatgtttaacattgtaagaaactgtcaaattgtttaccagagtggctctaccattttgtattctactagcaaggtatccagttgctgtcagaacatgtattcattctttatactttgttacagattgtcttaaataacaaaatgttttttaaagaaagtaagagaaatacatttgcctgtgtacatgtgtcttttacatttgcccacatatttgccatcttcatacccatgtattttgtttcttcctgaagatctgtagatcttagtttccacctggtgtcattctctttcagttcaaggactttcactatgcttgtagtgcactcctgctggtggcgaattttcttttcttttttttttttttaatatggaacacttcacgaatttgcatgtcatccttgcgcaggggctatgctaatcttctctgtattgttccaattttagtatatgtatgtgctatttatctaaaataatctttttttgcctttgttttagaaatacaattttgcttgatgtcaaatttaaagttatagggttttttaagctttatattgatgttccattttctatcagcccccattgcttctaatgaatggtgaacagccatttgtattgttacctcatatacagttgacccctgaacaacatgggtttgaactgtacaggtccacttatacatggatttctttcaaccaaatgtggattgaaaataacaatattctcaggttgcaaaacccagtataatgagggtctacttttcatatagctggtttctgcagggctactgtgagactttcatatgcatggattttgggggagcaggtggtggtcctggaactaatccttcatgtaaaccttgttactagtgtataatgtattattttttctcagactgctttaaagattttctccttatctttggatttcagaaatttttttttctttgataagctaaggtttccttttgtttgtatttattctgcttaggatatactgagctttgtggatctgtaagttcatattttttcatcatatttgggaaattgtttgccattattatttcacttttgcgggggctctgttttcttacctgcgttctgagactaaatacacatattttggactactttttattgtcttacaatcactaacacgcttccagtctatttcatcttttttttccttactgttatttagactggataatttctgttaatctatcttctacttccctgtttttttgtttttttgtttttttcctgccatatccacgttctgctgttaaatctacctgatttttcatttcatatcctccttttggttctttttttttttttttgaagttttatagtttctgttcctcatcttggatttccatatgttcgtgcattgtgaccatgtttcctgaaagtcctgaacatattcataataactactttaaaattcttgtttgcataggtcacataaggattgatttctgttaactgctttttctcttgatacaggtctcagaaatattccagtatatacaataaatcgcatagtcatcctgccttcacttgacaggagccaaacttccagcctgtcctacctgcctgcacatcaggattcctgtgtgcccctggatgcagccctacatgttgttttgtatttttgttccctcttgggtctacaaagttacttatcttgtttttgagtctttttgatgttaatctgtttataaggtatctattttaggtaggttagcctgagggagtacattgaaacacgaatttagtgcccctcctgtcaaaaggtctctgttttttccgaagcagaatgctttggaaacttgaggagtctttttatttgctgataatttggttaatatgcttgaactcagtgaaaacctcatttcagaaataaatatttataagtacttcactcaagtaattctatttatatattccctctccattccaaatgtttaaaagaggggttaatttaacttcaacacagtggaaaaaaataaatttataagaactaaattgtaataatattagagataaaagtaaacgtgtctgttgttaaataagaaattaattacaaattcatttagggtctttactataagtgaaaaactatatgtgtatagcaaaaagttattaataagtatgcatgtgtatgtgtatatatgtatacctagatactttttatatatgttatttttagtctttgtgtttgtttataactatgcctacctacattgatttttcaggagcattatacaaattaaaataactgtcaatattaatgaaaatctgtttagtatttttctaaaaaaattaactcatgtttgtgtatttatttatttattcatttatttatttttgaggcggagtctcactctgtcgcccaggctggagtgcagtggcaggatcttggctcactgcaagctccgcctcccaggttcatgccattctcctgcctcagcctcccgagtagctgagactacaggtgcccgccaccacgcccagctaattttttgtatttttttagtagagacagggtttcaccatgttagccaggatggtctcgatctcctgacctggtgatctgcccgcctcggcctcccaaagtgctgggattacaggtgtgagccaccgtgcctggcctgtgtatttatttttgaaagataaaagcttgtaaagctattaatttgcctgtaagtgtaactttggctgtgttcatggacaaagttttggggaattggagagataatgattgatatttgttaagaattattcccttttattaggtgattttcacccattatttaatccccatgacaaccttgatttcttcttccctattctggatttgaagaaacaggtagtacatttttcccaaagtgatacaatatggaagtaccagaaatggaatttaaacttagtgctgtctgattccaaacatgtttttctttagttcttgttagaaacttcctgagtgttctcattgtcattattttctgaatatttttagagttttgattttcttttggacccgaaagttatttatttagtaagactttttattctttgtttatttgcttttaatatttatcttttaattatatttaaaaaatcaggggattgggggtggttctttttcagtaggcaagagtttttaaatgtgtttattgttgatctttaaatttattatattgtacttatagaatgtgttgtcttaatttccatgtgtttaaaatttcttaacattttctttgtttttggtatataattatttttaaatgttattgttttaatatgtctctagattaaataggtctcatactttctctaaatttctctctcatatatactgttcatggtctttgtatataaaatataccttatcaatttggcttttgaagtcatatcattactattaacttacttccaaagtatgtttaattctgaagtgtgggtaatattgaagtcttggcaaactcatgtgattagaaacacccctggtgcaacagagtgtgtttttggattcaaaaaaaaaaaaagagtagaaagaattttccaattagattttagaaacaagtgaattggtttatatggaaaggaaatttggttatatgaaagatatacagtatccccagtgaaggaaaaaaaagtcataaacgtttctcttagaaagtattatgttagatttatctcatgtctgcagagataaaatggtaggttttcattaagttattataggttttcttttatagaaacataaaccaaagttagttaagaaaaactaaattgaagtgagagctctggacttggaaaaacccaatggaaccttaagatttgtctgttatattgcttcattattacctgtttttcaactggaattttagagagaaatttacaatattttcaatgtatttatatagaactatgattatttataaaacatatttttatagttttaatacaaaaattcccttaaggagattctatataatctttgttaattaaactttcaaatttgaaagtaaatcatggctgcacactatttgtcagaagttatgacactctttataaagccttttttaaaaatctggggtgataggctgggcatggtggctcacacttgtaatcccaacactttgggaggccaaggcaggaggaacactggagcccaggagttcaagaccagcctgggcaacaaagcaactaaaacaaaacaaagcaattctactggaaaacaaacaaacaaaaaagattagccaagcatggtggtgcacacttgtagtcctagcttcttggaaatcgaaagtggatgaattgattgagccctggaagtcaaggttgcagtgagccgtgattgcacagtgtactccagcctatgtgacagagcaagacactgtgtcaaaaaagaaagagagagagagagagagagaaagaaagaaagaaaaagaggaaagaaaaagaaagaattttgaggactgctttcagttttacatctcatgtacatctcatctttactggtttattattgttaattttttttccattggtaattcctctgagttttactttctaaaacatacccaaaatcttaccatttatcactacctccatacaactacgtttgtctaggccctcatcatagttcacctaagtagactctcttagcagccccttattggacttccagcttccattttttcctctatgtagtcttttctttacacagcagatagaaagatcttaaaacatttactcctctgcccaaaaccatcccaaagttaaagctataatccttagtatggcccttagagtcctctgtgactggcctgtgactgcttctctaatcgtatctcctaatactttctgttttttcactgtgctctagccatgggactttcttactgtctccctgaaatgttaaaagcacacccttagttcagaagatttgcatttactgtcttcctcccagactgcactcctttcagatacctgaatgagttgctcctacagttcatccaagactctactaaagtgatttcaccagaggatatccctgacctctcatatctacaattctcttctttccttacttgcaaagcagcctatatgcataactgtagatttttatggtttttttcctcctaatgtttaactgttttcttacccaggcctaattttttttttcttttttgtttttatttttagatggggtctcactatgttgcccagaatggtctcaaactcctaggctcaagcaatcctcccacctcagcttcccaagtagctgggattaggggcatgccatggcacctagctccaggcttaatttgacaacagatattttagcaatgttttattgaattctttcagaacattcaaattaacttcataaagacaaacacttttttgtactcataaattcactggtgtatgtaatatttaattacatctcataattataataaaagatacagttagcataaatggtttgggaataaacacacctgatgcttggtaaagctaaaacttaactgatggaaatagaagtgtgggcttcattctagagtactctgccagagtcagcatacataatatgtgaacattaatcagaatgttctacaaaagtagagtctttactaatcagtccagtaagttgatcaagtagagttcgattaaaagagcttaatttgtaatcaaaattagaaactgaaatagatttagcttaattacatatatagcttttccagattatcctaactttattggattagttcatctctaaaattcatataaaattaattccacaagtgggaataaatgactactagagaactgccacttttcttaaaataacatagattgtaaaaaaatatatctaatcaaagatgtcctacaaatggatagtgttgatggttgcacaaaattgtagacatacttaatgtcactgaattatacacttaaaaatgcttaacatggcaaattttatattatggatattttatcacaataaaagaaaactgaaaaaatacatctttacttacattttttaaatgtaaataaaacttttgggcaatgttactatgcagtatagaagaaaaagcagaagtcatggaattagaagtcttgtatttatataatactagttctatcatgagtgagttggatagattttggcaagccttttaaactatcttagctgtagttttcttatgttgaatataaacatacttgtttttaactctcaggaatttcgtgaggaacaagtttaagttttatatatatctatgtatgcttttcataaactacaaataagtttatacactttagctggaactttttataatttcagaggggttattgaactgactgttggcattggatataagaatttggcttcaggcatttgctattgaggttttaaaaatgtttaaatatcttactgtaatttttttgttttgttatttgggacaatgcagctgttttctcctagggtataattagttgagaatggaaaagtttagcttatatttggagagttatacttcttatttccattataaaattttcagtttttttcctaatttgtgtctttgcttattgggtcctctttatgacttttggggagaaagcctcctagactgaggtagatattagataattagctttctctttctccttggaagtcagtgagttaagtaacaaaaatcatacaaaagttatatgatttgtaaaagttatatacagtggaagagaaaatgttagtttgagtaaggtacaacgatgaagtcataaatcagatttaagcaacagaaaattatttattgctttgttgcccaggctggagtgcaatggcgtgatcttggctgactacagcctccacctcctggactaatgcatttctcctgcctcagcctcctgagtagcttggactataggcaatcaccaccatgtccagctaattttttttgtatttttagtagatatggggtttcaccatgttggccagactggtctcaaactcctgacctcaggtgatcccaaagtgctgggattacagacatgagccaccacacctggcctagaaaattatttatcttgggcattgattaaattgcatttctagacactcgccgtcagtagactaaaagatttttttcccctctgaataagaaaaccgttcgttcaaggaactcaatattaattaatttttgcaaaacatccctgtttgttttgttataacaaaacagtataattttaatatgctctaataaatatattgtatacaatacaatatgctgtgacaatatactgtaataaaattaccagcaccactactctcgtgctttgtggccattctgaagcaaaataaaggttaactgaacacaagcactgccatatcaagacagtggatctgctaactgagaaggctactaagtgactaatggtgggtagtatatagaatgtggccacactgggcaaagggatgattcatgtcttggacaggatggagcaggacagtgcaagatttcatcaggctactcagaatggtatgcaatttaaaacttatgaattgtttatttctggaattttccatttaatatttctggattcagttgactgtaggtaactgaaactgcagaaaacaaaaccgtggataaagggagattgctgtgtatatgatcctcagtgactggcttttcctaggtgtctcctccctctcccctgcctcctaacagtgatgttctatccatgcagaaccatctttgtatattctaaaatatagtcccttgcttttatgtgtgctgttccttctaccttttcccctcttgtccagttagtgatgtacttctcacttttataatgctttcttttactccctcttctatgacattaccattgcttctgtttatctctgttaaaacctcattgcattttaattgcagtttatctatttgtctctttccctgagttaaaaactgagtatcttgatgaaaagaactttgttgtatccatccatttattccccatacatagcacattgtctgaagatgctttgtaaatgtttgtagagtgcaggaatagtattatacatatgaaaacacaaaagtctgaaggtgatatacatatcaatgatgatgctgctctaggtatcacaatcaattgtgcttctggttagactgggccccatgtttcctggctccctcagtccaatgctctgccactaaagggaattaattttggttcttaacaaaacatctttttgtttttttctttacagatattgatgatgttaagaagttcaaaccgggttacctggaagctactcttaattggtttagattatataaggtaccagatggaaaaccagaaaaccagtttgcttttaatggagaattcaaaaacaaggtgaagatgagaatctttattttaaaatgtacctcctgatacctgtacaatattcgtttcacttgggaagtttcttatgtgaatatgtatatatagcatggttaaaaaagtgctttttactaacttacatatttaaaaacattattttattatttaaattctgtttcagaagatctaagtgaatcaacaaggctgaaaaatatatatttccatctatgtgtctatagctcctacgtcttggaaaatgaaggaatttcatgatcagactaattttgcaaattgtgtacatagaaaaactttctatttactgttttgtggaggagaaagttactcacccttaatgtaaatccataggggactccctcctaagtgttcattctaccacgacggaactaagctgcttaacaattgaaaggacacctgaattatcttactgtcataggatttttctattagaataccactgagttaccacaaagtatctctaatatgacacagatggagagaatagaccaaagagttaaagtctaaagcatggaattttttttaaagttattaccactaggtaaattgaatatttgaaaccaacttttaagtggataccagtaagtatgttttataagtgaaataaggcatgttaatgaaaacttaaaatttataatgggtattttgctgtaaaagaattgattgctggactcagtgtttttttgaaagcacattaaaagaatccttcaaatcttgagggctttgtctgggattattaaatgtaaatataaaattattattttagattaaattatcttaaaggattgaaaatttatacattatttttcttttaaaaattttcattttattattgagataattgaaattttaaacctatatggtatttttgcctcagggtaagtctgccaagtcacgaatttgtaaagaatgaggtagtttttttttgtttgtttttaacaaatagtaattcttttctgtataaagatgaggtcatttatacaacttcaccagaaaataattgttttatgcattgctttttactactgctatttaaaatatagagccttagtgcccttagtattgctatgaaagaactgctgaggctgggtaatttataaagaaaaggtttatttagctcacagtcctacaggctataccagaagcatggtgctggcatctgcttctggtaagaacctcagaaagcttccagtcatgccaaaagatgaagggggagcaggcatgccacagggtgagagaggaagcaagtgagagaggtggaaggtgcccaggctctttttaacaatcagttcttgtgggaactaacagcaagaactcactcattactctgaggaggcaccaagccattcatgagggatccacccccattatccatacacctcccattaggcctcacttccaacactgcggatcaaatttgaacatgagatttgagaggacaaatcccctcaaaccatagcagggtataactcaagaattgatttgtgcctctttaacatggttggaaagatggctcctttcttttattgtgggtttttcttgccactcctttaaacaagtattgaaattggttctaaataatcacacttatccaaataatttgattaaaaatctatccttacataatcagataatgtattagatttcttgtcctgtatctgaagtgagattcccgcccaacactatctcattaagatataagtcgtcctccatcgcaggcaatcgtagacccgagagaaattctcttttcagaggataaatttcccattattactgtacctcagttcccaagattctttagtttctttattatcataatgagtttagttatcattgaagaagaaaggagctactttgaactaaccagtaaggactctccttaaggaaaacaaacaacaatttttgggaaaaaactctaaagaactttctgctttggaattataaagcaagttttccttagatattcttactggatgtatatccaacaagaggtatatctattgttgcttatgcatttttagacaatgtcataaatgtcaaggagatgtactgctttcagacagtggatagtctaaaattacttcgattgaaaaaactacatttagactgcctgcagttttgatgatgctgagattaatgggtgcatgcttactgacaagccgggtactgggttaagcactttacatatgtcatctcacttactctttcaacaactctgtgacttggatcaggggttggcaaacttttttctgtaatgggtcatatagaaaatattttaggctttgcagatcgtatgatttctgtcacagctgctcaactctgctatcgtagtactagagcagcataggccaaacacaagcaaatgtgactgttcagtaaaactttacagggggcagactggattttacccatagttcctagtttgccaacccctgatatagattatccctattatattctacttcatagatgaagaaattgaggcttagcaagcttaagtaacctgcccaaagtcacacagctgacaaataaggaagccagaatttataccaagctttgcctgactctggagctcatgctcttaacaattaactgtcatcacaagattagttttgtgttagtgtaacaatgtgactgatattaaatacgtctttttttatttgtttgtttggagctaggcttttgctcttgaagttattaaatccactcatcaatgttggaaagcattgcttatgaagaagtgtaatggaggagctataaattggtaagaatttgtcttttctatgtaagtaatgttatattaattggtattaaacagccacataataatcagatttcagatttttgcattttttttaatttaaacaatacagattatctacctattcattgggcattactaagtgttgggcactattaaactaggaattgacgtgatcttttttctcaaggaatttataatttagtgggaatactgataaataaatggacatttaattgaaatacattgtgcaaagatgaaaaacgcaatttttcagcatgtaaatctatgcggtttctttaaaatctaataactaccatataatttcttagaaagtaaaagcctccttattcatcatgatcactaattgattgattaagaggaattaagtaacagtaacataaacatttaatttaaaacatttaaatgtatattcacccatttttggatatagggctgagccccttttaatatagattccatatagattttatatacactctaacataacacaggatagaaaataaagattctgtaatccttaagctccttgtaacttaaaattcctgacagatttttagggttcttttaaaaaaatcatttaaattatgttatctacaccaaatttttgtagtgattcacctttattgaggctttttagggcctcagtattgtttaaagcctcgttagttttataacctacttaatgttcacagaaacagttcttccacactcttttacagttcatctgtgaacataattaatacttaaattttgaaattatagtaacaagtacaattgacgaacacatttaagaactaaaacaactgactcttggtaagtctaagtataggaggcaaaagcagtcctgtgggggtactaaagataacactatgaatacgatagagtccctgtgctctctgagcacagtctgggaatcaagagggtcattaaataaattctagactaaggtaatcagatggagtaaagaattatttaatatcaaggaatattttacctaagttatcaagaaggcccattttgcctacaacacaaatgcttggcattgaagataattgactttgtttctcttgcttactaaagaaacactgtcaactccttggccttctcccttttttcttacctcgtatgcagagcactcttttttttttaagcataatcttaaaatgcaggtaattgtttctaatataaataatataatttattaacagcaaagctggatatgattgaatgtcctctagtcttgtctatcctagtaaatggtagagtgagctattctttgtgggctaaaattaagactccagtgtaatgagtccctccagtatgaaggaggagggggtctgtgattgtctgaggaaatatttgcttgctctttgctgtcttatctccttcctaatcactttctaaaaagcttatgcagtctttgatgagacttgagtgtttccccaggtttcctcagctacacagccagagaccctttgtttggttagtatatatatagcttgaactcattccttctgtgctgagtctaattatccttactgtgaaggtaactttatttctaagctctggaatcattttgctatagcctcctgagtaatgataaggattacattaacagtaagagttaacatttattaactctatactatgttccacgttctgagtgatttatatatgttatgtaattaatactcaagaatcctataaaatatgtattgttatctccattttacacatgaagaaattgagtccacataaagatttaggtaacttacctaaggtcacacaatgcattgtggagccaggatttaaaccttactctctttttttttctttctttttttttttttttttgaaatggaatcttgctctattgcccaagttggagtgcagtggtgcaatctcggcccactgcagcctctgcctcccaggttcaagtaatttgcaattctcctgcctcagcctctcaagtagctgggattacataagcctgaaaccaagcctggctaatttttgtatttttagtagagacggagttttaccatgttggccagggtggtctcgaattcctggcctcaagtgatccgcccaccttggcctcccaaagtgctggaattacaggcgtgagccaccacacctggcctaaaccttactctgttaatagctatgttcttttacctcctctacattttttataacaaaataactttttttagtttaagaattttcagaatataagtttcagtatatgtatcatatgcatctagaaaatttaaagtcaagagcttcagaattttaactcattttaatccatttttctctttatcataacttaatttggaaatatattcagcgttgttagtttttatttcttttgcctttctgtaatgaattgcctatctttcttaattccttaaactgtaccattgtagattggcaagcttcctctgccttcctttttgaaacccatttttctcactcagttcagtttaggtccatactatcatagacattctctcaatgtatatgtaatacacagaattaactagggaaattgttagagaactcagatacattgtccccttctttaaacctagtgtattagtatctttaggaagtagaatctaaacgtatatgtttttaaagccccctatgtgattctgatgagcctctctgcttaagaaccatattattattattattattattattattattattattattattattattattattttgagacagtgtcttgctctgttgccgaggctggagtgcaggggcgcgaacatgactcattgcagccttgacctcccagagttcagcgattctcccacctcagcctcccaagtacaggcatgcaccaccacacctggctactttttaaattttttgaatggacagggtctcgctatgttgctagggatattcacgaactcctgggatcaagcaatccacccacctcagcctcccaaagtgctgggattacaggtgtgagccactgcgcccggccttaagaatcataaaatccaaacttgttctcatggaaaaacaaacaaggccgtccaagatttagataacctttcttgcctcattttccatcacttcttgtctcctatttcatgttacaacaactgaaggccacttgtcactgtgcttgtagtaatctctagacctttactcattttgtttcctttgccatgattgtcttctcatttcttgaactggccatgttactcatcttttaagatttaatttttacttcgtcttctctaggaaacattccctcatatgctagttgaaatgccagtactctctgtattccttgtcttctgtggatttttgtcattacatctgtcagttactaaatacttggttaatgaatttatcttcttctctagaatataagttcctcaagagcagatgaataaagatgccttattcatctttatattcctaatgcctggcatgtagtagccactcaataaatatctgttggagtaaattgttgaataatattttaaagccaaccattttcttttttttttttttgaaacagagtctcactctgtcacccaggctggagtgcagtgatgcaatctcggctcactgcaacctctgcctcccgggctcaagcaattctcctgcctcagcctcccaagtagctaggattacaggcacctgccaccatgcctggccaatttttgtatttttagtagagacgaggtttcaccatgttggccaggctggtctcaaactcctgaccgcaggtgatccacgcacctcagcctcccaaagtgcggggattacaggcataagccaccactcccagccttgtttttgtttttttttaatccaggtagtgactcttctcttttcaggagcactgcttttattaagttcttttcattgataccttgaaaattctctttctccgaagtttttttttttgttgttgttgtttattctttttttccactgctggatgtttactctgaaatctaaatattatattaacagagagaatttaatttctagtcttacctaagaaaactttaaacttgattctgggagaaatcattttttgacatttgagtttactcttcagtcctctcccactttctcttcaaccagttgatataccttattaagaaatcagaaatgtactattctgtttactactttattttattaatcattatttattttgatccatctgtcttacatatttttcaagttttgattgattcttgagtgccttctagttataaaactacactaattcagttacttagcatttctttactcataaagtaatgctttatttctttactcatactctttttttattaacaatcattctcctgtttaatatattctatacaatactgccagaattatctttcaaaagtatgaatataactcatttttatgcctaaaaacgtcttatgattcccttcaaaaatgggatttcatccaacccttctattcttaaacaatgtgtccaaacctgcctttccagcctcatgggctcttccttcctatccccttgtctttctttggtggacatcttcattttttcgagaagcagtttagatgtcacctctgcacagtttcatttctgttgggctgttgtatcactgctgtacatacctctatgtagaactggaggtggatttttttttaatactttgtattgagtttttacctcagcactcaatagcaggacttgatgcagtaggtagtctaaatatgcttactgaataaataaataaatatattcaattcatctaaattctttaggtcttaaagttgtttctttttacattcctagagaaaggtatattaacctggtacttcctttttttttttttttttttgttactttaagttccaggatacatgtgcagaacatgcaggtttgttacataggtgtacatgtgccatggtggtttgctgcacccatcaacccatcacctaggtattaagccctgcctgcatcagccatttgtcctaataatctccctcccctccccccaccagcaggccccagtgtgtgttgttcccttccctgtgtccatgtgttctgattgttcagcccccacttgtaagtgagaacatgtggtgtttagttttctgctcctgcattagtttgctgaggatgatggtttccagcttcatccatgtccctgcaaaggacatgatctcattcctttttatggctacgtagtatcctatgatgtatatgtaccacatcttctttatccagtccatcactgatgggcatttgggttggttctgtgtctttgctattgtgaatagtgctgcaataaacatacgtgtgcatgagtcttaatagtagaatgatttatatttctttgggcatatacccagtaatgacatcgctgggtcaaatggtatttctggttctagatccttgaggaatcgccacactgtcttccacaatggttgaactaatttacactcccaccaacagtgtaaaagcattcctatttctccacagcctcagcatcatctattgtttcttgactttttaataattgccattctgataataattgccattttagtaatcgccattcatggctcaagatggtatctcattgtggttttgatttgtatttctctaatgatcagtgatgatgagctttttttcatgtttgttggctgcataaatgtcttctttcaagaaatgtctgctcatatcctttgcccactttttgatgggttttttttttcttgtaaatttgtttaagttccttgtagattctggatactagacctttgtcaggtaagtagattgcaaaaattttctcccattttgtaggttgtctgttcactctgatgctaatttcttttgctgtcagaagctctttagtttgattagatcccacttaccaattttggcttttgttgtaattgtttatggtgttttagtcatgaagtctttgcccatgcctatgtcctgaatggtattgtctaggttttcttctagggtttgtatggttttgggttttacatttaagtttttaatccatcgtgagctagttttttgtataaggtgtagggaaggggtccagtttcacttttctgcatatggatagccagttttcccagcaccatttataaaatagggaatcatttccccattgcttgttttcatctggtttgttgaggctcagattgttgtagatgtgtggtgttatttctggggttccattgatctatatgtctgttttggcaccagtaatctggtacttttttatgtattgatagcctcagttgttttggctttgtgtacatttattccaaggtcacttccttctataaactctggaggttatggtctaaaattattgtcattctgatctctttaaattttctctttgcctttttcttgactactttgatttagaatgaaaagccttgacaaatctttatcctgaacactgtctttgaggattctcataagtgtgggccattgtttgatttgaaatttacttgaagaaaatggtttcccttcacaaaacactattatctgtctagtaatatactttattatttttatatgtaatttgggcttgttgtacacagcatttttggttttactgattttttgctctaatgtcatctgcttgttttggtcaacaaggttgtatataggtcatgtaacatttatacaattagaatataatatttaatatcttagtataaaaaggaaagcagtgcattctttttagtttttttttttttttttaagtttcgtttatagtgggcactaacagcttagtcatccctcctttaaatgattatactgcttttcccctggcaggtcgtagtaatagtttgagaagtaaaaagaatcttaaagattaaaagttccttggggcctccatgattcaatattgtgtctccagcgtctagaagagtccctgacacatagtgtgattttttgatttggcaaataaatatgaatcaatgttaaacaactatttttacatgaaggccagttcagaaaaaataaaaatatttcttggtatcatgccttttattacacttttaaacattcaaagtacaaataactattaaatccaagagaggataaagtacatttaggtatgtacacacacatatttacatacatatatgttcttacaacctagattacatatattattgactaaaaggacatcattgaggatgttggcactgtttttagctgatagaagagcctatttgataaatagaaggaactttgtaatctttcatcctatgtatcggtttatcttacaagaatctcctaagttcatttgtatgtgcttgccatttcatttttcattcttaaaacagctaatttttttttttttcttttttttttggagacgttgccttgctctgtcacccaagctggagtgcagtggcgccatctcggctcactgcaacctccaccacccaggttcaagtgattcccctgccttggcctcccaaggagctgggattacaagtgtgtgccaccatgcctggctaatttttgtatttataatagagatggggtttcaccatgctagccaggctggtctcaaactcctgacctcaggtaatctgcccaccttggcctcccaaagtgctgggattactggcgtgagccactgcacccaaccgctcatacattttttaaggtgaaaaaatagcagagtcaatttactttcccaagatatccactactggttacttgtcaagacattttatcagagatatttttaaatttttttaatttttaaaattaaaataaaattttaaatatttttaaattttaccgtgctggcttaaatattgtcattcttttctaatattcctattcatagtttcattttgttgtaagagtaggggattactttagaagtagggttatcagatttaacagatgaaaaatacaggacaccagttaaatcactttttcttctatttaaatatttcagaataacaaatattattccatgtaagtgtgtgtgtctctttcaatatttgggacatacttattctaacaaatagtttgttgcttatttgaaattcaaatgtaattggttgttatgtattttatatggcaactatatctagaaaagacctccccacccccgccccctgttctctcaccttcatttttccagaatttccaaggaatgttttactttggtttagttataatgttaaaagcattgttgtatgcattgtaattagtactttgtatatcgtagtttcttcacaggaccagcacttttttgcagtgtctaattttttgcctggttctttttaaattcatttttgacagtcatcaaggaaacatctaacttacagggctctgcctttttcaattgtcagcttgtttaaacatgagctgtagaaaagacaaaaaactgtcttttttttccccctcaacttttaagttcaggggtacatgtgcaggatgtggagttttgttacgtaagtaaacgtgtgctatagtggcaaaaaaaacttagtcttaaagatgttactgctaactttcatcagattctattcatgccaagaatgaaaatgaatcccacattatgagtctggatagaaaccaaaatgaccacttattataatcgctgtatactcagtgtcatcaattacaaacagatatagacagatgtttttatcaccgatatctcggcatatttcacacagctattgtgaaaataaatttgataatgtatatccttaggtccacttgagggggaatatgtttacgtgtgttttacctattattttatcttttaggtatctgctaatcactttttcttctatttaaaaaagttaatttggctttaactcccttctctaccacctctttatccattttaatctgcctgttcctgtgatgaaatttttaaaaatcagccttaatatgtttcagaggaatgatgcttttgctttcatctagagagtggcagtatgtaatgagtagcatgcttttagaggtataggaaaggcttttgactctatggaggcttccctagtcagggaaggagctgctattcctatgcctggctgaacttccctacatataagaaaacaaactttacattcatatagtttcctctttaatctccttatctgtgaaagagattccgcaaaaactttcagtagctaattacaatgtttgttacctcacttagaggaaaatttatcctaggtcccattgtgtgggtcaaatttgcttcctcttttcttcaataaaggtgaagtgcaattgtggtgtagctttttatatatacctggaaattattaggatttgtgtaatataatttttaaaaatcttttatcattctggagagtgctttgctgtggactactctatacttagaaccttgcctgaaagaatatacaataattttcattgtcttaatttttattcattcagtttctattcattggttaaaattatacaacagatgtggagtatttggagttagtttttggggtttttttggtaattgtttctttttatcctgtttaataataacattctcttttcctctccagcacaaacgtgcagatatctgatagccctttccgttgcactcaagaggaagcaagatcattagttgaatcggtaaggggcaaacatccaagacatcctttaatcttataaatgtcataggaagtctagtagaaattctgaaatctctagcaatgaaatgtgtcaagtccttttgagaagcataaagtttacagatcaccttgaaatctatttctgtaattcaaggaatttaaattaagaattttaaaaccttttagttgagtttttaaattttgtatttgaaagttcattaaccatttagctaacttcatatgatgctgtttttcttatcatccgtttattattgtttatataaatatgctctcctctgtactgttgtatctccatgaattatcctctgtccgtgtctacattggaactggctattggcacagttccagcttaagaataataaaattggcccagcatgggagctccttcccgtaatcccagcattttgggaggccaaggtgagtgaattacttaaggccgggagtttgagaccagcctggccaacataaggaaaccccatctctactaaaaatataaaaaattagctgagcctggtggtgcatgcttgtaatcccagctactcggcaggctgaggcacaagaatcacttgaacctgggaggcaaaggttgcagtgaactaagattatgccactgcactccagcctaggcgacagagtgagactctgtctcaaaaaaaaaaaaaaaaaattgaaaataaaataaaattatgtttttcagcttaagaaaaataaaattggtgagaccctttgcttttttatttctctttagtttggctgtctcacatgctttccttctgtaagctgagatgatatccttggatttttatatgtcttagtgataatgctgcatagaggcaactgaatttattagtaaattaatgactgatttggagatcactaaattagaaaatttatattcagataatcaagtaatattacttgtataaagtgtatttaggagtgatcttaggctagaaatctcatttataaattaagggtttttaagaacgatgagatttaaaagctagtgaatttagatctttacactaagaacaactaaaatgttcctaaatgttagttgatcactgtggctgcttttaatttattgttttttttgtttgtttttttgttgttgtttgtttgttttttgttttttttttactgatgtgtcagctatctaattatgttatgtggtaagatataggttctgggaatgcagtattaaagaaaagacacaaaaacctctgcccttgtgtagctcgcattttatctggagagatggataagaaggaaatatgcaagtaaaataatgaacgtttcagagagcaataaatgccttctgaaaaaatgacaaaaatgagcagggacaaggggataaaatgccagaagtgggatgggagttgtagttattaaaaaggcagtcagccacagcctcactaagaagagggctgacatatgtgccaagaattgtagaaggtaaggtcaagcgaaggaagagcattcaaggccacactcccaaaggtcctgaggcaagaggatgtctgaggtattcaagaaacactcaaagtgaccatagtgactggtagagtagagaaagtatgggggagaaaggaggagatgagattggaaatgtttggatctgggtttgaaaatgggagttgattatggaagactctgtgcaggctatttaaggattgcatttcttattctgaatgaggtagggaaccattaaaatattttcagcaaaggagtggtctaatctgactttgattttaacaagatcattctggctgcattggtgagaatgggctgtaggccataattagattagagaagatacaaggaagctgtcacaataatgcaggccacattattttctccaagttatcagttttgtatctatgtagattatattcagaatttggttttcattacttatttaaggatgaaaatgaaggaaatcaaaaacttttcatctttgtacaagcagtctgtctcactaatctcagattaagtctattccatgtatttcagttttagattcataaataatatagtagatacttgtcttaaaattagcgagaggctcaaagtttctatattagatcctgttttttcattgctttctgtcacattagtggcaaaacaaaaaaataattggaggacatatatgtgatctagttagattagaggaataagattagaattcagaaaggttaacatacagctttaattacctggcttggtaacttggttgagctttataataatgaagaagatactctactgaataatttttcactgagaatactgcatcagaaattcacaaattagagaaaccagtgcctcttcactagctcagtggaacttcatgtatgccagttttcatcattcaatatttgtaagtcaaagaattaccccattagcaccctcatgaatgatttcggattcttagagcccagattagttaacacctttctcatatagtgtttaatttgttataatgaaattctttgtcataaaagtattttgtctcatttcctttcttcagaatcacattgaagtatttgaatcagaattatttaggtgtatatttccatgtctcttcattttgctgtatactgaatattgtacagtcttcaaagtgctatcaggttttttttttgtcctttaattgcttagaataattgaagacacagaagtcattcatcatacttgatcagattcagaccgtatcaagtcctgggtttgtatgaaacaaattagaagacccaaaatttgttagtagcttagaatgagcgaattaacagctctaatatgtacctaagtaatattatcttgagacttatctgtagatgttaaatgagttcaaagtatggtcattacaaggccagacagtaatggaagttttcactttcgagatgcatattgctagaatactcagggtgtgttgattgagattttagaatatggttaactgctttgtacttttaaaatagacaaggaaaagaaaagaaatggactaaacttttgagtggttgatagaactattggaggaagtatatgctgggtgaacatttattgatcaaaacacaattaagtgtaacattgagacgaaacaaattgttagtcatccaacaatatgtacaaatcagtcaggaaatccaagaaaaataaaatataaactaacaaattgatgattattattaagaaccatcttagaaacaaaatagaaaatatctacagaagtaatttatcattcttaggttagagatctttagaaggatagatctgaaagatctgcaaagatttcagaaggagaatttaaatgatcaaaatgattattgggctttgtttacaaatatagatgtttgaactatacatgatcacaaaaagcatgactgtatcataaacaagttttgttcatttgatcccaacacactagggaaccataaaagggagagagagtgctctgagtgggctacagcatgtggaccctggcaacaggaccctgtatgtaatagttcaactgcaggaccactcaattattattatttttttttgagacacagggtcttgctctgccgcccaggctagagtgcagtggcatgatcatacagttcacagcagccttgacttcctgagctcaattgatcctcccacctcatcctcccaagttgctgggactacaggtgtgtgccaccacacctggcgaagtttttctagtttttggtagagtgggagttttgctatattgcccaggctggcctcagacttctggcctcaagcagtcctcccacctcagcctcccaaagcaccgagattacaggtgtaagccatcgcacccagcctacatttctttttgtaaagtttttttatttttttaaccttcacctgattttatagccaaaaaatatgagattcttccccaatacttgagaattttgtgactaacagttggatctttatttcagggagcaaggcttagagaatttatagagaacaaagaatgtgtgtttgtgtgtgcatgtgtgtatgtgtatgcaaagacatgatttgcctttcagataatattagttgatagtctttaaagacttgatttgactattgggggttaagatgctacttttaggaccctttagttaaatattattttgagaatgttgagaagattcaaacaaaatgtacaagattaatctaatgcacatacataattagtgaatacataattttttcaagtatatgtacacatttccaaaaattgagtagatattaggccacaaatagagttacaaaagacttgctgtcatgcagaccacattctctgtctacaatataatcaattatgaaaatattaaaagaaaaaagcacaagttcatgtgtttgaaaatttaaaagtacttataaataaattaggcctcaaaaaatataaataatttatatttaaaactaaaatatttaaaattggaagacaactgagtcagtgtatgttaaaacttatgtaatgcagcaaaaatagttcttgagaaattaaatgtatacaatatagcagaaattaaagaaaattatagaagttcaacttaacaattacttgtacattttgtttgaatcttctcaacaacttctcaaattgtaacttaacaattactctgttcgtttttctgactttttatattagaagaaaattataaagagtagagtaaatatttaatgaaacagaaaacaaataatgacaggatcaactaaaacaaaagctgggttttctttcttttaagactaattatacagacctgtggcaagaaagatgatgaaatagaataggcacaagtaaaaatagcaagaattaaaatgaagacataactacaggcataagacatatttaaataatcagaagagaatactgagaagctttttgcaacaactttctaaacacagatgaattgataattttgtttaaaatataaattgccaatattaaatcaataataaatagaaaacctaaataaacttgtaaaacaatacttaatcatgaagatggcaatttttcccatgttaattcatgaagtcagtctatttttttcatcagaatcccaatgaggttttcactgaacctcacagggtgattctaaaatgtatatgaagtagtaaagggccaagaataacctagaaaggattaataaatttaagtaaaggggaaaaaaactgtaaacaacaaaagaaaccttaaaataagttacaagataagccattgattggaaggagatattttcatgtaaatgataaaaggactggcatctaaaataataacttattcaaactcacaagaaaaagataacccagtagaaaaaaattgtgtaaacaacatgaatagacggctcacaaaagaggaaacatacaatgaccactaaacatcataatttgctttatcttacttgtaatcagtgggatcaaaataaaacacaatacaattttacagttgtagattaccaaaagtttaaaagtctgttaataccaagagtttttaggcaagtgaagaaagggaagctttcagacttgatggtataataggagtatagatggctacaactactttgaagaacattaagtaatttctagtaaacttgatgcctataattcactactcagaaattacccttctaggtacacatcttacagagacactatacatgtgtttatgatcagaaatggaaaaattagaaactgaattacatgtctattgataagagactgggtgaaaaagcaggacacatatagtatgtaccatttatgtatttttttaaaagcaatagacatattttttatgaaaacaaacatatatggtattacattttagaaacataaataagaaaagtaaacgtcaatttcagcacggtggccagaagttacctctgagaagggaggggagtaaatatgatttttatttttaataaatagggagaaagacttcagttataaagatctgaaacaacaatattaactcttctaaatctagagagtaggtatgtgttataatggtctctgcatacagaatatgtttgaagtacttcgtgatttaaaaaatttatatgcccagaaaaacaatttaaaaaaattaatgaagccaaaagctagttctttgagaagatggtaaaactggtaagcctttaggcagaatgatcaggaaagaaaagaagacacattttcaaagtaaggcacaaaacaagtaatatcactgctaattctacagatattaagagaaaaataagacaatgtgaacatattttatatcaataaatttgacagcttgcatgaaattgacagatgccttgaaatatataaactaccaaagctcactgaagaagaagtaggcataaacaaattcaatttgtacttaaaaacctttctataaacacgactctaagcccagttggcttctactactattgttcagcattgtactgaaggttctagccagtgcaataaggcaataaaaagaagcaaaagccattcagattgtgagggaaggggcatgaatgtctccatagcaagttcaacaaattctacctaaaaacaactagaataagtgagcttagcaagattgtaggacatgagattaatatagcaaacaattgcagaccgggcacagtggctcacgcctgtaatcccagcactttgggaggccaagataggtggattgcttgaggtcaggagttcaagaccagcctagccaacatggtgaaaccccatctttactaaatatacaaaaataaggcgggcatggtgatgcacacctgtaatcccagctactcaggagtctgaagcaggataatcgcttgaacccaggaggcaaaggttgcagtgagccgagatcgcgccactgcactccagcctgggtgacagaacgagactctgtctcaaaaaaaaaaaaaaaaaaaaattagccaggcgtggtggcgggtgcctgaaatcccagctactggggaggctgaggcaggagaatcgcttgcacctgagaggcagaagttacagtgagtcaggatcatgccattgcactccagcctgggcaacaagagccagtatataaaaatagttgcttgagatatctatctatctatctatctatctatctatctatctatctacacatattgatagatacacacatatagatatatatatacacacacatctatatatatagatatatatacatctgtatatacagagatatatatctcaagcaagtatttttgtgtactggctacaattagaaaataatattaaaattacattatttataatggtatcaaaaatacaaaagaaacacttaggaataactctggcaaaagtatgcaaagaacctgcaccctgaaaagtataaaatattgccaacagacatcagagaactaagtaaatgaagagatacataatgttcatgccttcaacattgcatgtaatatagtatttcagtattttgatatcagttctgctaaagttgatatatagattcagtccaatgtccatcaaattccaatatacttttttgtagaaattaacaagctgatataaataaatactaaggacctagaatagtctaaccttggtaaaggacaaagttagaatcataacttttcctgatttcaaggctttttaaaaaacactgcaataatcaagagaatatagtaatggcataaagatagattagtgtaaccaaatctagacacagacctacatatatttggacaactgattttcaaaatgatatttttttcaacaaatagtgcttaaataattggttattcatatttttaaaaacacatttcagttttgcactgtatgtaattgtctaaaatggatcctagacctaaatttaaggcacaaaacttaaacctattttgactttgggttagacagtatttcttagatatgacaccaaaggcacaatctgttctttaaaatgataaataggacttcatcaaaataaaaaatttttgttctacaaaaggcattcttaggagaatgaaaagaagctacatattacaagaaaatatttgaaaattatatatctgataaagggacttgtattcagaatatataaagaactttcacaactcaagaaaacaaaacattcagtttttaaaaatgtacaaaatatggctctgtaaatggatggatgacccaaaaatagaattttttaaaaagtacaaaatatatgaatgagcacatcaccaaatctataaagaaggcaaagaaacacatgaagtgatgctcaactttagttattaaatgcagatttaaaaccacagtacatgctaatacacacttttaggatgtctgaaagtaaaaggaccaggcataccaactgttaacaaggacgtggaggaactacaattctcatttactgctggttagaatgcaaaatagtacaaccatctggaaaacattttggtattttcttgaaaagttaaatgtatacatatcatgtgatccatgtgatcaagtcattccactcatatatatttacccaagacaaaaggaagtgtatgtccatacaaagacttgtacacaaatgcttgcagcagctttctttgtgatagacagaaactgaaaacaacccaaatgttcatcagtagatgaatggataaacaacttgtagtatatttatgaggaatactactcagtaataaaaaggaatagattattgacacatgccacaacatggctgaatcttaaaaaaaaatattgagtgaaaacagatatatcatacacattttttcataccatttatataaaattttaggaaatgcaagctaatgtataatgatgcagaccagatcagagagagccaggaaggaggattttacagtctcttttataagagccatggagaaacttttaggaatagtggtgaatatgtttattatcttgattatattgatggcttcatgagtgtatatatgtcaaaacttatcaaattacagactttacatgtagtttatttcaggtcaatgttagtctaatgacacatcttttgaaaaaaaatttttttttctgaagtcagattatctgagtccaaatctcagttctttaatttataacctgaaacaaattttaatttatttacatctttgacttcttatttataaaatggggcttataataatagtatcttatcaggctgttgtggagaattgaatgagctaatccaggtaaaaatgtccagcagataaggtattcaataaatgttgggttttattgtcattactgctataagtgtagttgagttaaatcgatcaaagagagagaaatcccttctattccagcctcttctttccaatacttctaatgatgaggatatcactcctttatgagttgacccattccattgttgggtattggaaaagtcagccttactaatttttctagacatatgagaattagtcctactttcagagactttaataggaagaaagggaggaagaagaggtggaacaagtggaggggaaaagtagttggtttaaccactcttcccatctgggaattcttttccccaaaattctcccatgtgctttgtttaagcactttcctctttgaggaaatagaacactctaggcattatgcaaagttggggaaatatgaattaaacaatgtgtgaggttctctaatacttggtactgtagtcattttactggaaaaatgatcgaactttatgaggctccacacacaaactggtggcatacagaactgaggagagagccatattcagtgctaaaggattcccagacttgcttcagacatgtgcacagcctaactccagggatttaaaactcttacaatctagaattcaggccaagaagagtaagtagctatacacttgctcagttctagggaaccagacccatgccactgtgaacctctagctcatagtagtgatggaagaagttcaaaagcttaatgacttctaaaactgagcagatagaatgcctcccagagaggtctcagcaccctcagtctgactgtttttgcctattcatcgacagatttccactaaaactagtctcggataaacctggagcacacaagactcagagatgatagtgatgatggtacataggatgctaaatggatggtgttttgaagtaaaaaagtcaagggggaattggaacttcaatataaatgtattatttcttgctacatttggtagatcttatctctcagtaaagcaacagtatccatagtgttgtataaaatttggatggttgtcttatagttgatgcaagacttcttagctgaattgtaaaaagcagtgcattcaggaggccaaggccataaagtgaatcccagtgacggttaacatcagcatgtagtgtggccatctatttcatcccaaaacgttatcagtcatcccataaatgcatattggcattgatgtagagactcaaagatgaatccgggtgaaggactttagctgaatccatcaatataagcatttcatgtgagtctgaggcattgttatcatttggaataatagcacttaaaatcacaccaaagccatgttttatttttcctaaggatcacaagatggattaataaagcagtcagcttagaaccacactcttagaggttctgcattttaataagaaaataaccaattaattaatattttaaatagttataagtaggagaagtaatgaccagcagaagaatggtgaagttcattgtcatgttctcggataggacttgtaacagcatgttcctcaaatggttcctttgggcatctcctttatctctatttagggctttcctgataacatgacagtaacagcttccttgcatggtccacaaggagaaggcattccctggcatctggttattgaaactgagtcagctcagaactaatctctgaggttaatctggctgggataccctcttatcaccagggttgctttgacccttcagactacctatacaagaaatacttccctctatgggcacgcactttaatcaaagctgtatctccatcaaagaggactgcattttcttttagagtagaactgatcttaggatgtaattttctagtaagatcacactacaatatttatgtcatacagatttgttttatttatgaccctgagaatgaacatccttatgggaattcatttaaaaatgttttaaataatgccttttcttcataaatcagggtctgattagaaccagaccctgatttatgaagaaaagacattattttagttttatttctccctcttctttctctttttgccccttaacagctttgctgtgcattaccaccggatggtagacaaagttagtgaaagtaaaaccaatcatttacttagctactagccatttaaatgcattcttgaagaggaagtattaatagattaaacttacatgaacttaaaatatttttatgtcttctttatgaataactaagaattgaacctatattgttgattctaaagcgaaaaatcagaaaaggattgtgtgaaaagtaaaatgaatgtagcataactgctttatgaagtgtggaaatacaatgcagaaagacaatgtccggctgggcacagtggctcacacctgtaatcccagcacttaaggagaccgaggcgggtagatcaattgagttcaggagttccagaccagcctggccaacatggtaaaaccccgtctctaaaaaaaaaaaaaaaagaaaaaagaaaaagaaagacaatgtccaaggcactttaattcaactaaaaccttgcatcacctgaatgaaaaattgggaacctatttttttccctttaattttgaactcttttagtaaaatgacagaatgtcaatccctttgttatatatagtaaagcaggatactttatattggttcagtgtgtcatgtttgttcatttggacaaatgtaacttacaggtgaaaatgcttatagggacctggtagagttatttgagagagagacacttaagtacagagcagttgtattaacagtttatatttgtttaaaatacagtttatatataaacagaaaagaaaggaatactttggcaatgaaaccgttagagtttttgaaagcaattaaagatataaagataatgagaaggatttttgggatgaggaagaggagtagatagcatttttattaattaattatttaataaaagacacagtctcactatgttgccggggctggtctcaaactcctgagctcaagtggatctacctgccttggcttcccaaagtgctaagattacaggcgtaagccaccacacccagccgtggaagtagcatttttagaatgagactataaaacaatactcattgttggtggagaatttattttgggtgagtagaggatgtccacattcttttcctactaagaaattagatgaggtaagtaattacattaaaagaaatttagaagtaagtaactaaaagttatttttttagtttcttacaatgaaaatgtaatcatagtatcccctgagagtgaagagttgggattagtaatcttttgggtactgctccatacatctctttgttccattttctgtaagtaaatgttatatttgttgttatgtttaagcaccaggaaatcattgactgtagataaagagtcaaatagctgatgtttatcatgaatccattattactgatgttttcaaatttaaatgacagtttctcttttaatatggtatttttttaaattaccttcaaactttatcattatctctgagtgtcagacttacctatgatggggtgtgtgtgtgtgtgtgtgtgtgtgtgtgtatttaaatatatatcatatggctttgtatattctgaatatattctatcaattgagaaatgtattttaagaatgaagaaataaaaccattctggaaattattttaaaataaaatgtaatgataaatgttttagagtagcttgcccatttctttactgtaatactttttaggttaacgagaagctgctcaattattctatttttatacactgtacattttattcctctgaaatgtttggcactccaacaagaagcagctgctaattttaagcaggaaatctaaacagctaatttgagaaaaaaaattttgtattgttatactgtccttaaattgtgcaggacacaaataggcatcctgcacaatttaaggagtatatagcaatttcatagaataagcaggttaacccgttttatggtctgtttagaaaaacagagccgtcaaatcccaaatgcctaatctcaaggagtacaatttttatgttgtgttactgtcatacccagatttaaattctaccatcctcaaaaccaacgatggttaagaatttttctttgtgcacaaactgagtagagattttattctttttgaagtacttggaaaaactaaaggatgtttttaaaaattgtaattttaggccaggcacggtgctcatgcctgttatcctagcactttgggagaccaaggtgggaggaaagtttgagcccagaagttcaagaccagcctgggcaacttagcgagactccatctctaaaacaaacaaacaaaaagataaaaattgtaattttatttacatggttacactatccttttctttgatataaagaaaataaaacaaagtctgtttgttcagcttttttcttaaaacagagtagaaagagtaataactttaaactatttatgatttgggggaatttattaggattctccagagagtcagaaccaattggatgtgcatatacagaaagagatttattataaggaattggcttacatgattatagtggcttggcaagtccaaaatttgcagttgggctggtgggctggagactcaggaaagcagatgatgcagttccagtgtgaaggccagcagcctggagacccaggagagccagttgagcagatgaaatctgatggctgtctcctggagaattcccttttgcttgggacagactagtctttttgttctattaaagccttcaactgatcagatggggcctaccaacattatggagggtaatctgcattattcagagttcactggtttaaatgttaatctcatctaaaaacaccctccaagttgacacataaaattagctatcatagggaatattttaatattgctgaaatataaatctttcttctggtggagtggtggctattcagtactgcccttagatttaagcacggagagccttcctcagatcctgctttttggagggtcatacttggccgttattcagtcacatatctcaccgtagggcaagaagaccaaggggccaaagttatagattcaccaggaggcatgcccccattctagaccacatccccacaaggggccaaagttagactcactaggaggcatgcccccattctagaccacatcctggctacccaggaccctggaatcctctgcccagacaggtttaagcctgtttctggggcctgtgtagaaaccaggctacacatctccccaggtccacgctcctgactctatggactttgtacccaccgttacttctgcaggggccggtgggtggctgtttggaggtaaaaggtgcctagatatgtgggctactaaattattacccatgtgcagatgaggcccttgaaatacagaaaggagcctggaatagggagagaagtggagcaggatgagggcctcttttccttcctctgctgcatccagacacatgtctctaaggtgtctggaatcctaaatgagagtttccaggtcattacaaaggtatttgtatcaagatagtgagatggaacacatttcatatatatattcatcagttgttagcctgagttattgtaacttttaaatatttagatatatatttgtacatttggacctctgcctcagacttaaatgctagaggcaggtatttcctatctattgaaggtcagcaaattcagagaattagaagttaattattaaatttgaaatctgaaaagtgtgttataaaatcagggtagggtagggttattgctaggaaggaaggggtcatagttggggaggggcctggcatgtttcatttctctacttggatggtggtcacatagatgtaaattctaatgattctttaaactaaatctttatggcttcttccttatggaaaatagatcttccaatggagtgctaaaaagtattattcttaattatggggaaaaaaactattgcataaaaatgtttcttcaaacttgtctgttctcagaatcttggcccagccatcagaataaatagaaacaataatttaaagttctagaagacagataaattttttagcaagtgtgtgttttatagcaagcatgaacaaacatatatttaaatatgtgtgtgtgtgtgcttgattttaactttcaagacattagctgcggaagccattgaaagaaaacctctcttctcattcctagctgcaagaccttcagtggattccatgggttaagataaaaaatattttcaagtatttttattttactctaagtctgttgtttgtttatctgaaagaatgaacaatgataatgaaaagcaaaggggaatatttacctttttcaggttagagatccattgtgtgtaaactttcttctataatttcgtgaaaaaacttctggatgcgctttccacatataaatatttattgtaacagagattctttctctgtttttatttccaggtatcatcttcaccaaataaagaaagtaatgaagaaggtatagtatattttgattcattaagagtaacatgtataaatttatttgtttacagtagtggaagccaaaaactaaaactaaaaataaaatagataaattgaaaagctgtataagctaagtgaaatatttttaaaatagtcgctaaaatttcagatgaaatattttctaactcagaaaataaggagaatgcatttaactacttttctaggttagaaaatgatttgattgtacggtgactttttttttcgctgaagtactgagatattccagccagttctgatacatttaattttaaaagatttaattaaaaaaaaactcttacatttagatatttatctttttttaatgaatcacttattttagctgaagatcttaaaatctatagttatagaattaaaaataaatataatatttttattaccattatttgaagctgttttaataaacaagtaaaaatgctctgtagtgaattttcagaatttaagcatgtgcacacatcatttgtctttcaaaatattgcaagattttggctttttgttttaatataaaatattagaagaacattcaacttgcagatttggaagaaatatgagaactatttactgtgagtcaagtatgacatgtttagaaaggagtaaatccatagacatgatttcatgggaaagcaaactgtattccttatatggtaagctaacaaattgtttctttgcgatactatcccatttggggcattttttgtgtagtcaaattttacaatacaagctttatctaaacctttcatattatagcacttctatgttgtctgctagagactaaaatgacccagaaagatacaagaaataaagtaggaaggctctagaatttttaatgtagctttatataaggcttgggccaaatgagagaacttgggacgaaagtttgaagggaaatagctttaaatagagaaatgcaactttagatagcttatgactgtttgtatctgcctaaatacttcctaaaagtcgaaattaaatttgattaatcactcccttctccctcctcttatcccttccctaataccctctttccccattttaaatgcagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaatcacagattcaataaattaataaactttgtgt

SEQ ID NO: 38623 - DNA, 32160 bp, Homo sapiens
gcagctctgtaatgagatcaccatggccagcctcccacccgagcaaaaacaaggttagcctgcagcagagccgcagcagcaacagccaccaaagcgggggctgaaagggaagagaacttagatttgacctgtgcaaggacctcagcagcttggacacagcccactgcagaggtaagtgggaactacgggggaggggtggtgtttgcaaaggtcaggacatgtccaggttcacttaaagtaagggcaaaacaacactcttcccacctctgccaccaccctgtcctctctacttatggcagggttagatttgcctctaaacagggttagatggcagggttagaatttgtcctaggacattgctgtagtgcagtcgcctccttgtctcttactaatgtctgtatcctctgcctgtgtttgtaccatctacctcctcagtagtctaatttttctagcaattgacaggtgattgtaatggacaagtaattgtttgactttaaaaccatttgtaaaggagcaactcctaattcagaactcaaatgagaggcagaacaaactggaagagactgttgggaagcaactgctgcctaattgcttctcatctctactctgccatcaccaggaaggtatggggcaaaatacaacagttttaaagtctctggatagatgtgtgggctatgagctagacaagtaggttgaaactgttttgatgcaacatacttggatttaccaacagtggctccagttgtgaaatcgttagtggcttgatagtacctatggaaacactccacgaaggttattgagtaaagggcatacagtaaagtgtgtaggtggagatgaacaatagaacagtggctttcaggaccttctggggcttaaggcaagcaagacaagatgctgatttgtgggttgcttcagtttcatgtgcaattccaattaaatttctttgagtgggatatacagattcaattcaatttgctaaaacacagatgcactgagcatcagcttctaactttagttacgaaagtaattagcacaagggaatggtgctaaaatgttccatagcaaatgttgaacactttttgagggcaaaaagcaatgcttttgattcgtgtatctcttatttattcggcaaatctttcttgagtatcttctacatgccaggcttgggcttgattctgtggatctcgtggtaaacaagacaggcagattctcggcctcatggacatgcaatcaagcagaacagtaagctcaaagggtgcaagtaccatgcagcaaaaggagtgaagagagtattactaaaactggcccatgggaatcatttttaacctttcctttcatgcatttcatcttctgtttttgttttttttgttttttgagatggaatctcgttctgtcacccaggctggagtacagtggcgcgatttcagctcactgcaacctccacctcctgggttcaagagattctcctgcctcagccccccaagtagctgggattacaggtgcccgccaccacacccagctaattttcgtatttttagtagagatggggtttcaccatgttggccaggctggtctccaactcctgacctcaggtgatctacccacctcggcctcccaaagttatgagattacaggcataagccaacgtgcccagccgcatttcatctttgtttttttttgtttttttgagacagactcttgctctggcgcccaggctggagtgcagtggcatgatcttggctcactgcaacctccgcctcccaggttcaagcgattctcctgtctcagcctccagagcagctgggattacaggcgtgcaccaccacacccggctaatttttatatttttagtagagacggagtttcgccatgttggccaggctggtctcaaactcctgacctcaggtgatctgcccacctcggcctcccaaagtgctgggattacagatgcgagccaccgctcctggccgcatttcatcttcttaaatgaatatcggccactctatcttctatataagcctcagattagtacagatgttgagtcatagcagctcctcaaaaccctcttcaccagaggctttaaactgtgtaattacattacaggtcagtctcctcagccctggaggtcgactgctcagctttttcctagcatacagtctgagagcagaggctgaagtaaggggagttctaatctttgggtcagttgccctctccctgtgtcatttcttatgaaatagaagttatgctattcccaaaatacatacagcactaggcaaagtgttaagaagcctagattttgccagaaaccatgtggagtttggagcaagtcatttctactaactagggcttcctccttagcttataaaatggaaggggtagaccagatgaacatgaggtcttttttctcccccctctaagagtaaattgtctcaacaattttacaagttgtttacaaaacaatacacattcacataaaggtgatgtatttatatctataaaataggaacattcagtaggccgggcatggtggctcacgcctgtaatcccagcacattgggaggccgaggcgggcggatcacaaggtcagaagatcaagaccatcctggctaacatggtgaaaccctgtctctactaaaaatacaaaaaattagccaggcgtggtggcaggcacctgtggtcccagctactcgggaggctgaggcaggagaatggcatgaacccgggagatggagcttgcagtgagccaagatcgcgccactgcactccagcctgggtgacagagcaagactctgtctcaaaaaaaaaaggaacattcatcaatcatgcagaatatccaggaaacaagaatatgaaagaaaatctgggccaggcgcagtggctcatgcctgtaattccagcactttgggaggccaaggtgggtgtatcacctgaggtcaggagttcaagaccagcctggccaacatggtgaaaccccgtctctactaaaaataaaaaaattagccaggcatggtgggggtgggtgcctgtaatcccagctacttaggaggctgaggcaggagaatcgcttgaacccgggaggcagaggctgcagtgagccaaggtcatgccattgcactccagcctgcgcaacatgagcgagactccatctcaaaaaaaaaaaaaaaaagaaagaaagaaagaaaaaagaaaatctgaaagagttgggctgtagacaaataaaattcaagattaaaccgtctgtattccttccagcctcaccttattcccatgtcctttactcagattcttgaagttgtaaacattagctatagcttcactgtgtcatttatctagattggggattctttaataaaaagcctgcatactgagaatcatctgctttcaacaaaaccacataggcagggcagagtggctcatgcctggaatcccagcactttgggagaccaagatcacttaagcccaggagtccaagaccagcttgggcaacatagggagaccccatgtttacaaaaattttttaaaaattcgccggcatggtggcacagacctgtagtcccagttactcaggggactgaggtgggaggatcacctgagcatagaagattgaggctgcagtgagctatgattgagccattgtacttcagtctcggcaacagagcaagatgctatctctaaaaaataaaaataaataaaatccttggttcacactaaaaaaaaaacaaacaaaaaaccagaaccacactaaaaagtatctaatttgctactagggaggctgaggcaggaggatcacctgaccccaggaagtcgaggctgcagtgaatcatgattgggtcattgcactccagcctggacagagtgaaactctgtctcaaaataaataaataaataaaatttggataaactcacaatagaatatcaaattcactttaaggaagtatccattcattgttgtaaaatattagaaccttcggccaggcatggtggctcatgcctgtaatcctaacactttgggaggctgaggtgggaacatcacttgagcccaggagtttgagaccagcctgggcaaaatagtgagaccccatctctaaaaattaaaaaaataaatgtttaaaaaatatttacttttagtacacttcatttctttctgtcctctgaatgcattccattctaaaataagtatgctattatcctcctactttctctggaaaatcaaagttatacgatgttataaaatagggcaaaaagcatgtcttattcatctttctatcccatgtctagcattgtctctggcatctgataaatgtttcttgaaagaatgattagtattttagagaaaacgtgtcctttggtattaacacacacacacacacacacacacacacactatctagttcactattcatggctaatataggccaatctcatgcttttgtgtccctttcaatccctgacactcaccctgtgctcttcaacatcaatgtattctatacttttgtagtctcagttggtataatgagcactgaattcaagttctgccactaatatgtgtccaggctgggcgtggtggctcacgcttgtaatcccagcactttgggaggccgaggcaggcagatgatgaggtcaggagatcgagaccatcctggccaacatggtgaaaccccgtctctactaaaaaaaaatatatatatatatatacaaaaattagctgggtgtggtgacgcatgcctgtaatcccagctactcaggaggctgaagcaggagaatcgcttgaacccgggaggcagaggttgcagtgagccgagatcacgccactgcactccagcctggcaacagagtaagattccatctaaaaaaaaaaaaaaaataggtgtccaacttgaagccaaatactaaatacctctgcacctctgtttcttcagttggaaaatgggggcatctgaatagatgagctctaatacaacttccagtttgtttttttttgtttgcttgttttttgttttgttttttgagagtcttcctctgtggcccaggctgcagcatgagccaccacacctggctaattttttttatattaatactttgtggatatagggcctgtgtttcccaggctgactcaagcaatcctcccgcttcagcctctcaaagtgctgggatgataggcatgagacaccatgcccagtccaacttccagttcttaagacggcacactccaaaaggaagaaaaaaagaattagtcaagtcacagaaagtaatgactatggtacttcagtgtattagtaaatgttgttgctagttttatttgccaaaatttctaacttgaacactatcattagcaaacaatgttaaggagcttctttgggtgaagacccactgcctaccatgtttgaggtctcccctagaacctttctgactgaccatgttcatgtaaaactgaaaacatgtctgcaggcgggcagagaggcacagaaagcaagctgctttggcataacatattcagcagaacaatacaattggaggactcagtacctagataagtatctctggaaattgcatatggccatattggcgtaactaaagaataaatgacatgtcaggaaatgctttgtttgttctaatgaaatgagatgtcaacagataaatgctgctgctcttacagccgagaagccttctcaccaccagaaagtaagcaatcattttccctttggccagaaggtgtacgtagagcagaggagtccagtgtcaaacatacttatcagcccctaatcactcagtctcagcaatacgcagtttccataacatggacacagtgggcatgatcagcactctgccctgtagagtgaaccagagctgtcttcttccagagccaagatcttattgtactgacagtcatcctagttcctcttggtttttgtttttaatttcaatatctgattctgtttatttatactttatacccagcctatatgtcaaaagggtttgaggtagtttccaataaaaggatatatagaacagcttcaaataaataaaaactgataagaaaccatcagacaataacctaaatcattttggtggggaaggtgtgatttgtagagaaaataaacaggtgctttaaaaagagggaaaaatggattgtccaattttctttgcacaccataagaaagcataccacttcttccagagaggcaaaacttctgtgcacttatttctgttttggtctttatctgactcagtctctatatgtacttgtttctttttctttttttttttttttggaggcagggtcttgctctgtcatccaggcaggagtgcagtggtgcaatcacagctcattgcaacctccacctccccagctcaagtgatcgtcccacctaatctttttaattttttgtagggacagggtctcactatgttttccaggctggtcttttttttttttgagacagagtctcactctgttgcctaggctggagtgcagtggcgcaatctcgactcactacagactccacctcctgggttcaagcaattttcctgtctcagcctcctggtagctgggattacaggcacccgccaccatgcccagctaatttttgtatttttagtagaggtagggttttgccatgttggccaggctggtcttgaactcctgacctcaaacgatccacccacctcagcctcccaaagtgctgggattacaggcatgagccactgcacccgacccaagactggtcttgaactcctgggcttaagcaatcctcctgcctcagcctcccaaagtgctgggattataggcatgagccactgtgcctggccaaacttatttctttattggaatcatcatctatatcctcataaaaagtatactgcttcttcttaactaaataatggagtaaggaatgtcttcaatggctattttggtattcatgtggcagactgttaaatatttttttctcttctatctatcttgtttaactatggtctgactaaaaacagcattctttggataagctaaaatgcagtctgggaagaaagttcagttttgaagttggagaccatgtatccaagagcatgaagaaagcctggacattgtcttcctatagagatttcttggtgtaccagatctcctacctgtctagtagtttcttagctctggcatagacctctagcccagtactttgatataaatttcagaatgatgaatatgtatccagactgagagtttctcatttttgcatcttcagcactttctacagctccttgcacatagtaagttcgtaaatgtttttggaaggaatggatgagctcctaaagatcaaaggccatgtctcgtttgctttgcaagctcttagcaaagataatggagttgataagacagggaaaaggctaggagacttggacttgtgagtgaagttccctgtggcatggcatagcaaaaagagctctgtaagcttgaaaagcaaacaaacaaaccccaaatcctctctactcccttcccaaacaggatggttatctcaacagggtcaacagaaccttttatccttcctaacaaacactgaagagggaaatccacactaacgtgaaggctctgcctgttttcaaatggtttgcagacatttagatctcccaagtatttcccaagttgaggtgtttcttttgacagttggttccttgtcattaaatatttgagctgggcctggtggttcatgcctgtaatcccagtgcttgggaggctgaggcaggaggatctcttaataagacccaggagttagagaccagcctcagcaatatagcaagaccctatatctctatttttttttaaaaaaaaagggccgggtgcagtggctcacacctgtaattgcagcactttgggaagccgaggcaggcagatcacgaggtcaggagattgagactatcctggccaaaatggtgaaaccccatctctacttaaaaaaaaaaaaatacaaaaattagctgggcatggtggtgcgtgcctgtaatcccagctactcgggaggctgaggcaggagaattgcctgaacctgggaggcagaggttgcagtgagccgagattgcaccattgcactccagcctgggtgacagagtgagactctgtctcaaaaaaaaaaaaaaaaaaaaaaaaaaaacacacaaagggctgagcgcagtggctcacgcctgtaatcccagcactttgggaggtcgaggcgggtggatcacaaggccaggagttagagaccagcctggccaatatggtgaaaccccatctctactaaaaaaaaaaatacaaaaaaattagccgggcatggtggtgcatgcctgtaatctcagctactagggaggctgaggcaggagaattgcttgaacccaggaggtggaggttgccgtgagctgagattgtgccactacgctccagcctaggtgacagagtgagactccatctcaaaaaacaaaacaaaacaaaacaaaaaacacacaaacaaacaacaagggtgggggaaatgaaacatttgataggtttagccctaaaagtacctaacaccactacctcccttgtgcttaatgatccatgctttttgggactccagacagcaaacaaagtgccaggctgaaaatgacacaagccaggcacggtggctcatgcctgtaatcccagcactttggaaggccgaggcaggtggatcatctgacatcaggagttcgagactggtctggccaacatggcaaaaccccgactctactaaaaatacaaaaaaattagctgtgcatggtggcagacccctgtaatcccagctacttgggagaccgaggcaggataatcgcttgaaccagggaggcggaggttgcagtgagctgagatcgtgccactgcactccagcctgggcgacagagtgagactgcctcaaaaaaaaaaaaaaaagaatatgactttgcctcatcccagaatcctagcactgtgtgaagggcagcttctctgaagggacccttatccaccttggagatgtgagccaaactcagaatcaagccacaggaactgcttaggacaatgagggtggagaaaatcattatttaaagaataattctttggaatcttcataagcccaatttattaaataatgtctgttgtcctagttgtggggcaggggtgtttacaattggtttaggctgagacttaccatcctgaaatgcttgctcagctgtccttctggaagctcaggtgctgcagaatatgactacagagcaccctctaacccccaagtccacagaggaatcccagccacccactcagtatcagaacctggagtgaaggaatgcctgcagctgcactctactaacttctctttttctggttttcctagaacttgcattgaggcacaaactgcacacttacaagcctcagtagcttcccttgctgtcagtcaagcaatgtttgggaagggagcaggggaagggagcatgggtaaagcaggcctaggagtgtggacagggccctgttctagagtgtctgaaacccattcccgtctctgggtaggggttaggcctacgccacaccaaacatcctggtgcctgctctcaagtcagacagtgtctccctggcaggatatcagatgcctcggtatttctccctgagaggctcttcctctgagctaactgtacccctcctgctgtaatgggactcacagtggtaatgataagcagcttgcttatcacctccttctggtgtcctaactcctcaaacactgaaagacactttataggtcaccattctctcttcctttcttcagcctaagtaatctgtaaaaaatgtgggctgggcacagtggctcatgcctataatcctggcactttgggaggccgaggcgggaggatcgcttgagctcacaagtttgagatcagcctgggcaatgtagtaagacactgtctctacaaaaaatacaaaaattagctgggtatggtggtatgtgcctgtagtctgtattcccagctactcagaaaactgaagtgggagaattgcatgagtctaggaggcttgagcctgggaggcagaggttgcagtgagccatgatcatgctgctacactccagcctgggcaacagagcaagaccctgtctcaaaaaaaaaagaaatgtgaatgaggctgggcatggtggtgtacacctgtagtcccagctactcagaaggctgaggcaggaggatcccttgagcccaggagtttgagtccagcttggacaccatggtgagaccccatctcctaaaaaaaatcaatttaaaaaaaagggttcatgggtgtaatttcaacactttggaaggctgaggcaagaggattgcttgaagccaggcaagaggattgcttgaagccaggagttcaagacccccgtctcctcgttattaaaataaaaataataataaaaaaaatgggtcaaaggggagcagttatttcctaaagtcatagctggtaaacatgcatttagaataataaaactaagtacaatcatatacaaaagaataaaacatccatagagatggaaataagtggcacgaagtccagtctggaacctgggtcctaagcctggctctgctacttatcatctatagactctgggaggtcacctgcctcttcttgtctaggttctttcatccttgtaacatggtgggaccagatgatctgtagtgctcctctccagccaggttatgacactatctaatagggatggccagtgggataacatgtgctagcttctctggactggtgtgcctgccttgagtgctgtggttgggtctgtgagtttagttagtctcaggtgaaagatgttgggaatgacaggtgctgtctaccagggatgacagagtgatggaggagaatttgtcatctaagtttcaattactattatttaaatttaaaatttttgaacaactagtacattcatatggtccaaaatttcaaccatataaaaacataaaatatttattgccagtattgttctattgttcttttttttttctttctttttttgagacaaggtcacactctgtcgtccaggctggatcagtggcatgatcatggctcattgcagcctccatctcccaaactcaagttatcttcccagttcagcctctcaggtagctgggaccacaggcatgtgctaccacacctggctaatttttttttttattttttgtagagacagggtgtctctatgtttgcccaggctggtctcaaactccaggactcaaatgatcctcctgccttggcctccccaagtgttgggactacaggtgtgggcaactgcacccagcctcagacgtatttcttttctttttttttttttttttgagatggagtcttgctctgttgcccaggctggagtgcaatggtgcgatcttggctcagtgcaacctccgcctcccgggttcaagcaattctcctgccgcagcctcctgagtagctgggacaacaggcatgcaccaccatgcctggctaatttttgtgttttcagtagagatgtggttttgcggtgttggccaggctggtcttgaactcctgaccttaggtgatccacccaccttggcctccgaaagtgcagggattacagatgtgagctgcccgcacccggccctcagacatatttctaatgattgtccttctagccaattcttgttaggctgcatttttaaaggaggttaatgcctgatattcatatcctttttcttttccatagaactgttgattggtttcagaaaaatcttggtccatgtttttaaaccaaccaacaagtaatactaaagaacaaaccagcactttgggaggccgaggctggcggatcacaaggccaggagatcgagaccatcctggctaacacggtgaaaccctgtctctactaaaaatacaaaaaattagccgggcgtggtggtggaagcctgtagtcccagctactcaggaggctgagcaggagaatggcgtgaacctgggaggcagagcttgcagtgagccaagattgtgccactgcactccagcctgggcgacagagcgagactctgtctcaaaaaaaaaagaacaaaccaaaccaacttgctagaactactctttgagttctgggtaagttcatttttttctcttacagcaacagctctctaataaaagggagaaatgaagacaggagtttgagaccagcctgggcaacgtagtgggaccctgtctcttaaaaaagcattatcatacattttttgtagttggtagacctagtagccccctcccttccaccactctttttcttttctggcatttttctagctattcttgtacatttatctctccattaagttttcaaatcaatttgtctggtttcaggaagaacaacaagccaatttttttttttttcaaaaatcactgctagccatacactttgactttctccactccctacttccttagatgtttatgaaaataactccccggctcgcctgtgctttctcattccagatgaaaggagaagctggacatatgctacacaatgaaaagtcaaagcaggtaaatgccagcaccttgcccccaaactggtgagaatgtagtcagtggctctttgccatagctgcacttgctatgcatccaacatctcccccaaggtttaggggtggctgacacatggtaatgtcttcattttcagtaactgagcagagttcacttgactgccaactgccttttacccacaacccctttgcctgaatgcagactgcgaatgtgcgttatggaattgaaaagcattgtaactgtcctcccttctcctcttggctctcctgcctgtagcccttggcatgtcctatgcctcgggcctttggaaaacccctttctataactttcctggggacaacagaggctttctggaggtagctgagaactggcccttgaccccagctaactcctgcactgcgttttcctgcacttcacagaggacctttgtcctgtttatatttccttcacctgggctgctagagagatgaaaaaacccaacatccccgaacaaatatctaatcctgtatgtgaaactgaggttttaatttgacttaatttggtttgatcaaactcagaagattaaaacttccaatgagtctagaaaagttcctgaaaagagcccttaaattccaaacaaaggaataactggaaaagcccaaggtcaccagtctagcaaacacagggcgacctttgaatggcccatgtaaaagaacaagttctggtgggttacagtggctcacacctgtaatcccagcactttgggagactaaggctggaagatcacatgaggccaagagttttggaccaacctgggtgacagagaataacattggctcaaaaacaaacaaacaaacaaacaaacaaaaaaacaaaaaaaagagcaagttcctccaattggtctggccaatccagcctgagagagagagagagagtgtgtgcacgtgagagaatgcgagtcagtgagtgagcatgctcatttccaaagctcaggactagcccttcaaaaaaacatccctgcccatgaaaaatgacttctgcttggtcttttgatcagaagtgggataggataatgctgagaagaaacagttcagtgcagattcagattgcttagaaggggtgaattaaaacaatgtttcctcagatcttgaaagtctggattaaaatgtagtgtcctggccaggtgtagtggcacatgcttgtaatcccagcattttgggatgctgagacaggcagatcacctgaggtcaggagttcaagaccagccttgccaacatggcgaaaccccatctctactaaaaatccaaaatttagccgggcttggtggcaggcacctgcaatcccagctactccggaggctaaggcaggagaattgcttgaacttgggaggcaagaatcgcttgaacttggaaggtggagattgcagtgagccgagactgcaccactgcactccagcctgggcaacacagtaagactgtctcaattaaaaaaaaaagtaaaaaagtagtgtcctattagatcagctcctccaacatcccctctgacaccctgtacatggccccattagctaattgcagatgagccccaggcacacacagggtagggaccaccacctccagttctttcctatgaaagaatatgagcagaccccgtctgagtttagaaacgggatatgagtgggtcatctgtaattcctgtctgtcgtacaacggaaattggtgatacacctggcagctggtgttttccctctctgaatctggggcattgtttggtcatcgagctcacaatgacttctggtttagaggagaaccttttggaggagaatatacaaggacctctcagtgatttccagtggtctctccttgaccctcagaatggctagtcgtcttgtccagctgggagcctgggctaatcttgctggaaggcagagaggggttattaaaagtcagaaagtggccgggcacagtggcttgtgcctgtaatcccagcactttgggaggatggggcaggtgaattgcttgaggtttagagttctaggccagcctggccaacatggcaaaaccccagctaacttcgctactaaaaatacaaacattaggtgggcatggtggcaggtgcctgtaatcccagctactcaggaagctggggcaggagaatcacttgaaccctggaggcggaggttgcagtgagccaagatggtgcttcactccagcctgggtgacagagcaacactgcctcaaaaaaaaaaaaaaaaaaaaaaaaaaaaaagtcggccgggcgcggtggctcactcctgtaatcccagcacttagggaggctgaggcgggcagatcacaaggtcaggagatggagaccatcctggctaacacagtgaaaccccgtctctattaaaaatacaaaaaaattagccgggtgtggtggcgggctcctgtagtcccagctactccagagtctgaggcaggagaatggcatgaacccgggaggcggagctggcagtgagccaagatcgtgccactgcactccagcctgggcgacagagcgagactctgtctcaaaaaacaaaaaaacaaaaaaagtcagaaaacgtgtacaattcactctttccttctaaaataagaggagggtagggatggaagaaatgggcctggcctatgcacacagtgaagcctgtatgactgggaaaggatttcctcatcatggttttggcagatgctgctatgatgactatctcaaccttgcctgcccattggaattaactggggagcccaggtcccacccccagggactctttatgtaattggattggaggggaccctgggtattgggactttttttaagctcccaggtgatttcaatgtgtagataatgggtatctccatttgccaagaggactggtgatgaaatcctatggctgatagaggctcgcctgtcctctgactgacagaattgcctgctagtttctctggagtcaggctaattcccttccctcccccaacttgagctctaattttcataaacacacccatgtacagcctgagagctcctgataaggaagaggctcccacagaagctggaaaaggccagctggaaaacgcagatgtgccttcctggttggttgagatgctgatcctacagcactcccgctgtgcctcagcagtgagctgggtgtaaaggcaggaggcttgctggggtctgacacttccctgccctcctccaggagggacacatctggggctctatgaggaggacagctttcatcctgggctctggacttctctcatttgtggccttctggaactcagtgacatggtaagtcggctccacccagctagggtgcagtgtggtggtggtcgggggcagagcataggggaaggagctgtccacccactagtcttcacccagaaacctggttttttttccaaggcatcttcagagattttggggtgcttctggctacttttggcaagcccagtgggagaggctgctgactacatttgaagggaaggagtggatcctcttctttataggtgaggttcccagaccaccagcacctagcatgtgggtgcatgattataacttaattctttttgttgttttgttctctactttgggacttttcagtttattattccaagggatgaggacttgaacttcaaaaaagtggtagtcccaaagaatactaaacttgtgggcagtctgaaaacaggatgtctaaaaaaagaagctgagaagttaagactcctcccaaaatatagaaaaataagaaatattttatgtaaaaatgaatgcacatttagagcaataatcctgtttctacacttaattccacaagcacagagagctgccctgtcttgtctgagactatgtaccctgtacctggtacagtcagtgcttgacagcaagtggccagtcaataaatatttactgacagcttcaatggctccaaacaagcctaagtaaatagatggaaggaaaagccatgtaaacatagatatttataacagcattatctataatagtgaatgtcctcgatcatacattcactcaaataataattatatacaatttatttaatatatattatatataatatacatttatttatattattaatatgacatataatatataatgttactatgtgctacacttgtatcgaggatatagaaatatttaagatgggaggccaggcgtggtggctgacgcctgtaatcctagcaccttgggaggctgaggcaggtggatcacgaggtcaggagtttgagaccaacctggccaacatagtgaagcctcgtttctactaaaaatacaaaaaaattagctgggcatggtggcaggctcctgtaatcccagctacttgggaggctgaggcagggagaatcacttgaacctgggaggcgggttgcagtgagccaagatcatgacactgcactccagctgggcgacagtgtgaaacttcgtctcaaaaaaaaaagaaagaaagaaatatttaagatggggctgggcacagtggctcacgcctgtaatcccaacactttgggaggccaaggcaggtggatcacttgaagtcaggggttcgagaccagcctggccaatatggcaaaatccctttttcactaaaaacacacacacacacaaattagctgggtgtggtggtgcgtgcctgtaatctcaactactcaggaggctgaggcatgagaattgcttgaacctgggaggcagaggttgcagtgagccgagatggtgccactgcactccagcctgggcaatagggcacgactctgtctcaaaaaaaaaaaaacaaaaattaagataggccaagattagtggctcacacctgtaatcccagcactttgggaggctgaggcaggcagatcacttgaggccaggaattcaagaccagcctggccaacatagtgaaacctgtctctactaaaagtacaaaaaatgagccaggcgtggtggtgcgtgcctgtaatcccagctactcaggaggctgaggcacaagcatcgcttgaactcaggaggtggaggttgcagtgagctgagatagcaccactgcactccagcctgggtgacagagcaagaccctgtctcaaaaaaaaaaaaagaagtatttaaatgaaatgtttccctcccccattaaaaaatgatgtcatagtctagaagggaagataaaaagtgtcagttgctataaagcaaaatgcacctgaggattgttttcaactagaaggaggactctgacaatgggctgaacattaaatatgacagatttaatgggatcttaagcagtcattgaacaatgcagattacctatgtatatggagaaggtggtagaaaaactttattagcttgaacctgcaatctaaaaaaacctcaaatattttatatatgttaggtacaatcctgtgaaaattacctattaccttggtgataagccaatatgagagagagaaaatatttccaattttaagtgttagagctagaagaagtttaagatcgtcttacggtgtgcttttcatctgtattcctcaggcagcctttgaagttccaagtaggtagacaccttggatggcccactgggtaaccatcagccttttttttccaaagtaaaaaatagtttattttttctgggtataaaagtaaatatgggccaggcgcagtggctcacgcctgtaatcccagcactttgggaggccgaggcaggcggatcatgaggtcaggagatcgagaccatggtgaaaccccgtctctactaaaaatacaaaaaattagtcgggcgcggtggcgggcgccagtagtcccagctactcaggaggctgaggcaggagaatggcgtgaacccgggaggcagatcttgcagcgagctgagctcacgccactgcactccagcctgggtgacagagcaagactctgtctcaaaaaaaaaaaaaaacaaaagtaaatatgtgctcattgttaaaaataaaaatcaggcaattcaaataagcatagaaagtgtgaaaatcacccactgtcttaccttcaagaaataaccactgtttatatattagtgtgcatcttttatatattgggtatatagttgtacttatgagataccaactatttttaaatctttttttcattgaatagattgtaggtatctttccatgcctattaatgtagccttacttaatactctaagcttcccattctattccattatatggaaatactctaatctgtttagtcccttccctactaatgggtatttaggctgcttaaattttttttttaatgctgtgacggacatttatgcatacaaacagacgtgtgtccttttcttctttctccctttctgtcttggctctctgactctctcactttattacttcagttactgccaaattgccctctagaaggtttgtaccaatcctactcccctacagtgctggcaagtattttccaagtcccagccgccacagttacttcggttgatggagcatgaagggtgctggtggaggggcacagacatggaattaagcaaagccgagtcctagctgggcatggtggcaggtgccggtagccccaactattcaggaggctgaagcaagaggatcacttcggcttggcaggtcgaggctacagtgagccatgatcacacaactgcacttccagcctggatgacagagagaggctttgtctcaaaaaaacaaacaaacaaacaacaaaaaaaaaacaacgatgagttttccacttatactgactagatgacacctgaagttctgctgctcagttagtaggatgacagggattaagtttcctgactgactcctagcccagggctcactgtgacccataccatacagagtacttcctttgcttctccttccttggcaattcataaagggttcagtgggcgcagactcccaaatgtcaacctgaattcatttctattttagagggtattatatatcttaacatactttcatatgtatttatatgaaaaccaccaaccaccttgaaggttgtccctattttatggctaagaaaatggagacactccttaaatggcctgtccaagttcctacccaagactacaggtaaccccttggtcccaagccctaagacctccctggcaaagaaatgtctaggatgaagcctcagtcaccacaaaaaagtatgttctgttagtctatgtgctgtgagaacccaaagtcgccctgactgtttctgtttcccaatctcaggtgccatccaagtgccttgtctcttcttctggagcttcaatgggcttctattggtggttgacacaacaggaaaacctaacttcatctctcgctaccgaattcaggtcggcaagaatgaacctgtaagtgttgttgcaacttctggtcaaagcacagaaagcaagagccaaagccacactctcagaattctcaccactggcccaggagagacctggccagtgtgagccaagttattagcaacaaggctcccccagtttagaaggttaaagagaggaaataatttgcccacaacctcagagtcactcagctagtggccagtcaagaccagtgttctggtctcttgattcctggcccaggctctggacctgcctgtggtgccccatggcactgtggtcagcctggcactgagaaggcaggcaactccactttacccataggaatggagacagcaatgggtggatgctagaatatgggtaacagctgttgttatgagagagggagacagctgcgaaaacaatggataactccactgtaatagacggatagtatggattctgaatgtgtgggcggtggctgtcttttaaacaagttctccttccgaaatactcaattcgaccaatagtgaaaggcaccagggcaaatccatgataagtgaggcccagaccctgcttacaaggaactctgacttgcacagcgccgggaagtgggtcccactgttccctgagtctggctcgccttttcctacacaacaaggaagaagttgattctgaaacccaggttctttacccagctccacccaaaccacatcctggcttctttcccagacaagacaatcatcttttagtcatctgcccaggtgtctgggtgaaccacctcagctctcaggtccttttgccccagcccagcactccagaaaggcaaacagtgctcttgacccactcctttgaagtgggccccttcctgaactggactgctggcctggcttactgtccccctcacttgggacaacagctgccagccaggcttgggggcttcctccaggcccagcttggcaggacatgaatcagagcctaaagtgtcaaaccctgtgcttggtccttgagaacacttcatctgtcaaccacggctgttgtagcaccactgactaaatgctcacatcttcaactgaggccaagaaccttcactgttcagatgaggaaacagaggtgttacacgggtaaactatgattcaaatgcaggctttgtgacttcagggctcacattcttaattggctctccagaatattacctgccgtctgtacaaccttgtggtctacacaatgactacagagctacattggaagatgtcattgcattctgcagaagctgaggttcagaaatgtccagtgactagctcaagatcagattgctgctaggaaacagagccagggctcatcccatctgacaccaagtccagtgttcctgtaccacatgcaccctcaagtgggcacacaagcaggaaagaacctcacgaggccatttaatctttggctgtttcaaggaaggactggcccctgaactaacacatcagaaacagatcctcaagtggggagctgaatgctacctggtgttcctatgatccattcctgctctgtttactctcccactgcctgaatggctagttcacacctcctcccctaactgctggcagagggaggggccttgcttcccatttcactaagaaaatttaagcctgggcgtggtggttcatgcctgtaatcccagcactttgggaggccgagatgggcaaatcacttgagctccggagttcaagaccagcctgggcaacatggcaaaaccctgcctctactaaaaatacaaaaattagctgggcatggtggcgcatgcctggaggagaattgcttgaacctgggaggcagaggttacagtgagccgagattgcaccactgcactccagcctgggcgacagagcaagactctgcctcaaaaaaaaaaaaaaagaaaaaaagaaaatttacgcaggctggggcacagtggctcaggcttgtaatctcagcactttgggaggcagagacaggaggatcgcttgatgctaggagttcaagaccagcctgggcaacatagtgagatccctgtctctacaaaaaaaattattttaattagccgggcacagtggcgtgtgtctgtagtctcagctagtcaggaggtcaaggcaggaggatcacttgaacctaggagttcaaggctgaagcgagccatggttgtgctattgcactccagcctgggagacagagtgagacactgtctctagggggaaaaaaaaaacaaaaaactaaagcaagcagaagagttttatagatgcacaccacattgggcagtgaccagtacctgcacccacatgctctgcctgcccacctgacaccacaggtgaactctccttgctcctgtctgtgggtgattcctcccctatccatgtactacatccaggaaatggctgctgcaattctctctttgctttcttgtatcttcttttccttctctttctctcattattcctctctagattattacaaacgtggtaaattttttccatctaaaaaacaaaacaaaacaaaacaaaacaaaaaaaaccccaccaagtgtggttgctcactactgtaatcccaaactttgggaggctgagccagaagaatcgcttgagcccaggagtttgagatcagcctgggtgacagagtgagatcctgactcaaaaagaaaaataaataaataaaacaggccaggtgtggtggctcacgcctgtaatcccagactttggcagtctgaggcaggaggatcacttgagcccaggagttcgagaccagcccaagcgacagaacgagatcccatctctacaaaaaattttttaactaggcaagtgaggtggcgtttgcctgtagtcccagctacttgggaagctgagacgggaggattgcttgagcccaggaggtcgaggttacagtgagctatgatcataccactacactctagcctgagtgacagagtgagacactgactcaaaaagaaggaaaaaaaacaggccaggtggagtagttcacacctgtaatcctaccactttgtaaggccaaggcaggaggaatgcctaagctcaggagtttgagaccagtctgggcaacatgacaaaacaccccacccaacactgtctctacaaaaaatacaaaaattagctgggtgtgatggtgcatgcctgtagtcctagctacttgggaggctgaggtgggaggactgcttgagcccaggaggttgaggctgcagtaagctacggttaggtgtaatggcctcacctaacatgtcctctcacaacaggctggcgaaacctggcctcgcgatgggatggaagtaaacaaagagtgcactccagcctgggtgacagagtgagatcctctctcacaaaaaaacagacatacacacacacacacacacacacacacacacacacacacaaaataacagaaaaaacaactcttaactagcaaagttctttgagagagttatctttatagtttccaattcctgtctgtccactcttatttgggttttgttggtttttttttttttttgagacagtctccctctgtcacccaggctggagtgcagtggcactgcgatcttggctcaccgtaacctccacttcctgggttcaagcaattctcctgcctcagccttccaagtagctgggattacaggcgtgtgccatcacgcctgggtaatttttgtattttcagtagagatggggtttcaccatgttggccaggctggtctcgaactcctggcctcaggtgatccactagcctcggactccccaagtgctgggataaaaggcgtgagacaccacgcccggccatctgtctactcttttccccaacatcctgtaattatgaaaaatgttaaaaatacatacagaaggttgaaaaataatgtaagaattatgcatttacatatcacttagattcaccaattttaaatatttttgctttatatataaaaatataaatatatatgcatctatacatttttcctatttgaaagtgagtttgaaacatcataaaacttgacccctaaatcctttagcctgcatctctcctaaagtaatcacaaaagcattgtctcattttctctataaacctcctccaaattaggtgtcacacctagaaaaaggctctaccaacatttcttttggtaagttcaccaatgatatggtttcattagagcaccagagacatttccacagctgctgactccctcagccttgaaatatttttttcacttggcttccaggacaccctgctctctaggtagcccctcaatattttcttttctttttttttttttttttttagagacagtcttgctctgttgctcaggctggagtacaatggcgcaatcttggctcactgcaacctctgtctcccgggttcaagcgattctcctgcctcagcctccccagtagttgggattacaggcacctgccaccatgcccagctaattttttgtatttttagtagagacggggtttcaccaagatgcccaggctggtcttgaactcctgacctcaggtgatccatccacctcggcctcacaaactgctgggattacaggcatgagccaccgcgcccggctccccatcacatctgattgttcactttttcactgtccctttcctgattccttctcttctccccaacctcttcatgctgaatgtcccatgggctctggccttggtcctcttctctatattcattcccccagttatctcttcagtgccatgactttaaataccatccataggccgacagctcacacatttatctctctagcccagaactctctactgaattccaagctgaaatatccaactccctccttgacatctccacgtggatactaatagaaattgccaattcatgatgtccaaaagagcatttctgatcgtcctgccaaagcctttacttactacccacaacctccccaatctgagtggatggcaattccaatcttccagtttctcaggccaaaaaccttggagtcattcttgactactctctttccttcatactccacatccaatctatccaggaaccctattaactctatttctgaaataaattcagaatccagtcacttcttaccacttctcaccacttccatcactattaccctggtctaattcaccatcttctcttgtctatattactgcttttttttttttttttttgagacggagtctcactctgtcacccaggctggagtgcaatggagcaatctcggctcactgcaacctcccgggttcaagtgattctcctgcctcagcctcctgagtagctgggattacaggcgcacactaccatgcctggctaatttttgtatttttagtagagacagggtttcaccgtattggtcaggctggtctcaaactcctgacctcgtgatctgcctgccttggcctcccaaagtgctgggattacaggcatgagccacagcaccggcctgcctttttttttgatggagtcttgctctgtcaccgaggctagagtgcagtggcatgatctcggtggctcactacaacctccgcctcccggattcaagtgattctcctgcctcagcctcccgagtagctgggactacaagtgcatgccaccacgcctagctaagtttttgtatttttcgtagagacgaggtttcaccatgttagccaggatggtctcaatctcctgacctcataacctgcccaccttggcttcccaaagtgctgggattacaggcgtaagccacagcgactggccctttttttttttttttttttttttaacaagattgggtctcactctctcacgcaggctggtgtgccttaaactcctggactcacatgatccttccaccccaggcttctgaatagctgggactacaggtgcacaccaccacatccagctttttaaaaaaaattagatggggtttcgtgatgttgccaaggctgctctcaaattcctggcctcaagtgatcctcccacctccacctcccaaagtgctgggattacaggtgtgagccaccgtgcccagcctgatatatatgtttttatatttgttgtgtctagtctacctttctcactggaacataaattccatgggggcaggaatctttgttttgctcatgctttattttcaacacccagtacactgagtgctacatagtgggtactcaataaatatcagttaaataaataaatgaatagatagatgtgataccccgcctcttggtcaaggtttccagaaggtgtaatggcctcacctaacatgtcctctcacaacaggctggcgagacctggcctcgcaatgggatggaagtaaacaaagagtgaattctgaaatcagttaatgcatgcagtgcctggaaaggctggaggaagaggcaggcctcaagctggggaccattctgaacctgtcgcgctttggggcagaaatccctccagctcacagagggaacttggagaaatcccttctaaccaaacaagttcatcaggatccaggaagtaatctatggtcacaggactgttgcctggagccccagtgctctgacaaagggaagggtcaaagggttgctgattctgggggaaatattggctgcagtattgaggccaaatggactttggacacttgggaccagctctgtacagtggaccctggtggaaatgcttgggcaggcccccatcttcacagcatcactgtgaaaaccagcaagttggtcaagaagctggataagcagttccttggcttacctgcttctttgctctgggcctactgcagggaggctggaccacttgaggaggcagatgatcttgatctctgcatccaatcatgaacaaggttctctgatgaagaggggctaaatggctgaaatggggtatcactcagaaagtcacagccttctccaagcaccatggaggctacccaagttacctgtaaatacatggggcctggccagagaaatggggagggcagtggtgataatgtgcagaaccaggaagaaggcaggttccgacacagactgaaggctgctgaagtttccaaggacaggggtattactcacctgcctagcagccagggccttattctgcaacgtttccaggcccagagctgggtggcagtcaggagctactggctgtcccccgacatctctcccagaatccaaccagagtgagggcctcctgtaagcaggtcacggtggagcctacttctcacactcttatccatctccctcctcccttcccttgggcaggtggatcctgtgaaactgcgccagtctatccgcacagttcttttcaaccagtgcatgatatctttccccatggtggtcttcctctatcccttcctcaaatggtggagagacccctgccgccgtgagctacccaccttccactggttcctcctggagctggccatcttcacgctgatcgaggaagtcttgttctactattcacaccggtgagcaggccctgcctgaggcacagctggctcctcatcctgtctagggctcactgatcaacaaggaaactgaggccaggtgcagtgactcacgcttgtaatcctggcaatttgggaggctgaggtgggcggatcacttgagcccaggagtttgagactagcctggggaatgtcaggagaccccgtctctacaaaaaaatttaaaaaattagccaggcatggtggtgtgtacttgtagtcccagctacttgggagattgaggtgggaggatcacatgagcccgggaggtcaaggctatagtgagctgtgatcacaccactgcactccagcctgggcgaaagagcaagaccttgtctcaaagaaaaaaaataaaagggaacaggcttctgaattgagtgtaggccagtaaaatactccctggcctcaagtgtcccattaaatagttaacagggagaccactagttgtctcataactgacaacttgggacaactgaggaatgaatgtccaaaagagaaaaggcctctctgattgtgtgggagccagggcagtttcccattcatttccttattcagtcctttctgggcagcatcccattttacagcgaatacaactggcatagagaagcaaagcaacccactcccaaactatgcagtataagggctggggttgaaatttgaaggcaggtcttggtgttgttaactttgctccatggatgtaacccctagttcctatttttggtttctcatggtctggtcggggagggagaaagaggaatcagcaggttattaactattaactatttccccaggctccttcaccacccaacattctacaagaaaatccacaagaaacaccatgagtggacagctcccattggcgtgatctctctctatgcccaccctatagagcatgcagtgagtagagctctatgctccccagagcaaagggcagatggccccaaccaccttcctgaaggtctcctgcagagaacttagaccacaccggccctttttcttcccatttaaaaatagctaccatttattgtcagccttccatatgccaggctatgttaagtgctaacacagttgtctcatttaatcatcccaacaactttctttttttctttttgagacagggtcttgctctgtcacccaggttggagtgcagtggtgtgatcatagctcactgcagcctccaacccctgggctcatgtgatcctctagcttcagtcttccaaatagctgagaccacacgtgtgcacttccaaatagctgagaccacacgtgtgcaccaccaaatctggagtctcactgtgtcatcttggctggagtgcaatggcatgatctcggctcactgcaatctcccgcctcccgggttcaagccattctcctgtctcagcctcctgagtagctgggattacaggcgtgtgccaccacgcctggctgatttttgtatttttagtaggacaggttttcaccatgttggtcaggctggtctcaaactcctgacctcgtgatctacccgccttggcctcccaaagtgttgggattataggagtgagccatcgcacctggccacatctggctaatttttaaatttttttgtagagtcgggatcctgctattttgcccagactggctggaacccctggcctcaagcaatcctcccacctctgtctcccaaattgctgggattacaggcatgaatcaccacacctggctcctccaacaacctttttaatcttaattttgctaacaagaaagttgaggctcaaactgcgtaatttgtcccaagttacaaaggtgaatgccttcaacaaatcaaagtcccgaaactctcaccttctccagatctgggtcaaggaagtttgcctctggtaccaccttgggactaagtgtatacccaactaagtcccttcatctccctggaccctgccttcaatcatccctcctcttgcaggtctccaacatgctaccggtgatagtgggcccattagtaatgggctcccacttgtcctccatcaccatgtggttttccttggccctcatcatcaccaccatctcccactgtggctaccaccttcccttcctgccttcgcctgaattccacgactaccaccatctcaagtaaggaccttctccccacaatgggtccctaggcaacaaccatcaccctccctccttaagcttctgatagcaggcactggtatctcagtttacatgtgagtgctagttggggaagaggtctgatggctgggaaaataaccacactgggatgaccttactcttttccttctgaaattgggtcctcctccaactgggggttttaaacctttatttggactctgggccctttgaataagctctggacattctctttagaaaagtacatatatgcataaaactcctgcaggcaatcacaaggaagtcatgtatctctgaaagccccagactttttcaagtgtagtctacaaacctcctataccagaatcacctgagatgcttgtttaaaatataggctcttgaattccactccaaatatgctgaactaaggtatctgggggagcagggcctggaaacctgcattttagttaagtgttccaggggattctgatgctggtgatctcatacctgaagaagcctagttctgctagagattctcagactgtgggcatcaatcacacagcaagcttttcaaaggaggactccagatacggcaaattgcaggtttggagtggcccccgggagatgcattggtagcaactccccagcttattctgatgcagatggtcaggatggtggtgacaggtgtggggtaggagggctgagaaatgtgtgaggctggcacaaatgaaatgggatctgcacggaagcctccagcatgggcactgcagtgccgtcctctctcttctaggttcaaccagtgctatggggtgctgggtgtgctggaccacctccatgggactgacaccatgttcaagcagaccaaggcctacgagagacatgtcctcctgctgggcttcaccccgctctctgagagcatcccagactccccaaagaggatggagtgagagacagcctaagtgtcatcctggctgtccctcagccatgggatgcagacacggcttcctgattgcacctaacaatttgcctccttcggccacacgccctaatgatggcaccaccagggtagagggaaggtcggcttcccggaaaagcagggccaaggatgaggctttcttcaaactactgcccttgatgtccctcaatgggatcaggagttagcttaagaaaaaggaaaacacagctccccagactggaggctggtcagagggaggagacccctggtcctctgctgtggaaggagaggggttcagccccagataactcctttgtggcctgggcaggatgcagagaatgacaaggctgaaaggagggggactggaggctgcctggctccagcgagagctccttctgggaccagagggtgggacggccaggtatcactttgccccttcctgccccaaaaggctttcacatacccgactcaggccagagccaagacaccctggcaaatcattataggtctcaattcatgacataccagatgccagtcgccacttcacccaacacacacacaaacatacacacaccaaacactctgagtgagtggtaaaggccccgttttaactctggcccaccgcaaacaaaaggtttccctctgtgggggagaaaaagaaatccaggagctcctccctggattaaaaccaacgaggtgcagaccaaactttaacacctttagccttatgtggaaaccaaaaaccaactgctgggaaactgtgaaaagcccttttacccacaaggggaggggtcaaagttgctgccctttggggacacccgagacccctaattagcctatctgaatgaggaccaaaggttagagccctctttctccccgaagaaagagcccggaaaaacatggcagagcaaagagcaaaatcctttctcccccgaatgctttaccagtttctcagcaacatttattcaagatgatttttaccaggaaccttatcaaaggcaaaaccacagctgcttgggttgaagtccccatcctggcctcctctcagccgccagacatggccaggaaccctgtggttcccaagaacaatttaaagatcactctttgatttgaaagaccaccattatcattttactaaattcttatatatacttgtgccttttccaactttcagttctcttaagaaaaacatccactgtagctttataaaataccttagtatcagctaggtccaagtctccaggcaggactatcaaaatggactccttcttcctatcagctctagaaccccagaggacttgcccagtaggccagctgagcacttaccaggcagcatctccctggccttccacagtctcgcctgtctgtctctggccttggtggacctggctccctccctaggaggcttttgccctcagcttgaatacagttcctggtgcatcaaagctgtaagttctcagctgctggcctgcactcatcacctcttcctacaaataaacatttggaaaaaagtccatcttcaatatgcttaaagagaagggtaggagataaggagaaagaacagatacggtttttttcccctttaaggcctttagattttgaggtactgtaaggggcctagaaggacaaaaggctttcattccctcttccttttggcaggcaggttatcagtccttggcagaagggcccagccctatccttttctgtatcaaacaaaatccttgaggttggtatacaagttaaggctgaaaaaaggccttaaattcccagtaaagaatgtgaaagcaagcatgtaaaataaactggtcttcatg

SEQ ID NO: 38624 - DNA, 122184 bp, Homo sapiens
agagctcgcagctccgccggcgcctggtcccagcgcccgcggcgccgcgtccccggcccaaccatggcgtcctccgcggccggctgcgtggtgatcgttggcaggtaaagggctccgagccgcgctgctgcccctggagcccggggagacgccggggacgtggtgccctcgcgtggggccctcggggtgggcgccgggtcgctgtccccgccccggcctccggtcctccgaagccctgcgccctgcggcccctacggcgctggcgggctcggggagaggcgcggctggaggggcttggcaggtggaggcgccccgcggagttgggtctgcttcccgggagccagcgttgcaggaggttccgaggttgaccgcccaggccgcggggcctgcggttcctggactctgttgaatgtcgccgcgtctgcccgcaggtccacatagaagtgccaggcaccgtgttgaatgaaacgaattctggctgcgatcctgcgacgactgtgttctcatccccattttacgaatgagaatactgagactaagcagtttacctaaggtcacaggcgtttagtgacggagacaggactagcccagcagggagggtgccagcgcagtcctgtcggcgacgatgtcgctggaggccgcagcaggtgttaggcgaacatacacgcagtcctaattcctgggcgaggcgatgtttccagaggggaggtgggggccgatggagcccagagagtttgctaagtgtgtccatttaacagcttaaattctgcccaaactgatttttagtgtgtgcttcccccaccccgccccccacccctacggttacaatccttgctatttttgttttttaaaaaggggcatttgtatgtacctttctttggccagctgttagcagcaatctataaacatgttaatacttgctattgatagttaaaagcacctttttggtgactgctgttgaggtgttggcctgcccccgactccgccccccatcagtgtacaacccggtgtggagaccacttccaatgtcagggtgtttccttcccactgaaggaaggcatcagattccttgttgtcagctttcttttctccagagcagtggagttaactgtgcctttgttctttctggcccatgagtgcccgtggttgaatagtgaaggcatattaaaaagtgcactttgggccgcgcgcggtggctcacccctgtaatcccagcacgttgggaggccgaggcaggcggatcatctgaggtcgggagttcgagaccagcctgaccaatatggagaaactccgtctctactaaaaatacaaaattagccgggcgtagtggcacatgcctgtagtcccagctactcgggaggctgaggcaggagaatcctttgaacccgggaggcggaggttgcggtgagccgagatggtgccattgcactccagtctgggcaataagagcgaaactccgtctgaaaaaaaaaaagtgcactttgtaccagtggtggtagttacctctgtcttgcattttattaatagttaccagagtttatgtgtgtgtgtatatatatacactcacacatatatatacacacacagtttttacacgcatgcgtgcgcgcacgcgcacacacacacaattttaataggatagggtctcgctctgtcgcccaggctggagtgcagtggcactatcatggtggatctccaccttccgggctcaagccatcctcccacagcaggcatgtgtcaccatacccggctgatttttaaaatttttaggtagagatggggtctcaccatcttgccctggttggtcttgaactcctgggtgcaagcgctttggcctcccaaagtgttggggttacagttgtgagccaccttgcttggccttgtataggtccatcatgccttggagtagtgttatgcatgcacctaatacatgtgaagtaaagttttagttgattgtgcagttatctggctgtgggtggctcagtctactgaggaggagcttcagttaacagtttacttctgattccttgagggatgttgataaggaattagagaaaggcttccaaactttaaggaccacataattctctggggcctctgcttgtttctttgttttctggtgtgaaaatcttgtctttcccccaccctcagcacttcagcacacacccagctctgcctctgggacagtgctggtttcttcccttcctctttaccacccttctttctcgtccctctatttctttcctggccccacaggtgattccaaggaacacccacttaacaaatagggcttggggaatgtcaattaatttgccaaaacctggttcagtttcattcttaggtttcaacagaccaaaatatacatatttcaatttcaggagcatattgtgttttcagctttccttatcagtttatagatttcatcttgaaagtacctgctaggaatacagtcccacttaattcttttccgctgatctttttccaaagttcactcttccttagggccacttagctgtcctataaacatccagggcaagtcccttcagaatggggagggcttgaaagaggatgagagaaactcttttgggcctagggctgcaggaaaatctggtagtgataacttttaaaaatgggagtagaagtccaggcatggtggctcatgcctgtaatctcagcactttgggaggcctaggagggcagatcacctgaggtcaggggttcgagaccagtctggccaacatggcgagatcccgtctctactaaaaatacaaaaattagccgggcgtggtggtgcatgcctgtaatcccagctactcaggaggctgagtcaggagaatcgcttgaactcaggaggcggaggtttcagtgagccaagatcacaccactgcactccagctgggggatagagtgagactccatctcaaaaaaaaaaaaaaaaaaaaaaaagtagaaatgggtatcatgaagataaatttgcattggagtagtgttctaaggctttcattttgttagccttacctttataaaacactgtgtttctaaatcgctaaaatatgagttctgtatttgtatacacactgcaagattcagcttgtagcccttgagcttgtttagaataggaacacaaaatgttcctggtgcagggcatgccctttctcctgtcctgctttttagggggcacactctttcaggatcaagctcagggactgtctcctccaggaaaagttctgcttctgggcctttcccctaaggatagaaactgtattgttgccatttgtatccaccatgcgtggtcccaatagacagatagttgagcgtttgtaacagagactgcttattttttaactgatgtgccctatgaagggcttggtaggacgttgttttatatcaagaaaaacatcccataaactagaaaggcaagaaagaaaggtatcctataaactacagtctccttcattttttttaattccaaaattttgtttggggtgattgtactttttttttttgagacggattcttgctctgtcaggctcaggctgaagtgcagtggcaccatctcagctcactgcaacctctgccttctggattcaagcaattctcctgcctcagcctcccaagtagttgggactacaggcacgaaccaccattgctggctaattttcgtatttttagtagagacagggtttctccatgttgcccaggctggtctcgaactcctggcctcaactgatccgcccaccctagcctcccaaagtgctgagattacaggcgtgagccactacacctggcctgtgcattttttataagaaactttctgaggcatgaattttctttgaagtgctattctaggtattttcctgctaatttttgtacacatacacagcaaaccctaggatgccctccttgccttttgagtcagcttagacactaaatgtgcccttcgcaggagttacttaatagctctttctggcaaaatttccatagtagactgagatcatgagtgtaggaacagttttacttcaatttttacccagtaaataagtaactgtagctggaaagatactttcaaatgtatctaaagtgaatttattcaaaattaagtgacattaatgatagaattgaagcaattatatcacttttctcccctgctgctttgctactgtgtaacagaataaatgttcatctgcattcaccttttgtagtacccattaagattcatgaattcagaagctttaagacatgtcgcaatagtcacagtgggaagggcattgaattacctctatcgctggctcccattttgaggtccccaggcatatagtggttggaaaaaaggccaataagatgtcacaagctctcaggacaggaagttaattattcttgggcctgatgtaaggtagtattggggaacaatactgagggaaacctgaaacagaaacctgaggaaaaccaagccagggaactttctagctctggggccgtgcaatctggtccctgtgcctctctgtagcttcctttgctctgtagattccctctccttgtacttgctcacttttctttccttccctgtgactttatcttgcacatcactgccaaccctaaggttatcctctttcaagtatagtgcctcttactgattttttttctgtattttgggtccaatttatttcctttctttctttctttttttcgttcgttcgttccttccttcctttcttccttctttctttctttccttttttttttttttttttttttgagacggagtctcgctctttcacccaggctggagtgcagtggcgtgatctccgctcactgcaacctccgcctccgggttcacgggattctcctgcctcagcctcccgagtagctgggactacaggcccctgccaccacgcctggctaattatttatattttagtagagatggggtttcaccgtgttagacaggatggtctcgatctcctgacctcgttatccacccacctcggcctcccaaagtgctgggattacaggcgtgagccaccgtgcccggcccgggtccaattttcaagagaggaaacccagtggtttcacctctgtgcatcccaggctgcagatgttatagggtgctcctaagccagttgattggctgctttgggtcaggtgtccaatccatgtccaatcagcaatgactgagtgtgtgggcgtgaaggggtgggggaaaagacaccagctggtccccaggggtcagcggtctgctgttggtcctctgcaatgaaggggccaatctcaagactgaaagggaagtggggcccagtccaatcacctgatatttgatgccagaatcctggccgatggttaccctccctcaggtcagataattgcgattccaaggatttgctgcctgtttgattagggggctgcctttccctgagcaacagcagcggggtaagacccaagccatggaggcaggtgcattagccccagaccaaagcaccatgctccctccctcatgattgcttcccctctccagggttcagaccccgcagccagcaaacatatagttgttccctgaaaacagaaaagcaccctctcttgaccccatttttccctctggtaattgccacattgctcctcaaaacttaataaacttatccatattgtctccagtttctttcttcctatccatattctctctcttaactttgtgttagggaaacatttcaaactgtgttaaagttgagagaacagtgcaatgaaccttaaagtaccttcccccaccccctcaacttcaacaattattaacacatggctaatatggtttcagttattctcccttctctggattgttctgaaacaaatgccaggcattgaatcatttcgtctgtaaatatgtcagcatgtatagtatctaaaagatatggactgttttaaaactatataaccacaatagcatcatcatgtgtaaaacattaacacaattccttaatatcttcatgtaatatctttaaatatctcttccatattcaagagttccctgattaattttttaaatacttggcttgattgatttagggtctaaataaggcccacatgttatatttagtcaataagattcttagctctttcaatctatagattgttcatccctctctggttttgtaaaatttttcttgccgtttatctactgaagaatttgagtcatttgccctgtaaaatttcccatattctaggttttgctgaatgtatcccttccctcccctcccctccccttcccttcccaagatggggtctcgctatgttgcccaggctggtcttgaactcctgggtgcaagccatgtacctacttcagcctcctaaagtgctgggattacaggcgtgagccactgcgcccaacccatgtagtgtcatttgtcatgttccaccatcccttcatttcctgaaactggtagttagggctagaggctcattttctcttaaacctaccctgagcagtctttcatcaatcccacaaatctgctcttgtcatggtccccaccgccattcatcttgcaaaacccaatggtcaatcctcagttcaagtgttcatcagcagcgtttgatgcagatggcagctcccttcactttcctgactacacccccctcccatctcactggcactcccttttgtccccatattcttccccattaaagttggagtgtcccaaggctgaatccttggacttctttatcgatattcactttcttagagatctcacccagtcacacacttttaataccacatctctacagtaaatcccaaattaatatcccagcccagcccttggctctgaacctggatacttacagccagcgatttgctagacccacccttagcatttctcactgaaaacatcccgttttgaactgatcttccctcctaacatctgctccattgctagtctttcccagcagagttaatgacatctccatcctttcttgtccaaaagaaacttggcactgtcctccatttttctttttctcacatccacatgcaattcgccagcaattcttcttggctgtactgtgaaaatactgcacattcatttctcagctgacccctttccagcaccccctctgcctccgtcctggtcccgcctcccatcgcatcgggcaccagcctcctgacacccagctggtctcctgacttccatctttgcccttctgcagtatattctcagtaagacaactagaatgtccctttaaaaacagaagtcagatgatatcttttgtctaaaaccttctattagccaactatctcactcagtaaaaaccaaaatccctccattgcttctgaggtgccatgcaatgagctcaccgttctctccttccctttgacctcattgtcccctccttcctctccccccaccgcccctccagcagagcaccagccttgttgatctggaccagctgggcaaacagactctttgaggaacacttgtcgcagaaatacactcatggcttggccccttacctccgttgctaaaatgtcaccttcccagtgagacagtccctggtggcgcttttaacatttctctgcctctcagtccctactcccctgctttctttctcccaagtgcttttgcttatttagtttgttgtctgcctacctactatgagctccttggggtcaggaactgggcagtgcctgcacatggtaggtgccctttacgtatttcctcagtgagtcatcgttgccttctaattaaccccatggcaagagccagctgaccgttatctcgtatttttcacttgataaccatggctttttcacatttattgagcctctacaacatgccaggaatatgaaggtgagtgctagttcctggtgcatagagtttaccctgttgaacaaataaattcatactgctcactagcattgcttttttttttttttttttcttgagacagagtcttgctctgtcgcccaggctggagtgcagtggtgtgatctcggctcactgcaagctccgcctcccgggttcacgccattctcctgcctcagcctcccgagtagctgggactacaggcatccgccaccatgcccggctaattttttgtgtttttagtagagatggggtttcaccatgttagccaggttggtctcgatctcctgccctcgtgatccacccgcctcggcctcccaaagcgctgggattacaggcatgagccactgcgcccggccactaacattgttttttattttaaacttcactatgcaaaatttactttttttatttttttgagatggagttttgctcttgttgcccaggctggagtgcagtggtgcgatctcagctcactgcaacctccgcctcccaagttcaagcgattctcctgcctcagcctcctgagtagctgggattacagatgcgtgccaccactcccagctaatttttgtattttcagtagagacagagtttcaccgttttggccaggctggtctcgaattcctgacctcagatgatccacctgcctcggtctcccaaagggttacaggtgtgagccactgcacccggccataaagatttcaaaatccaaaaacaatttgcaatctgaaatactgggcccaagcattttgaataaggcccactcggcctgtactgcatttgtcatctgctcctgtctctccatccactcccaggcttgcacacccatataaggtgggtgccagaggtagaatttttttcagagttttgtcccaggataaagactgtattgagaaagttgactttgggtagagcaagattaccttcttttttatacagggtcttgctctgtctgaggctggagtacagtggcgtgattgtagctcactgcatactgcatccttgaactcctgggctcaagtgatcctcctgcctcagcctcctgagtagctgggaccacaggcatgtgccactacacccagctaatttaaaatttttttttgtagagatgcagtttccctctgttgcccaggctcttcttgaacttctgggttctaattatcctcccgcctcagcctcccaaagtcctggaattacaggtgtgagccaggcctgttcaaaattatcttttggccgggcgtggtggctgacgcctgtaatcctagcacttttggaggccaaggcaggtggatcacaaggtcaggagatcgagaccatcatggctaacatggtgaaaccctgtttctactaaaaaatacaaaaaattagccaggcgtggtggcgagcgcctgtagtcccagctacttgggaggctgaggcaggagaatggcgtgaacccaggaggcggagcttgcagtgagccgagatacccccacagcactccagcctgggcgacagagcaagactccatttcaaaaaaaaaaagattatcttttgatattcagtccccaggagaacaaagccatgtgctgaggcttgaagaggggccagggaaactgagattgaaatgttacaaatacatatttcctctaggctagtgagaaagtgcccagttgccttctggtggggtaggtaagccttgtccccactcagaatcatccttttgcagggtaagttagtgttcatttttttaaaaaaatattttttaaacttttaaaccacatttagcatagtaaaatagacataacatacaatttgcctttttttttttttttttttttgagatggagttttgctctttcgcccaggctggagtgaagtggtgccatcttggctcaccgcaacctcctccccaccggttcaagcgattgtcctgcctcggcctcctgagtagctgggattacaggtgcccgccaccatacctggctaattttgtatttttagtagagatggggtttccccatgttggccaggctggtcttgatctcctgacctcaagtgatccacctgcctcagcctccaaaagtgctgggaatataggcgtaagccactgcgcccagcccaacttgccattttaacagttcttagtgtacagttcagtagtgttaagtatgttcccattgttgtacaatcaatcttttcatcttgcagaattaaaactctgtacccattgaacaacagctgctcatttcccccagccccagcccctggcatccacccttctagctttctgtctctatgggtacctcaggtaagtggaatcgtagggcatttgtcattttgtgactggcttatttcatttggcaaaatgtgctcaagattcatctgtgttgtggcatgtgtcgtttctttttaaggctgagttagtgtttattcttaaaagcctaagactctgcacacagatagctgttttttgcattcacaccttaaggcaactccctacattatgccaaatgtgacatttgtttccccctcacccttctactcaactaaatttaagtattattattattaattattattatttactggctccatccactcttatgaaaatttaagtattattgctttacatttttacggcacgagttggttgtcaaagcatgtttacaaacatttatttttaataacagcagtactgagctgtaattcacccatttaaagtgtacaattcagtggttttagtatattcacaaggttgtgcatccatcaccacaatcaattttacaacatgctcatcatcccaaaccttggacccactagctatcacttttcattccttcctcccctagccctgggcaaccacaaatctacttcctgtctctatggatatgtctattccggacattttataaatggaatcatacaatacgtgaacctttgtgactggtttcttccacttagcataatgttgtcaacattcatccatgtggcatgtgtcagcatttcattcctttttgtggctgaatagctctgttatatgggtatgccacattgtatctgttgcatttagctgttatgaataatgctgctataatcattggtgtacaagtttttttgtggacatgttttcatttctgttgggtagatacctaggaatggaactgctgttacatgctttcattaaaaaaaacctttatttttttagacaatttttacatttttacagaaaaattgtggagatagtatagagagttttcatatgtcatctcaccaaatttcccctattattaacatcttacattaatatggtgcatttgtaacaattaatgaaccaatatattattgttaacatcgtttattaataattttaataatattggctattcatgaccaacacattattatttaacaacattcacattttattcagatttccttagtttttacctaatgtcttattgctgtcccaggatcccctctaggataccaaattacaataatcatttctcttttgactcatctaaactgtgacagttacgcagactttccttgtttttgatgaccctaacagttttgaggagcaccagtcaagtagtttgtagaatgtccctccgttaggatttgtccgatgttcttctcatgatgagaatggtgctatgggttttggggaggaagaccacagggataaagcatcgttttcactttgtcttatatcaagagtgcatactctcaatgtgagttaccactgttgttggtgactttgaacacctggctgagggagggtttgtcaggtttctccactgcgtggtgaccctaacttttccctcttccatactgtgctttttggaaggaggtcactctgcacacggaagtgggggtgatgccctacctgcctaagggggagtaactacataaattatttggcatttttctgcaagggagatttggcttcttcttcatttattcaagcatttatttgtgttatactttgtgttataatccagtattgctgtattaattttgtggctcaagttccagctttggccattgggagctcctatatcgggcccctatccctttgacatgccccatcgatgcgtttttttttttttttttaatactttctttttctttttggtgctacaaactgctccgggctcatcttgtatattttctggctctgtcttcaaattagccatttctccagggagtcctgcttcctattactggagaatagtattggaaaccaagacttggactctagatgtgttctgtacatttgtttttcactctttgaacaaccccatgtgaactctttatgactttttttgtcttttcacttttcaggaagtctgaaacagcagttggagtgtagtggttaagaggaaggactcaggagtcagattgcttggcttcatctcatagatccataacttatcacccttgtggacttaattcctccatgcctcagtttatcacttatgtaggcttaattcctccatgcctcagtttccctacatataaaatggaaatactaataacacctaccttgtagggttgttgtaaagattaacataggtaagacctgtggtatgtttgatggtgcctgatacctaatccatgctgaaatgtgggtggcagtggcagtggcagtaattattggggaggacagggcagatgctctctctgttcttttaaattaattgacttgcctaagacatggtcaaatggaagttcactaacgggtcttgtgtctccatggtaccctgctacctcctgactgtaatattttattcagcgtgtgagtacatgataaatacctgagatgctgcagggctccatgtggaatatgaataccagcactggagttgagggctcaggagctcctgggtggaaacagttaacatttaaaataaataatgttattaaaacgtgtacttaaaaaaattcatacctaatattcctacatacttatggggtacctgtgatattttgttacatgcatagaatgtgtaacgatcaagtcagggtattagcacacccatcacctttaacatttatcatttctttgtgctgggaacatttcagatcttctagctgttctgaaatatacaacacattgttgtgaactctagttaccctacagtgctatcaagctctagaacttactttttctgttaactgtatgtttgcacccactcaccaacctctcttcctccctctcccacccccgtccagcctctgttaaccaccattttattctccaccttcatcagatcaatgttttcagctttcacatgagtgagaacatgtgatatttgtctttctgtgcccggctaaaatgtgtacttttaagatatgtattgaatattttaagaataggatactgtgaatttaaaaaaaactcattctgggttaggaatgaaaagccattcgattattaaattaactcgaatcctttcttttatctcccttcagtggagtcattgggcgaagctgggccatgctgtttgccagtggaggcttccaggtgaaactctatgacattgagcaacagcagataaggaacgccctggaaaacatcaggtgggccagccggcgctctccagaaggaatggaagtgggtctgtttctctcagttggtcttgtttgtcatatcctcaaggctatgaggatctgtgatgtcacattttcgtctgatggctactgcagtgcctctgagttggtaaaggccaggcctacagtggctggaatgtgaattcacactggggaagggctcccatgggggaggaaatgacccttcttgctaagaggatctgcatcaagcgtgagtgactttgcaggcttctccagctgtttgccccggggctggagggctggggtttcctgcttccatctaggcaggaggaactcgcttccagcatgtgacagccatagctgcaggggcattacagtttaggaacagaggtcctgcagcttgttttgacctgttgatctagtaatggtaggacccaaatgaaaacatcttgaattttagttagaggtttagcactcatgtgagaggacagaactggagctgtttatgtggttattattaactgtgacagcggtactagttaaaggtgtgagagtgcatgaatttacttaatgctgagtgctaagaatgcggagggctgttttagggatggtagtcacgggaaccaaagaaaggctgagagtgagggaggtcaaggacaggggaaagaagccattgcagcgtgcccagaagcaaaggcactggcgtggagcaccctcaccgcatggcgcgtccccctgcggtgccgtcacggaacagggttctgaccatctcagacacgcgttagctggttattatccttatttggagggtgtccatgaatatatgacttgaatttgcatttttgtgcaacaaaaatatgcttactttattgtctgcattttgaaaagattaatatgtagggtatagtgttaaactataggcatgaagaaattatataccctaacctggtgttgttttacacattaagaacttgaacacagagaagttaagttacttcttccatgttgttacaaatagtcaatgcgagggtaaaatgtcaatctaaaaaacaaaaaccttgtccaggcctggtagctcacacctgtaatcccagcactttgggaggctgaggtgggaggatcatttgaggccaggagttcaagaccagtgtgggcaacatagtgagaccccgtctctacagaaaaaaaagaaaaaaatagccaatgtgttggcacccacctagatagtagtcctagctactcgggaggctgaggcagaaggattgcttgagcccagtagttccaggctacagtgagctatgattgcaccactgtactccagcctgggcagcagagtgagactttgcctcaacataaataaaataataaaatgcaaagccaaccagacaaaaatcaaaagtaaaacaacaccgaaaaaccactcacatagactgtactgttttggaaggaaggggacttggcatttcagaaccaactacctgccagccatgttctgttcactagggatacatagtggataatgtagacacagtctttttttttgccacggagcttgtggcctagtaatcttactgtattaaattctcgtaataaacccttttgcctgagctcaggagttggagaccaccctaagcaacatggtgaaactctatctctactaaaatcaaaaaaattatctgggcatggtggcgggcacctgtaatcccagctactcgagaggctgagacatgagagtcacttgagcctgggtggcggagattgcagtgagctgagatcacaccattgcactccagcttgggctacagagtgagactctgtcttgaaaaaaaaaaaaaaaaaagattcacttggtgtttacactctatggatttggagaaatgtatactgacatgtatctacccttgtagtattacacagaataatcccactgctctcaaattcttcctttccatccctcccttccccccaaccgctggcaaccactgatccttttacggtctccacagttttaccttttccagaatgttatataattgaaatcatacagtatgtaggctttgcagactggcttcttttacttagtaaaatgcatttaagtttcctccatgtcttttcatggcttgagcttgaatgatattgcattgcctggatgtaccacaatttatttatctattcacccactgaagaacatcttgggtgcttccaggttttggcaattatgagtaaagttgctctaaattccatgtgcaggtttttgtatggacataagtttccaactcctttgggtgaataccaaaaagcacaattgctagattggatggtaacaggttgtttagctttgtaagaaattgcaaaactgccttccaaaatggctgtcctattttgcattcccaccaacaatgaaggagagatcccattgctccatatccttaccagcatgtggtggtgtcagtgttctggattttagccattctaataggcaaataatggtatctccttgtttttttgtttcttgttttgttttgagacagtctccctctgtagctcaggctggagtgcaatggcacgatctcggctcactgcaacctctgcctcccaggttcaagcgattctcctgcctcagcctcccgagtagctgggattacaggcgactgccactacgcccagctaatttttttgtatttttagtagagataggttttcaccacattgaccaggctggtctcaaactcctgacctcaggtgatccacccgcctcggcctcccaaagtgctgggattacaggtgtgagccaccaagcctggcctaatggcatctccttgttttgacttgcatttctctgatgacatatgatgtggagcatcttttcgtatgtttgtcatctgcatatcttctttgagtagtactttttaatgtaaaaacatttttgattaaaggggaagccttaaaattttttctttctgcatttgctgcgactctctgtgcataaaaactagttttatgaaggatcctgagattttgaaaagagaggcccttcagggattctggtccatcatagtgctggaagtagaagtcttcaggtagtcttgaaataaattttaagcctcagtaaaaatagctcaaagtcatatagtcaggagaaagaaaaaaaaaacccttgatagagcactaattctaaaaacaaaacaaaacaaaacaaaaaactatgaggcaaaaagatgttttcagattgaatcaattttttttttttttttttggggattgagttttgctcttgttgcccaggctggagtgcaatggcgcgatcttggctcactgcaacctctgcctcctgggttcaagcaattcgcctgtctcggcctcccaattagctgagattacaggcacaagccaccacgcctggttaaatttggtatttttagtagaggtggggtttcaccatgttagtcaggctgactcctgacctcaggtgatccacccacctcagcctcccgaagtgctaggattatatgggattataggtgtgagccactgagcctggcccaaaatgttgttgttgtcagttttttttttttgtttttttttttttttttttttttttttggagtctcgctctgccacctaggccggagtggagtgcagtggagcgatctctgctcgctgcaagctccacctcctaggttcatgccattctcctgcctcagcctcctgagtagctgggactacaggcgcccgccaccacgcccggctaatttttttttgtatttttagcagagacggggtttcactgtgttagccaggatggtctcgatctcctgacctcgtgatccacccatcttggcctcccaaagtgctgggattacaggcgtgagccactgcacccagcccaaaatgtttttaaaaggcatcacaggaaatgtaacacaaacagcttaatatttggttttatggaggtgatttagggagcaataggaagtaatttattgataataaaaaagccgttaattttataattgtaaagaatgttaaggaatttgtggtcttcctgagtaaattacatctacttaattaaattcatcttttattcccacatttgtgtattaaagagcatagcaagctccactttggaaatggtggctgctaaaaaatgcttctccttctgtccttgagggctatcctggcttttcaggaggcctggacatttattttattttattttttttgagaccatgtctgtctccatcacccaggctggagtggggtggtgtgatcttggctcactgcagcctccacttcctgggttcagttgatcctctcacctcaggctcccaagtagctgggattaggggtgtgcaccaccacgcccagctaatttttgtatttttttgtagagacagggtttcgccatattggccaggcttgtctggaagtgatcagctcacctcagcctcccaaggtgctgggattacagttgtgaaccactgtgcctggccaggcatggacttttttttttcttttttctttttttttttgagatgaaaagtcttgctctgttgcccaggctggagtgcagtggctcgatcttggctcactgcaagctccgcctcccaggttcatgccattctcctgcctcagcctccggagtagctggggctacaggtgctcgccaccacgcccagctaattttttatatttttagtagagacggggtttcactgtgttagccaggatggtctcgatctcctgaccttgtgatccgcctgccttggcctcccaaagtgctgggattacaggtgtgagccactgtgcccagcctgggcgtggacttttaatcagttttctggtgacagtatatgcaacaggtaggtttggagctgagagacattagcttcatagctggcccagtactggagaaggagagtacctccaagggaagaggagacccgtgaatctctgattaggtcatgctttaagccagccccaagtggactccagacaaggagttgacaaactgtttctgtaaagaccagatagtaaatattgtaggctttgtgggtcatatggtctctgtttcagccgttcgttgtaaagtaaaagcagccatagacaatcaataatcaaatagaggtggttgtattccaataaaactttatggattaacatcgaactttgttcgtataattttcagagtcacaaaatgttattttaaaattttcccaactgtttaaaaatgtaaaaaccatccggtattagtctgttttcatgctgctaataaagacatacctgagactgaacaatttaagaaagaaaaaggtttaatggagtcatagttcacgcggctggggaggcctcacaatcatggttgaaggtgaacggcacatctcacagagtggccaacaagagaacttgtgcagggaaactccgctttataaaaccatcagatctcgtgagacttattcactgttatgagaatagcatgggaaacacctgcccctgtgattcagttatctcccaccaggtccctcccccaacacatgggaattatgggagctacaattcaagatgacatttgggtgggaacacagccaaaccatatcacatccttatctcacaggccatataaaaataggagatgggccagatttggcctgtgggctgtagtttgctcgctgctaccatagacttttcaattctgttatcatttcatcttttatcctgtaaagccaattccaacccacttgtaattaagagaaaatcccacggttcctaattgaaagtcctttgttctatttcttgggtatttgtgttttaggccttatttttagatgcatcattaaagatttttaaagtcctttcaggcatcaggactgatgatgctgaatgatggagggttgtggataagtttttttgttttttttttaaccaggttaaaggctttcctgttatcctactatgcttaattaagagctgtatttcttaatatcattggtgcctgattagatttaacttttagatacagtctgtaagatttttgaaccagaaaaacctaaataacttatgactgttagcagtcatattctagaagaagcaaatgtactgaattcttatgtacctaggattttaagggagtacatacaaatctttcctcagtagcaggtactttatttttataacacacacatttaagctgagttaaatatgcagaactggttgtacttctttggcaggaaaagggaagcttaggatatcttgtgaccaactacctcttccttctcaaataactggcaaataacttcaggaaaatccagttatgttgtgtcatattgcaccccctaggaagtactggattcttagtcttgagtgacttttaaataaagctacctttttctctttcttacatcgcaagatcttcaaatgtaccattcccgcacagagagtccaaggtaaaaggactgaaaccaaactttgtttttgtaagtattttggtcagtgcaatgagttcagagaccaggaggttaatgattgtgaagtcttgtcaacagcaacaccgtgtatgacctgtggtgcttagatgttcagaaaccccaaggttaaaatgtccctgaccacatatcaggcaaaaggaatgtaaggaaaaccaacttaatccttttgtcaagaagtataaatgatgtatctttccaatcgggttgcattgacttttgggtccaaatagcttgtgtccacaggcatcttccctgacaccctgttttgtggtctttgtctaccactgtaggtcgtgggctccctcaggacagaccatacatcacacccccagtgtccctcactatgcagtgacgtgtggtctctgtactagccattatggacgcagaaataagcaacaggcacgtttcctgtccccagagcctgaacctgctagcctgaacctattagctcagcaattgttttgactgagtcacaggaaccttttctagagtctccgaaggtaatgtttccagtcatattcctcatacacttttttctcaccgtctattccaccttgcagtttggcccacttcccatattctgatttttttttttttttttttttttggtgggatagagtctcactttgttgcccaggctggagtgcagtggcacgatcttggcttactctaacttctgcctcccgggttcaagcaattctcctccttcagcctcccgagtagctgggactacaggcatgtgccaccacgtctggctgattttagtattttttattagagatggggttttgccatgttggccaggctggtctctaactcctgatctcaggtgatctacctgccttggtctcccaaagtgctcggattacaggcgtgagccactgtgcccagccatattctgattcttttttaacgtttcatattagaaaatgtcacgtggttgaaatttcactacatctgcatgaatattctgtgtgtgttagacctattaaaaactaatggtattaaatagtagaaatggtacatatggattctgaacctgtaaaaatgaacttaaacggggggaagttgatttaaaaaaatattaaaacattagaagataaaagaaattatcacaactcataccatgccaagggatcttagtgaacttgaaaaacaaaaagctgtcatctgagactaatctttttctaacagggtggcacaataagaaacttaaaacttagcatgtttacatttcataatagaaggtcgcttgaccttggagaacctcattagcagatactttactgctttgtctttgttcaccattgtatgcccagtgcttggcctgcattaggtctcaagtaagaagtttagaggatgaagctgtgttttaagaagaaaagcaaatcccagcactttgggaggccaaggcaggtggatcacctgaggtcaggagttcgagaccagcctggccaacgtagtaaaaccccatctctactaaaaatacaaaaaaatcagctgggcgtgatggtgggtgcctgtaatcgcagctactcaggaggctgaggcaggagaatcgcttgaacgtgggaggcagagattgcagtgagccaagattgcaccactgcactccagcctaggtgacagagcgagaccctgtctcaaaaaaaaaaaaaaaaaaagaaaagaaaagaaaagaaaaaagaaaagcaaatcaagtaaacaaagttgtaacacggacctacagatcaggagtgttttagttcttaagatttggagctagactcatttccacgtagcaggtgggccattctagtcctcaagggaccaggccgccctgacttaggctgtgttgacatcttggtgaccaccccaactccaggagccaaacacactgccttgtctggcctgagtccctatctgaaatcgccatctttaggggcctgtacgcttcgatcttggtttctccaccatctgtacatggtcaccctggcacccagctccacctaaaagtgaatcatctttctgaatggactaggagttaataaaccaccagcagtgatctctgaaactaggtaggcctgtactgtgtctcctaagtgactgaatttcttgtgcttggacgcaggcatttccagtaactgggtctctgacctgtttttaacttgctacctaggtctctgccctggcctaatcttgaactgtgttttgatctggattggtctgttctcctgatttgaaacctttagttttcccacatactgttggccagaataactgagtatggtcacaaattgttcccgtctctgtctgcactcccctgtgcattgtgactttgctcctctcacccccttactctgggcttagccacgggcttgcatcggccagtcggttattagcacatgtggcatgcacagcagaaggcctggaaagtgcatgtgcattgagattcgttcgcttcctgctggggacccttcttccctcctcatctggtcagcccagcctagtcagcgggaggtgtgtggcccagctaccagccagcaccatccagcacagcaccgactgctaaacagatgagggaagccatcctagaccagcccccagacaacccactactcattgcaagccgcatgagtgagcccagctgagccagccaaaattattaaagcccgtgtctgttgcccaaagttcatggcagtggctgcgggttcagccgggttgttcaatctgacttccctgtgagttcacagatcctgctatcacttagctgtcattaggacagatcaaataattgcttcatttgccttatttttcttcccaaataaaaatagccttgttttatctgatttgtaaaagtcatatatatgctaattatatatccatagtattggggagaagccaaaatattaatactttgactctgggcggcaggattccgagtgatcttgctgcatattctgaggccgtgcgcttccggtatgatcctgcgtgcttccggcatgatcctgtgtgctgtgcatctagaccaatgcacattagcagtcatggttgggctatgaaggtgtaggtgctgtcaaggattggactcaagaattgtgtgactcctaccttgactggccattgtctccctgtgaggtttccaacaaggtgaacaggaaaccaaagtaccccattttttaaccgggccttgatactccagtgtaaactttggtgaaattgattgccttgacacttaagcaggccctctcctcccctgtctgtctccctgctacccagatcccagtgttaccactggcctggagggaggaggggaggagaccttttttttttgagacggagtctcgctctatcgcccaggctggagtgcagtggcgtgatctcggctcactgcaagctcctcttcccgggatcacaccattctcctgcctcagcctcccgagtagctgggactacaggcgcccgccaccacgcccagctaatttttttttgcatttttagtagagatggggtttcaccatgttagccaggatggacttgatctcctgatgtcgtgatccacccacctcggcctcccaaagtgctgggattacaggtgtgagccacctcgcccggccggagggaggagacctgagtgaggagggggaagcggggagggcagagacccggatgggccacagtggcgtggatccaggcaggcagacccacagccctcctgtgcgacagaaggtagttttctttcttcctacagtgcatttaagttcacatgcctcactacaaggtttgcagatcccgaagtctaagggggctgggtggctaatgggtgtgaataatggggtggggtggagacctgggcaaactggaggtagtctttggagataggcatgccagatttttaaaacattgtgctgtcaaacggaagtctggagctactcttcttaatgaaaacttgagtgttctgccctcttcccaacttcagaaacacctgccatgattgttagtgtccacacactatcaccgtgccacatggactgtgtggttgggctgtcttctgactcttttgcattgcagtaacttaattaaagatttttgtgcagcctcaacttaacctgcccgtctggagttagagtgatccctggggctggagtcgggtggagtctggctcagccctctgcctctgcataatcagggcctagaaacaacagcaatgtcaacgtcaaagcagacagcacaacacagccatcccataaggaagcaatccctggcctttctatttcctcactgctctctgttctttgcctccagtgtgctagaatttctgttggctggagatgaggtagactcacctccttaagctaatcttacctgatcttccatgtctgccccattcttccccatctttagctcttcagatcctcagaccttcaggaataggtgggagccaaagaccctgccagaaatccccttgggagttcactataggctggcactgagatttctgaaagaaatgttagccatgccctttattcctcaggaagctgcattatacatggagtcatactgtagatagaaagcaggcagcacagtgtgaaaataagtgagcagtgcagaggggtccagtgtggctcagcggcccagactgtgagctttgcagtcagatctggctcagccttcatagctgggtaactcactcaatctgtttcctcatctgggatatggagacataataataccttcctcataatgtggttttgttaccaaaacaccaagagtttggtctaggtgctgctgctcacagcagtgaaagccaatgactgaaatgatgagtacagccaaggaagaaggctttaatcggctgctgcagccaaggagatgggagttcagtctcaaatccatctccctgaccacctaaaatcaggggtttatatagcaggaaagaaatgtagcactgtgtaggaaaacaggaactaggggggggcaaggaagcaatcatggtgaatgaggggcctggagtctcattgtatggatgtgatgatctggtaagtttcagttcttcaacacttttttttttgagatgcctgaagtaatttcctgaggaaagaactcagataaaaccaatagaaatttcaagctttaaggcaaaaagtatcaatttctatgtttactgaaaaaattgagtgggtttcagtctccccttgtttatagattcctcaaccatggggcatctggtcatccatctttctgtctccttcctgctgaggagaggcattgtgggcagctccataccatggaagacctcatgaccatccaggaatcaaaggctaatctaatactaaagtttttcttctgaaacacaatctttttctccagtctaccactttcacaaagacatcacagcaggaccaatctacctgcaaaataagcttcagtcccatatacttggcctgattacccacacaaaatggaacaagaatcactgttctcataggctctcctaaattggctttgctagaacctctctcaaggccattttagtcaaagccctgggaaaacaaccagttccttcaactgtgtcccattaccaaagaaaacatgttgttattaactgtatgcaaacaaacacattgccatgaattaagaatactcacaaatagtttataaattctggataaattagagaaatatgcctcaaattctgtttacaaaagtatactctactcactatacttaaaagatacttaaaggatgactcaaaagaaaaaaattcttcagactctgaaaaacaaaaagaatgagcaatatttcaaacaaaaaagccataaaagttatttcagtcctccattagttccgtccatgcagacaactcctgctctgcttcatgttgagttagccatctttgtgaacacatcagtgtttccattagtgcactggaagttttctctcacatccaatggcacaatctccgaagttatcagaaacttgtattcaagagtccttttcatgaactccccccaaagaaacaagccctggacagtagctgattataagtcactttttgtgaagaatcaacacaaaacaacaattgtggatgacaaaagtcttaggacaaccacagttaaagacactgttgacaaggaaatttggttatttctgtgggatacaacaatttaacatgaaaatcataattattactgacaacatattaagacatatcagaattataagaatctaatataatcctggaacacattgacaacacatctatataaacataaccaaagggagctaaacaacatctcagatttgacaatgcttcctacatttttttttgtgtgtgtgtcagagtctcgctctgtcacccaggctggagtgcagtggcatgatctcggctcactgcaagctctgctctcgggttcacgccactctcctgcctcagcctccctagtagctgggactacaggcgcctgccaccacgcccggctaattttttttttcatttttttagtagagatggggtttcaccgtgttagccaggatagtctcgatctcctgacctcacgatccacccgcctcgacctcccaaagtgctgggattaaaggcatgagccactgcgcccggccacattttttttttttttttttgagacagggtctcactctgttgcccaggctggagtgcactgatgcgatcttggctcactacagtctctgccccctgggctcaagcaatcctctaacctcagcctccagagtagctgagactacaggcatgcgccatcacacccagctaatttttgtattttttgggtagagatggggttttgccatgttgtccaggctggtctctttactcctgggctcaagcaatctacccatcttgtcttcccaaagtgttgcaattacaggcaagagccaccatgcccggcttaaataattctaacataacacataagcctaatatgcctaatatgtctctcttggacttcagggaacctaatagctgaaaaagttagtttaaggtcagagaatttagaacttgatattttgctgttgggaagtctgtcaaatatcaaaggttttaagacacttgatatcacaaaataggatcagaagtcactataaaacagtcattcatttggccaaaattataatacaaaaacattttctctttgataggagactgagtttcctaaacattaagacctagtaaagacagcatgaggccagctaaatctgtctttctccttccctctatttgttttcttctgtggttttactgaaaaggtaaataaaaatctcttatctcttacatgaaaattttgttcaaaagagaaaaccaaattttacctttgtatggtatattattaatgttaatgctaattttaataaaacattataaataaatctaatcagtttgaccataaggtgagatttccataaactttataaccttttataattttatattaaagagcagatcaatgctccaagaaaaccctgttattccgacacacgggcctagacactggctttccattaggcagtgtgtgtgtagtgtgtatatggtgtgtgtagtgtgtattggtgtgcatagtatgtatgtggtgtgcgtagtgtgtgtaagtggtgtgtatagtgtgtgtatgaggtatgtgcatgtgtgtgtagtgtgtatatggagtgtgtgtagtgtgtatggtggtgtgtgtgtagtgtgtatatggggtgtgtgtagtgtgtagggtggcatgtatgtagtgtgtatatggggtatgtgtagtgtgtatggtggcgtgtgtatagtgtgtatatgcggtgtatgtagtgtgtatggtggtgtatgtgtggtgtgtatgtactgtgtatatggggtgtgtgtagtgtgtatggtgttgtgtgtatgtgtggtgtgtgtgtagtgtgtatagggtgtgtgtgtagttgtgtgtgtagctctagagacagaactgtgaccaaaagcatcaaaaatgtgataagttcaatgccaaagttatcaaagtaagacaactagttttcaatccatcattaaaaaatggtaaatgaaaacattagttttggaaattcaatatgagtataaatccttatattgtactgtgtatatatggtgtgtgtagttgtgtgtatgtggtgtatgtatggtggtgtgtgtgtagtatgtatatgtggtgtgtgtagttgtgtgtatggtggtgtgtgtagtgtgtatatgagatgtgtgtgtagttgtatgtatgtggtgtgtgtttgtgtggtgtgtgtagggcatatatgtggtgtgtgtagttgtgtgtatgtggagtgtggtgtgtagtgtgtgtatgtggtggtgtagttgtgtgtatgtggtatgtatgtagttgtgtgtggtgtgtgtggtgcatatatatggtgtgtgtagtgcctatatgtggtgtgtgtagttgtgtgtgtgtggtgtgtggtgtctagtgcgtatatgtggtgtgtgctgtgtgtagttgtgtgtgtggtggtgtgtgtgtagtgtgtatatgtggtgtgtgtagttgtgtgtatggtggtgtgtgtgtagttgtgtgtgtggtggtgtgtgtgtagtgtgtatatgcggtgtgtgtagttgtgtgtatggtggtgtgtgtgtagtgtgtgtggtggtgtgtgtgtagtgtgtatatgcggtgtgtgtagttgtgtgtatggtggtgtgtgtgtagttgtgtgtatgtggtgtgtgggcacgcatggctctcgcctctcagggtgtcctctatctgaagcccctggtatctgtagcaccccccaacggcctcttgtgtctggcctattgtggttggatttctttagtagtggcaccgctttcagtaaactcttgtcacctcccactcctcattcacactgtgtcctctttggtacctgcagattctgaccttttccacgtctctcaggagctattgcgacttgcttttcgttggcattttccttaaccccatgcctaagttttagctttctccacctcattcaatcatttacctgactacttttgcatgatttccaattttccaaaaaattagcatattttgtccattttgtctcccaataatctctgaccttgtgggcctacactttttttttttttttttgagacggggtcttgctctggtgcccgggctggagtgcagtggcatgatctctgctcactgcagcctccacctcgggggctcaagtgatcctcctacctcagcctttttgccatgttgcccaggctggtctcaaactcctgagcacaagagatctgatctgcctgcctcggcctcccaaagtgttgggattatgggtgtaagccaccacaccaggcacaggtctatgcttttaaaaaaagatccattattagcctggttttactaaggtttctggagggagcagagataaatagatgtgctttatgttactgtgtgtaattcaaagtccaggacctagattattgcatgaattaacgggaatatactagccaaaacgattttctaagtcattctgtaaaatctatgagcttgttataccctaaatcgacttatttctaaattctagttctcatgaagtttggccatctttgccattttaacgtgtataatagttgagtagcattaagtacgttcacatggttgtgcaatctgcagagctttttcatcttgtaaaactgaactctgtgcccattaaacaactcttcttttgtgcctctgccagcccctggcatccaccattctactttctgtcactgtgagtttgactgctctgggtacctgttgtaggtggagtcatatggcatctgtccttttgtgtctggcttatttcacttaagcataatgttaagtaaaaagttcatcctaggccgggcgaggtgggtcacacctgtaatcccagcactttgggaggccaaggcaggtggatcacctgaggttaggagttcaagaccagcctggccaacatagagtgaaaacccgtctccactaaaaaatacaaaaatcagttgggtgtggtggtgcattcctgtagtcccagctatttgggaagctgaggcaggagaatcgcctgaagccgggagggggaggttgtagtgagctgagactgcgccactgcactccagcctggcatatgacatatgacaggacttccttcccctgtggggccgaataagattccaccgtaggtgtgaaaccatgttttgtttatccctccatctgttggtggacttttggattgcttgcttcttctgttgttgacaacactgctaggaacatgactgtgcaaatctctctttgcgatcccgcttcagttcttttggatatatgcacagcagtggggttcctggatcatatggtggctctatttttaactttttgagttaccaccatacgttttccacagcagctgtgccgtttccacattcccatcatcagtgcacaaggttccaatttcttcagtcttttttaaaaataaatacatgctccttttgagtacatttcaaagatagaaacattaaaaaaaattaaaatcacccataccctgtcctaccgtgagaattgttaacatttccttttctctaattttaagtaaaaatttaactttactggttaggagccagtattttgagtcctagtgttaggctgacctctagaggtagaactggcacattgcagccttctactagtgcctctaacctgacgttaactgttaagtgtggcaatgccacagcctggtatgtgtgtggcatttgaaaatcccggttgattggcacatcttttctaggtgtttatgtacgtcttctacaaagcttgatgcagaagttcttccaaaagaataaaaaaaattggaattaatctaactgggacaaaatgttgccaaaaggctgggtttgatttgtggcatgtggatttgttggccctaaagagaacacaggggtctgtctgcagatgtcggaagctcctccgcagctttcactggacgtccctcgggaccacacagcagggtcctggagtttgcagttggctgatgggttcatgtgtgaccgtgtctctccctcatgcccaggttctctgtcctacctgtgtgtgctgcccagggaggaagggcctgaggcagaaccaccactgcacattcctcagcctgagtctgctctgaaagaggcgagtggttgtgtcttttcttgccactgcttgctgtctccatgggacattctcattccggggtggtccctggaggatcgaggaacaagagactcctgttctcccattatctgtctaatctcatgcagtacttttgggaaaaaaggctaaaagtttgctttggattagtggaaaggtttgaagacgcacagctggcctactaaggcttggagcaggtgctttgagcacatcaggcgctcagacatagtttcctaaaggatgcaatggttactcactatgttcccagaccttggcatccagagaccctgtgtgtgttcagtggaaagatggttgggtgaggctgggatgatggcgctaagagattcatttaggttttgtttacttaaaaagtgacaaagaggattggcggtggttagttctggagggtggagagatgaggatgtttattattctttctacatttaaaatttcttaaataaattatgaaaaggaaatagtcttagaaaagcaatgggcgcagtattaaacatctcacttattcctccgtaacacaaaaaactttcaattaagctgaagtgagtttttgcttggtagctacaaatagctcttctgccatatgaatgtttttcttctggttgtgtttatgggcagtgtggttgtcttttaccaatgttgactccaaggcttagccactgctgcaggtcaaacttatataaatcgtatagttaaaaactgaaaaattcaaatgtgttgtaatctccaaacaaagtctgcgctaggccctttcaggctataaaggacagggtactctgatttctgctcttgatgagggttgattgtgataccaggcgagggagtaagagatacaggacaccatctctgcggctgcatctttgtcgcagaaacagacattgttcaggggacacctgagcctctgatagtcagccagtggctctggcagctcacagcagttatagggtggctgtgtccttttctaaagtcctgactttttatggcctgtggtcatggtgactccactacgggctgtgtttctgttgctccttcctgccctcaaccagtctgcccactgtggaagtctgcatttcttctccttctccttctccttctttcttcttcttcttcttctgatggagtttagctctgtcgcccaggctggagtgcagtggcgtgatctcggctcactgaaatatccacctcccaggttcaagtgattgtcctgccttagcctcctaagtagctgggattacagggatgtgcagcctcacctggctaatttttgtatttttagtagaatcggggtttcaccatgtttgccaggctggtctcaaactcctgagctcaggtaatctgcccacctcggcctcccaaagtgctgggattacaggtgtgagccaccgcgcctggcctgggtctgcatttctgaccgccctgtcgctatagggctcaggcttcccttgggctggttactgcagccaccaccggctgcctatgggcctctgccattggcccagattcacatgtggggtccagtccgtggaagtcatggtagtaagctcacatggcaagaaggtaatggagaatttcagaggcctgcctcggagcaccagttccaaggggtgcttgacagccacagctggcggctgctcagtcttgctaatctagagcttcgattgtaacagccaacccgagtctgtgcaagatgggaatctaattggagatctctgacagaagctagagttctctaacagctacatcattggcgaaaaagagaacttggatcccctaaatggagggtcaccggtgggggcattgactctgagtggaggggaggaagagtttctctgagaatttataaccatagagcaatcctcaaattcatactacctgtgtcatctggaaaacccccaagccaagaattcagattggttccttggttggtagcacccccaagtgcctggcaggagcaaattgcatatcatcctcagaacaatatacctgcaaccacagttagatgtccagatttttggcatagctttggatgagccagaactttacatggcaaatgggacgttgcagatgtaattgaattaagaatggcaagatggggagattatcctggaatagctggcttggcctggtgtaatcacatgggtccttagagggataaaggaggaaggagacatgatggcagaaacaggtggggcagggttggctggctatggagggggaaggggtcatgagccacggatgcaggcagcctctagaagctgagacaggccaggaatgcattctccctgaaacctccagaaagagtgcgttccctgctgacgctttgatgttagtctacttggggtttctgacctctagaactgtaagataatacatttgtattgtttaagccactgtttgtgataatttgttacagtagcaataagatattaatgctactgctttattgagataaatttacatgtcatacaattgactcatttgacacgtccaattcagtggttttatagtatgtttacagagttgtgtaacaacattttcaaagatggatcaaaacatactacacagtgaatgataaatgagctttggatcacatggtgctctcttttcctgaataaagccacttaagaggcacagtctgtgttcagggaagtgtgctgagtgctgttgatgctgaatcgcaggaccctgtaggacccgtgaatgtctgcgtttcctttttaccttaatagaggaaccttttctcatgaccctttttgttatatttccctccatgatgtttcaaatatctatttactggcacttaccttggaccagttcttttttgatttagctattagaaatcttaaatttctaatctgttgctaagacacctcatagtaccctatgcaactagtaaacttccagatgaactggccaagacacatatttggttttgtatatttttcactaacttacttttgttttttgcttgcttgttttttgagacagggtctcgctctgtcatccaggttggagtacagtggcacaatcatggcttactgcagcctccacctcctgggctcaagtgattctcccacctcagcctcccaagtagctgggactacaggtgtgcaccatcacgcccagctagtttttgtattttttgtagagacgaggtttcaccatgttgcccaggctggtctcaaactcccgtcctcaagtgacccgcctgccttggcctcgcaaagtgctggaattacaggcgtgagacactgtggctggcctcactaactttataagcctctaattcaaggaatttgttctatatgaaaatttgaaaatgcctgctcactggggatggtggtccaggatatttagtacttaacactgagttgttttgtgggtgatgagatctgagcagggatcagtatgtttgtccttataattgtccaaaataagatagctgttttatggccctattttaagataagtagatttttttaagctgatatattacgaatcttccaaattacttatatgagaaaaacatctcaaagattctttccttccttttaaaaaaatttagggccaggtgctgtggctcacgcttataatcccagcactttgggaggccaaggcaggaggatcagttgagcccaggagttagagatcaacctgggcaacatggcgaaaccccgtctctaccaaaaaatacaaaaaattggtcaggcgtggtggcacgcatgtgtagtccctgctacttgggaggctgaggtgggagatcacttgatcctgggaggtcgaggctatggcgagtcatgattgtgccactgcactccagcctgggcgacagagcaggatcctgtctcaaaaaacaaaacaaagcaaaaaatcaaatcaaaacaaaacaaaacccaaaaagcaaaaatatattaagaattttaagaagctaacagcagagcagtaaacccagcacaggcccttctgagcatggtggcccgggtgaccgcacagaccacatgccccgaagcctactctgctataaggtaccttctttcaatccttccatcccaggggactgacccaaggaagaggattaagaaccactgttttccaacatgcccccccaccccatcccctgccatgagattgtttcattttaaaaaaagtaattaagattttaagttgtggtaaagtgtatgtaataaaatttcccttaatattttaagtatattaagtatatttacattgttgtgctaccatcgccatcattcatctccagcatgttttcatcttctcaaattgaaactctggacccattaaaccttaactccccattcctcaacctccagcccctggcagctaccaacattctagttctgtctctgttattattttttcaagacagagtctcactctgtcgctcaggctggagtgcagtggtgctaccatagctcactgcaacatctgcctcctgggttcaagcgattctcctgcctcagcctcctgagtagctgagattacaggcacgcggcacaatgccaagctaatttttcgtatttttagtagagatgaggtttcaccatgctggccaggctggtctcgaactgctgacctcaagtgatccacccacctcggcctcccaaagtgctggaattacaggagtgagccacctagcctggcctgcctctattattttgactgctttagatacctcttctaggtggaatcacacagtatttttccttttgtgactggcttatttcactcagcagaatgtcctcaaggttcatccattttgtagcgtgtgacagaattttcttcctgtttactgctgaataatattctgttgtgtgtatgtaccatgtttttttatctactcatctattgatggatgcttaggttgcttctagctcctggctattgtgaataatgctgctgtgcacatgggtgtacaaaaatctcttggagaccctgctttccattattttgggtttatacccagaagttgaattgctggatcatactgtaattctgtttttgggaactgccatatctgttttccatagcggttgcaccattttacagtctcaccagcagtgcacaatggttccagtttctccacatccttgccaacaattgctagtttctatttttggtagcccctaatgggtgtgaggtggtatctcactgtggttctgcttggcatttccctgatgattcctgatgttgggctttatctgtttttaaatgtggtgttgaatactcacagtgatccttctctctgcctttccagaaaggagatgaagttgctggagcaggcaggttctctgaaaggctccctgagtgtggaagagcagctgtcactcatcagtggttgtcccaatatccaagaagcagtagagggtgccatgcacattcaggtgagtgaaggacactggcgccgcatctgtggggcctgagacattgtctcccagcctctccggaggaacagggcaggatacagagcagtggcaggtgtgggcattttgcatcttcaagggcaggattttgttttatgtgataggaaatgtgatccccaaaacaccctctatcctgggttctcatcaaactagcgtgacaatgttctgtttcaagagaccaatgccttatccgtgaggccactagggattctggtgacaatgttgtattttagaggcattaacagttttagcaaaaataggttttctggactgctaatactattttattttgttttatcatcttatcaaatgacagattatattattgttctcatatgtaattgagcaaaagcttacatcatcaaaaagaaaacctttcacttgcatgtagcctttccaacaactttactttaaaaaagagaaatcctcatgagggttgtttgcacagcgggatgagcctggagaggtgagtggtccctgcaggtggagctgggagcagcccctgtggcttggccctctttccaggcatcccgctcctggagctcctgtgcccacgcacaggccctgccctgttgaagaatcctgaggcatacccttgtcttttcaaaggctgcacttactgctataaggtttatgcaaatttacctaaagctaaaagagtcattattcccagtatctttccttgatattttgtgttctgagatttgcacatttcacgtcgttactctgttgatattctagctgagaatttggaagcaaaccgaaaaggctgtgtgtgttctctggtcatttcctgctctaagattcgggtcaaatacagaagatggagattttaggtctctatgactctaaaatttcttaaaattgttaaattctcaatttgctaaaaattcattaaacaaatgtgtgtcacaacagaacacaaggagaggactgtttttcaacttcttatctctttctaatatattatcctctatctcttgatatggtgaagtttgtatgaagttgaagggactttaaagagacctgagggctcctaatgagttcccagtgccacctgtttctacccgtagttgcaggtgctataagaggagttgcttctgaagagcacagatgttctccaggcctggtcttggcagagttgcttctgaagagcacagatgctctccaggcctggtcttggcagagaagcttctttcacatgaatttagttttattttttatttttttgagacagagtcactctgttggcccaggctggagtgcagtggtgtgatctcggctcattgcagcctccacttcctggattcaagcgattctcctgtctcagcctgtggagtggctgggattacaagtgtgcaccaccacacccagctaatttttgcagttttagtagagacagggtttcaccatgttagccaggctggtctcaaactcctgacctcaagtgatccgctggccttggcctctcgaagtgctgggattacaggcgtgagccacggtaaactgcatgagttaagttttttttgctttttgttttttgtttttttttgagatagagtctcgctctgtcacccaggctggagttcagtagtgtgatcttggctcattgcaacctccgcctcctgggttcaagcgattcttgagcctcagcctcccaagtagcttggattataggcataaaccactgttcccagccgtgagtttagtttttaaggaaagtatttagttatataatgtgattgaaatattaataagtgatctattattataatatttctactttcacatttcacagaatgcttttgttcaaactctgggctgatatctccaacttcagcatgtttgtcttcattacaatcactttttgagtctctctgaacagagttcccagaccatgttacctttgcctcttggagatgtttgctatgcagagctttttgaacccatctacaatgctggcactgcaaattttatccccagcctcaaagactaattctcaaacatttagatgttttttccttttgtaataatacacttgtgattccatagcatggcaacttgctgtgcttttttttttcttttaaagaatctttctatagctactttataaatttcctagcagtaacaattgtaaagtcatcccctaggaataattcatctatccatgttaaatttctttgtctccccatcccatttttttgatagtttatcatatgatttctataaacatccaaaactaccctaactgaattagttctggttaatgtgtctccctcaaagagtatattgttttttataaagtggtgaaccctccataatatgagaacattataatagacttgggtaataaggcaagtttttctgttaaagagtaatttggggggaatatgtgaatttagaaggcatgtaaagcacttacatagtacttggcacacagaaaatgctcaggaaatggtaattattttataatgtggccatttataacaattttggtaataaagaatgacatggggcagtatatggcgttctgtacatggttggcactagtgaaaactgctctttaactacagtctatctttattttatagattaaatgagtgtatttacaaggcatgacatgttgagccatatctattatgtagaacacagagccaagccggatgaggagaggaaactagagaaagatgatgtaaactagtaggtttaattcctatgagagtttatattcttcagaaattgttgtacctccagtaccagagaaaggagtgggtaggaatagttctgaccgggaggcttcgggaaggtttaatgcaggtaggattagagcttgtcttgacttttgacaagtggattttggggtgggggtgggaggattgtgtgggaggaagagatgaatgagatgagaagtccctttgaggatgtttctaaggccacgttacagacccattggaaaggtaggaaaggctggtccaaggtggaaaccaagtcgccatgctacgaatgccaacctgaagaattacttaggtgaattgagtaatacacagtgcttagaggagtacacgaagagaagcaccatttatgtgtttctttaaagaaataaagatgaaggctgggtgtggtggctcacgcctgtaatcccagcactcttgggaggctgagggtggcggattgctcgagctcaggagttcaagaccagcctggccaatatggtgagacctcatctctactgaaaatacaaaaacttagccgggtgtggtggcatgtgcctgtggtcccaactacttgggaggctgaggtgggaggatttcctgagtctgggaggtggaggttgcagtgggccgagatcaggccactgcactccagcctgggcaactggagtaagactccatctcaaaaaacaaacaaacaaacaaaatattatgagacctgaagaaaaaataattataaaaaaaataaagaactaaagggtttggatttcaatctaagtcctgattagaatcctgcaaggaaggtatttagtaggagaatgaaatgaatcagaaggaaagatgagtaagaaaaaagaatcagcagttcatttttgccagttaactgattttcttgggcatgtttacacatttcttttcttttcttttcttttctatctttcttttttctttgagatggagtctggctctgttgtccaggctggagtgcagtggcgtgatctcagctccctgcaacctccacctcctgggctcaagggattctcatgcctcagcctcctgagtagctgggattacaggcatgtgccaccacacatggctaattttttgtgtacattttttaatagagatggggtttcaccatgttggcccggctgctctctaactcctgacctcaagtgatccacctgcctccacctcccaaagtcctgggattacaggcatgaaccattgcgcccagcctacacatttctttatatgatgtaaagcaaatttaatcctctgaattttaaaactagtgcataggctgggcgtggtggtccacacctgtaatcccagcactttgggaggccaatgtgggcagactgcctgagctcagtagttcaagaccagcttgggcaacatggtgaaaccccatctctactaaaaatacaaaacattagccaggcgtggtggtgtatgcctgtaattccagctacttgagaggctgaggcatgagaatcacttgaacccaggaggtaaaggttgcagtgagccgagatggagccactgcactccagcctgggcgacagagtgagaccttgtctcaacaacaacaacaacaacaacaaaacctagtgcatattagtgtctcaggtttaccaaacaaacaagtaaatgaaacccccagagtgaaacctacctaatgctgccccacatgtttgttaaagtacattagtgtttctaacacaatgtaatgttaaacatgtatcttacctaattaaacatctctgtgttgtaaagaaagtttaggacaatcctgtttaggttcattattccaaaaatactgaagatttttgtgtatttatatgtttccacttctcctgtttattttctctctttctaatacatttgagattatactgtaaatagaattttgcatcatggtttttatttaaaacttagaacatttcctgctgtacgatgtgctcggggctgtatcagagagaagtggcacaatcttggctcactgcaacctctgcctcctgggttcaagcgattatcgtgcctcagcctcccaattagctgggattacatgcatctgccactacacccagctgatttttgtatttttagtagaaacagggtttcactatgttggccaggctggtctcgaactcctgacctcaagtgagacatataatttttagacttaaaaaattgtgatagtcaccatttgatggcaaacctgaaagaagcttccgtctaagaattccattaaagctgaggttcccaaagtccgcagcctctgccgggctgcaaccactcatctgctggcaaccactcacccgccctgtggtgctgcctcatctcagggtccacagactttttgccagtggcaccctcttagcagctctcacagctcctttttctgatttatacaagggaaggttctcagtgtagaaaaatcaatctaggctacttggagacagttttctttttttaaaaaaaattaattgctgtattttggccaggcgcggtggctcacgcctgtaatcccagcactttgggaggccaaggcgggcagatcacgatgtcaggagatggagaccatcctggctaacacggtgaaatgctgtctctactaaaaatacaaaaaattagccaggtgtggtggtgggcacctgtagtcccagctacccgggaggctgaggcaggggaatcacttgaacctgcgaggtggaggttgcagtgagccaagatcgcgccactgcactccagcctggcgacagagcgagaagagggctggatgtggtggctcatgcctgcgatcccagaacatggggaggccacagcgggtggattacttgagctcaggagttcgagaccaacctgagcaacatggtgaaaccccgtctctaccaaaaatacaaaaaattagcatggcatggtggtgcatgcctgtggtcccagctgcttgggaggctgaggtgggaggatcacttgagcccaggaggtggaggttgcagtaagctgagatcccgccactgtactccagcctgggtgatagagtgagaccctgtctcaaaaacaaacagacaaaccaaaataaaagaaagactgtacagagctcttttagaatgatgatgtggtacgttacagtccaagtgagaaagctgacttcatgttgatgatatggtcagtccagatggcgtgaacccaggaggcggagcttgcagtgagccgagatcgcaccactgccctccagcctgcgcgacagagtgagactccgtcttaaaaaaataataataaataaaaaattacttgctgtatcttaattgtacatatttgggattcatgtgtgattgatttgtgtgttcagtgtgtcatggtaaaatcccggtgtattaggatatccagaacctcacacgtttatcttttattgtgttgggaacactataaatcttctattttgaaatatataacattattaactctaatttccctactgtattattgaatgctagaccttgctccttctagcgaactgtattttgtactcattaaccagcttctcttcatcgctccttccccttcctggtaactgccggctgcgggtgtccaccattctactctctacctccatgagacccactgctttagctcccctacatgagtgagaacatgggatcttcgcctttctgtgcctggcttacttcgcttaatataatgatctccaatgccatctatgttgctacagttttcttataaaatatgttgctgtggttttcttataaaaagaaaattattactatttagggaattgttcacaagcaggaggcagagtttgaggagacgcgtgtgtgcgtgcgcacacacacgcgcgcacacacacacacacacagactgcttgccacaatgcttcaactaaaaataatcccactgtcggatctgcccagccccagggggcgaagcccagtaatgggagtgtggttttccccagtggattgttttctacccaaccctagagggcggggagcctgggtcaggacgtttcctaatactctgctgaaatccgggagcacgcaagaaagaaacctgaatttctagaacttagtgcaattttgaaatcaaatcttgcctggcaagaaaacctactgttctggaaaaataagtttactctgaaaagctggtctcaagccttgacttttaaagcacattaaagctcattagccactatgtcgaggccttatctaatctctggaacttaaaaccggagatcacagtagctggtgggagccatgggaatgatttatagagttacgaagtttaaatggggtttccttacacaaagtcagaacaatctgcaatagctgaaatcgagaagttaaatggatattgtctatgtagatgatcagaatttgcatctcaactatatctttaaaatggagagaatgctaatcattttgaaaaggaccttcagacactgtcagtaattacaggaagtagcgttcttttggaaatttatttgttttcttaaaggattgttggactttcagtcttggttcactgagactcagaatatttcttcttttggtagagatgggtgtgggggtggggggttcaggcagcattggacacatgggatggccagccctgagaatattcgggaatgtgcgaggaaactggagttacactttttctgttgtatgtgttttttctttttcctttcgagatggagtcgcacctttgtcacccaggctggagtgcagtggtgcgatcttgattcactgcaacctctgcttcccgggttaaagcaattctcctacctcagcctcccaagtagctgggattataggcgcccaccaccatgccgggctaagttttgtatttttagtagagacggggtttcatcatgttggccaggctggtcttgaactcctgacctcaggtgatctgcccgcttcggcctcccaaagtgctggaattacaggagtgagccaccacgcatggccatacgtgtttttttctttaaaaactgtaaaatcaggtttacaaagatataatttccatacaagaaaattcactcgtttcagggttcagtgctatgtgtctgacagatgcgtacagtcacgtatgaaatcagcgtcacagctggggttcagagcatagagcctctccttccctttgcagctaatttcctcccaccgttccccaggccttgcccaccactgatctgttctttgtccctatagttttgccttctccagaatgttatgtaaaatggaatcatacatgatgcagccttttgagtttggtttctttcacagagtaaaatgaatttgacgtggcttgtgtggttgtgttgattggtaatttgttgctgagtggtatgacattactaaggtgcgtgggactctggatggactggggcaagcccacctcacacactcacgagatcatctggaagcacgagccttcagttttcacttgcgaagtgtgaaaacattctgtcctaatgttctactagcttcctgccacagcccttacttttctgatggcttgctcttgctttattcaaatagtgtgcttacagaactgggcacgaggtcttatttctgtgaagctgtatttttatttatttgcttggctttttttttgtagtatgtatagcttcaaagatataatatgagcaagtaatgaaaaatgttatacattcaagagacaggcaagtttttctcttaatctgtaattatgtatttatcttcttctgtgaccaaataggacttgaaaaaatgctaagtcaaaacataagaaggacagtaaaataaagtcttagaagaggagggcatcctcattgcattcagtgtgcctgcaggtgaggactaaacatggccagcattgtgggtccccgcagcatccacgaacggcaggttattggcatgatttgcgctggcaggccctgcagtgatggacgaggcagtgacctgcctgtgtctcagacatcgtgggacctgcaggagcattaggaaagtactccaccatgatttgttctctttggcctctaccttgtggggtggagtatgaagttatgtgtgctggagcagaatgttagaaggcaacaggctttgatctttgccaggaagcctggctcaaggtcagcgttagcctgaatttctactttacctttcagtttgggcattttggcttttcccccttcacaaccacctgccaatggaagacggtaatttttttttttttgagacagagtttcattcttgtcacccaggctggattgttggctcactgatcttggcttactgcaacctctgcctcctgggttcaagtgattctcctgcctcagcctcccaagtagctaggattacaggtgcccactgctacacccggataatttttatatttttagtagagacagggtttcaccatgctggccaagctggtctcaaactcacctcaggtccgcctgccttggcctcccaaagtgctgggattatagacatgagccaccatgcctggccgtgcattttttcaaagaagtaaatgtttcttcttcataatgtctttaagtctggaaggctgggatctagctgtgttgcgattttgacttaggtgttagggagtggatggggaggtcacctggtgtgttcttgcagcagtgtaggaaaatgtagttcttggtaacagcttggtccatgacttcttgatgaactgtgtgccgtgggagagcgcaggggcagccccagcatccctgtctcaacactgacatactcaatgctctgtccccagggctgggccagccagttttccttccagggttctttaggacagaaaccctccctttaaaaaatattatctataaatattaacaaagtttgcatgctacaaagaggaagacatgcctaattcaattcctctaatacccatttgtgacattttaatatatttacctccagccttttttccacatataatatttataattgtaatgatagtgtgtctttatagatacagtgtcatattctacttatattaatcaacatttaacactttctagtggctgtgtaagagtctgtcaagtggatgtatcaactaagtcaaatatcacctagaaaataatgatcttatggctacttccagtactgtgcgattgtaagttaaacttggttgatcatccctctatctcattcttccatgctttttgtgactttcttcagggcaagttcattcatagggaattactagatgtaagcccctttccagctcttgataacattttgctgagtggcattgtaaaaattgccagtacaccttcaggagtcatgtgttagcacagttggatttcaagcttgccagtgttgggtctgctgatctttaaagtgattattaaagtgttacttgaaaacattgtcccagtttgcaacaaccaatgtggcatcatcccaacatccacattcttaatttggttcctaaaatagttttaaccctaaatttcctctaaacttaaacggaatctcaaatccctatttaaaagaaagatggccaggcgcggtggctcacacctgtaatcctttacaggtgtaaagggaggccttacagacttggggaggccgaggtcgggggatcatcaggtcaggagattgagaccatcctggccaacatggtgaaaccccgtctctactaaaatacaaaaaaaaaaaaaaattagctgggcttggtgtggcgcatgcctgtagtcccagctacctgggaggctgaggcaggggaatcacttgaacctgggaggcggaggttgcagcaagccaagatcgcgccactgcactccagcctggcaacagagcgagaagagggctggatgtggtggctcatgcctgtgatcccagaacatggggaggccacagcgggtagattgcttgagctcaggagttcgagaccagcctgagcaacatggtgaaacaccgtctctaccaaaaatacaaaaaattagtatggcatggtggtgcatgcctgtgatcccagctgcttgggaggctgaggtgggaggatcacttgagcccaggaggtggaggttgcagtaagctgagattctgccactgtactccagcctgggtgatagagtaagaccctgtttcaaaaacaaacaaacaaacccaaataaaagaaagactgtacagagctcttttggaaggatgatgtggtatattatagtgcaagtgagaaagttgacttcatgttgatgatatagtcagtctagatggaaaccaaattgtcccttctgctttaaaagttgtaggttgttaaattaatgcccaaagtcaaaataagcacatatctaatagaaacaattttataaagtctgttaagtagaaaatataaatataagctaagaaaatactttttgatcttatcactaggttaaaaacatgataagcccattcaaaagtggtcatggcatacatatttaatgcttggaaactagtaaacactttagcaactataatatttgcttctagtcattttttctagagtattttactttctgctgttagcaatgggagatggttatttatgaagactgttggatactgtgtgctacacagaatacaccatggagcctgcccatatatatttttatatacatatatatatatataactacgtaatatatatattataaaatgataatatataatatactgtaatatatactataatacatatggtagtatttatagtatagtattatatattatcatataatatatattatactatctatatactatagtatattatattttagtataatatataatagaatacataatggaatattatatattatctattatacaattatatattatctagtatacaaaataatatataatataaaaataattttttaaaatttattatatatatttttaatatatttttaaaaatatttttatatatttaattttaaacattattaaatgataatatgtaatattaaatacaccatggagcctgcctgtatatatacctactgtgtgtcaatctcttactatgggccaggtcctgtgccgcccattttatgcaaaatgacccacttcagtcctcaggacgcccatgtaaagtgggtgctagtatttattccatgccatgcccgctctccaaccccaatcattgttgcctgcacacctcaggaatatttttgattgttttacctactgctatttctccaacacctaaaacagtgcctagtttatacaaatattatatatatatataaattaattacttaagatttttagagtcaaggtcttgctctgctgcccaggttggaatgtagctgtgtgatcatagctcactgacgtcttgaactcctgggctcaagcgatcctcccacctcagtctcccgagtagctaggactacaggcatgtgtcaccacacccaggtaattatttgttgctgtttttgagacggagtcccgctctgtcgcccaggctggagcgcggtggcacgatcttggctcactgcaagctctgcctcccgggttcatgccattctcctgcctcagcctcccgagtagctgggactacaggcgcccgccaccacgcccggctaattttttgtatttttcgtagagacgggctttcaccatgttagccaggatggtctcgatctcctgacctcgtgatccactcgcctcggcctcccaaagtgctgggattacaggcgtgagccaccgcacccggcctacacccaggtaattttttagtagagtcgaggtctcactgtgttgtccaagctggtcttgaactcctgggcctaaacaatcctccagcttggcctcccaaagtgctggaattgcaggcataagctacctcgccctgctgagcctgcgtttttaagaggtatgaggcataagcgggaatctgggagcttcatgttaatgaaaagtaagggacacctgcagaactcggtgctggccctgctgcatgtttttcttccggcttgggctccctgctgctcacctagcggtatcagcacgctgggagcatatctgctgacgcagagctgccttgctgtgtttattttcatttgaaagtcaatattcaaagacttgttgcccagtaagtctgtttgaaccactgggggaaatcaaaaggtttctttcaaggggcggcctttcacctcttatgggtctggttgacctgtatcagtccctgctgcccagcagagaccttcctgcctttcgtttttcctttttttttttttttttgagatggagttttgctctgtcacccaggctgtagtgcagtggcgcgatcttggctcactgcagcctctgcctcccgggttccagtgattctcttgcctcagcctcctggtagctgggattataggcacatgccaccactcccagctaattaccttcctgcctttcagaggccctggcgttcagcaagtatcgcattgcacatttgtgtgtgggaagacacctgggacactggagtagctatttctgttgttttggcagaggaggctgctactgtggtttcctctgagagacctactgtggtttccttccttcctgccgcgtgcgcaggacctgccccggaactgccgtgtgcgtggggcaggtgacacaggccaggatgaggctgtggccttcctggagcaagtccactttccactgactgagtacacttacacagccttcctttaacaggctctctgcctgtgatttgtggatatgtcaccgggactcgtcctgcggccttttgcttcttgctttgctcgcgtttgaaggcacttgctatcttgccatcctagttggtaggtggtgggtgggaatcttccgctgaaagggtccctggtttctctgagcctggccagagccagttgcacagcatcaggtgattcccctctgttcccaaggcctcctgaggctgatatggctcttctttagtcttggcctatgacccgcagctaatgggaactactgtgcatccatcccttaccatggaccaggtcctgtgccacactcttaacacaaaatgacccacttcagtcctcacgacacccccgtaaagtgggtgctagtatttattccatgccatacccactctccacccccaatcatttttgcctgcacacctcaggaatatttttgattgctttatctactgctgtttttccagtacctaaaacagtgcctggcatgaggcaggaacttaataaacatttgttgatgactgaatggattatctgtttagaaatgacaggataaagatctcaccccagagcccaaaggtggaatcagcctttgggccaggtcgcttggactccagctggaacctgcatgcctgccacccctgccagggagggagagacacggggtgtgatggggtctgggaatgcggggaggccctcttcccggtgctcctgaggtggcggatggctccctcctccctgtccagttgtctgctccttccctgtccctgtagcctggtgatggccatcctgtctgtgaggctgacttctgactcgccactctgggcaatggacatcgcgagaggactttgctgccctgtgttccgggtgttggagggtgaaggaggctgcgcacgggtccagatgctgggctgttagaagctagagtggatggaccaagagttcggagcttgcttgaccctgaggcaggggagccttgtccctgagactttgggagctgaatcacaagatccagagttgaggaggtcaagattgttaaggccaaatggtctccttccctttactgaaagtaaaggaggctggggcaagtccaggcaggtgacggtttctccagcaaacctttctgggctggtcattggctgagggccctgggaggggagaggaaggttgtgtgtgtccccctggacacagctgagccaggagcactctgagtgtgagcagcttgggagtcgccgctgcctctgaggggccaggagcattttatttcttcccaaggtatcctctcatcttttcctcaagctgtcccttgaaatacttggtttggctgtggaaaaatattactaattacaatcacttacatgaacaggaactccatgcagtaattatgcatcttgtcaaataggggctgactggctcttggtaagccttctgagggcgacacaaaatttttcaagtgtgtgttgctttaccggtttgttgcttgtggaatatggctctctcctcccagctcagatattagaggaagcctacatcccatccctatgcagcaacggctggggacgggacagggcaggtgggcgtgagagctgcctgctgccggcgctggtcccggaccggaggtttcctccgagatacctagtgagccctttaaaggccactatgatggctgaaagtggaggaaattatgaaaaatatattgtcagcatcttaagattctgactcttgtatgcttttaagtggaacagtttccaggagccatagttgagctctagctgctgctctctgtggaattcaggacgtgcccatgcctttctcattgtgcccagatgtttttattcagtgtctgtccccttcccagcccagaggtagggaatccccttcttcagagaagaagaaatggaagccgatgcctgtcattaatagccatgtgggtgaccctcaatgaaattaccctgttacttatacccgattcacttgctatgttaactaaattaccctgttacttatacccgattcacttgctgtgtttttggtactttcctgagacgttagaatccgtgagagccattgttttattgtataaatcatgatgaaaagagaaatggaaaatgagttatcttgagtcttaagtgaactgtttttgcttttcctgttttgttttgctctgggtgggatgtaacgtcagcttttacacctgtgttgcaagtacctagccccactttcaccaacgggctccttctacgttgtttgtactttcgtgaagcacaccatgttatctgtgatggccaggacggtgggctccgtgaagccccagacagacaccttggcatccaagtgtgccctctactttggagcgccatccttggcgcccgcccacccactctggccaggtccgctgagatcacaaggctgcctctggctcttctagctgaaggccagttcagaggtctcaggctggtaccaggggccgagtctggccatgtgcagctttaaaaataattgttcatttgtttgtttgaatgactcactgatgtttaaaagtctggaaatttccacataaaatatagctgtctcacagctccttaaagtccgacgctccggccacagtgagcagcatgtgggtgccgcacagtgggactgcgggtctccccgccactcctgccggctcctgttcgtggctgtacattactgtttacgctgtaagtggagaggaaagcgaaatatttcttaaattcctatttcaatcaaaagtgggaaaacaagaattagattgcagactaattttacctcaccttctttaactcactcactgtctctctgagcagtacgggcactcgagtttgctccactggccactccacccccgttccaccaaagagactggatcttggacccccaaatcctaacatcccgatggcaagaagaggcccaaaagtgagtccaaaaagcgattgcacctcacaaacactgagagcacaacgggcttcactccttgacctctctcctctgccctcccctccctggccccagccaaagtcctgtgatttcctggggtgcctcctttctccccagcataccagcatccatgtgttgttccagctgtctgggacctgggagatgcagaaggtgttcgagcagagcgaatccccaccctgcgaacctcagcttcttccagtgacaggcctgccccagtgagccagtcccaggcctcagagggccacgcgctgtccttaagctatcagaatcccatctttttagaggtaaaggcagtggttgggaggaacctttgactctagctagccttgcccgtacgttaggagggcacagccagcacttttacaggaagcttagaaaacaagttttctcatctataaaatggagataatattagaaaccaccccctaaggctgtattgaggaggaaatggctacgatgcgtagtgcttagaagaccatgcctgtagtaagagtgagctatgacagctgccctccctcagattctgcatcgtggattcagccaaccacgacttgaaaatatttggcaaaaattgtgtctgtgctgaacatgtacatattttttcttgtcattgttccctaagcaatacagtataacaactatatacatagcatttacactgtataaggtattataggtcatctagaggtggtttaaagtatataggaggatgtgcacaggtgatatgaaaatactaggccattttttaaaaatcagggacttgggccggatgtggtggctcatacctgtaatcttaacactttgggaggctaaggcgggtggatcacctgaggtcaggagttggagaccagcctggtcaatatggcgaaacccggtctctactaaaagtacaaaaattagccttgcatgttggtgggcgcctgtaatcccagctactcaggaggctaaggcaagagaattgcttgatcctgggaggcggaggttgcagtaagctgagatcatgccactgcattccagattccagcctgggcaacaagagtgagactacgtctcaaaaaaaaaatgaaagaaaggaagagagagagagaaaaagagagagagagggaaagaaagagagaaagaaagaaagaaaaaaatcagggacctgagcatcctcgaattttagcatccatggggttcctggaaccagtgtctgatggatcccgggggatgactgtattattaataggaaagtgggaaggagcacctagaaacctggtttcctaatgtaaccattagcatcaattttgcatttcctttgtcttttcctttttttttttgagacagagtctcgctctgtcgcccaggctggagtgcagtggtgcgatctcggctcactgaaagctcagcctcctgggttcacgccattctcctacctcagcctcccgagtagctgggactacaggcgaccgccaccacacccggctaatttttcgtatttttagtagagatgggttagccagtctctactaacaatacaaaactaacacttcaccgtgttagccaggatggtctcaatctcctgacctcgtgatccacctgcctcggcctcccaaagtgctgggattacaggcgtgagccaccgcgcctggcctgtctttttcatatacatgtttttgtttgctttagtacacagttgtcatcaaagtgaagaagttacttaatgtaagtgttccatgttgcttcataatcccatagccacttccgtaatagccacgtcatactctttcacgtgaatttacgctaacacacacaaccacccccgtactgcagttcatttgttttgatattatttcactcttctgacacctttttgatggctgagacaacttctatgtattgtgaataattttgttcagaatactttccattaagtgaaactcagaccagaggttataagctcttatttttttttaaagaaagattcttcatatgtgtgtcatgggtttttttttttgttttttttttttttttgagatggagttttgctctttttgcccaggctggagtgcagtggcacgatctcagctcactgcaacctctgcctcctgggttcaagcgattctcctgcctcagcctcccgagtagctgggattacaggcgcctgccactgtgctcaactgattttttgtagttttagtggaaacagggtttcaccatgttagtcaggctgttctcaaactcctgacctcaggtgatccacctgcctcggcctcccaaagtgctgggatcacaggtgtgagccaccgcgcctggccgggtcatggtttttatagcttttgtcttgagactctgggaggaatgaagttttgggtttaaatgtcaccattcaaaatctgcttccccttcctttctgttctcatctgttgttagggaaaacaatgaactggttttttgtgtcagtctctggaaaaatagaaagtcctcagaagattggacgatgtcactgctcttgtccagctcagcgcctttgagggctggtgccttccctgtggtttcccagtgctggcagcccggagagcttggtgtggtctccttccctgcagcggccgctgcctgcattctggggaagcacattctatgcactgtgaacagaacagtgcttgaggctgtgcttgaacttgcacccggggccaggcctgagtcgcggcagtggggcagaggctttccatgaaccagaagggaggtcctgctgccccttccaaagctgattctcttctcttttaatgagactttgattttggcaacagtgggctgctgaatgtattgctggtcttgggatatttgaggaagaagaaagcctgctttgcagggaggacgggtgtagctttataccccaactccaggtgatcgcactgtcgatagtcttcttcaggaccctgaggcgtaaattagcgaacttagtcctgaacttctaagatttggcatgaatgctgtgtccctcccatccttccacttcatttttattagattccatttggtataatctaatggctgcagctttaggagaggggcttacctggtcgtagtccatcgggagcccagtgctttgccagcaagccttcccatggggccagacattggtgtgagatgagtgactggctcagccaagacctttgacaggtttcctggggctttgggttcctccttctcctaagcaagccataggaagaaattaaacgttgtcatgcttggctgtggggatcagaggtcatacaggcatcttgcttccagcctgagaataaacagataccggaaggaatgtatagctaagagaattctagaggaaggaaaagtcccagccactgagttaattgaaccccgagtccctcccagcctctggcctttctgtgatgtgagccactccatttctttattgtttaaggtgggttaaattagattgcacgtagctgaaagcatcctgactggtaaatatgataaagtatatgctgacccagacctgaacttctcaagggcttcctggtagcttttaaaatcctattgtaggttcagaggtgtaaaacattgcttgttttgtctgtggatttacagaagaaagatgaaagtaaatttgtgtttataaaggactgttgagcctaggtttgaattatgtgaacaaagaagttgaaaagaaagtcctaggtttgaacttgctttttctccttgacatcttcctatgtggtggtccatctgctttaggaaatggcctatatgtttttagacttccacaacttattttaatcataaagccctcaaaaggcaccagaaagtaagttgttggtcgtatctatggtagacacttaacacttcctgagaaactgctgacggtggatggagttgtaacagggatgccgtccaggggagcggagcttgacgtcgacactctccacttcttacctcacattattgtttcaggaagcctaaggtgatcgctctccgactcatagcactagatgctagaaaactaggtaaagggagcgctgggcatggtggatcacgcctgtaatcccagcgctttggcaggctgagttgggtagatcacttgaggtcaggagttcgacaccagcctggacaacatggttaaaccccatctctactaaaaaatacaaaaattagccaggcatggcggtatatgcctgtagtcttcgccactcaggaggctgaggcaggagaatcactcgaacccgggaggcagaggttgcagtgagccgagattgtgccactgcactccagcctgggcaacagagcgagactgcacctcaaaacaaacaaacaaacaaaaactaggtaaagggagaaggtgatatcagtgtctctagaaagaaggcttcgaagctggcttcttctttgttcagttaatggtcagtgaaatgaatcccactgtggtcactggtagattgttgaatgctggagataattgaatagctaagttcgacttcaacaaaaaagtaagttttgagctgagtgtggtggcatgcatctgtagttccagctactcaggaggctgagttgggagggtcacttgagcctaggagtttgagtcctgtctgggcaacacagggagacgttgtctctaaaaataaactaaaataaaaagtaagtttagaagagatagctgagttggagaagagtgcaaaactggaaaattgtaggcatgtttaacgccttaaaaaaatttcaaatggttacatgtttaattacagaaagacccagaataaaagagaataattctgttaaggcggcagttctcaactgttttggcaccagagatgggttctgtggaagacagtttttttcattgccaggtgggggttgggggaggtgcgaatggcttcaggatgaaactgttccactgctgatcataaggcgcttgtaagattctcatgaggagagcacaacctagatcccttaagtgtgaggttcacaacagggtttgcgctcctgtgagaatccaatgccacgctgatctaacaggaggtggagctcaggcgcacggctcacctcctgctgcgtggcctggttcctaacaggccagggaccggtaccagtctgaggcaccgggcgttgcagacccctgtgttgaagtattcatgtttatctttccagcccaatctcggctcactgcaacctctgcctcccgggttcaagcgattccactggctcagcatcccgagcagctgggacaacaggcgcgtgccaccacgcccggctaatttttgtatttttagtagcgatgggtttcgccatgttggccaggctgggtttgaactcctgacctcaggcgatccgcctgcctcggcctcccaaagtgctgggatgacaggcatgagctaccacgcaaggcccagatattttaaaagtgaacctcatagcattttcaatgaaatattttagacatacaaaaactcatagaataatatagtgacgactcatgtatatccatccaatttaaggagaaaaaaaaattcacaagtacaggtccctgctatagctctctttcctccacaagggattgtgacatgaactttgtcatttatactttctatgtgtattttttactacatgtttatgcagctgtaaataatatatagcatagtactgtggggttttgaactttatttaaatgttatactgtatgggccgggggtggtggcttatgcctgtaatcccagcactttgggaggccgaggtgggcagatcatgaggtcaggagagtgagaccatcctggctaacacggtgaaaccccatctctactgaaaaaaaaaaaaatcagccgggcgtggtggcaggcacctgtagtcccaactactcaggaggctgaggcaggagaatggtgtgaacgcgggaggcagagcttccagtgagccaagatcacaccactgcactccagcctgggcaacagagtgagactccgtctcagaaaaaaaaaaagttatattgtgtgacttattctgcaacttgttttcattcattggtgtgtttcatacaaatattaaacaatttatttatctgtttccctgttgacggatgtataaatattatcaaaaatgttgaattataaagagtgcagttatgcatattcctgtacatctcttcttacattcatgtgcatagttagggtttgtaattaagcatagactcactattttatgtagcaggtgcaacttcaactacacacacacacacacacacacacacacagagttttccaaagtaatataccagtttattttctcaccagaaccataagagagacagttaagtttgtgccagtctgatatgtatgcaatgataactcattcttttaatttgcatttccctgattattcaagggcttgtgtatttgagctgcttctgctttgtgtgtgcgtgcgtgtgtgtggatgtgaagtatctgttgtacactttgcccatttaaacaaaatcttttaatggttctttcactgatttataacaactctttaaaaattttagatgctaaatcctttaatatctgatcacattttgccagctgcccctgtctatagtgtccttttatgtacatacttaaaaattttttcaatgcagtcaaatttacccatcttttcctttatttcttgtggaccttaacacttgtttaagaattcctaatcccctctgtttggagattggggcgtatggaaggctgcgaggccatgcctataaaaaggcatatatccaagtgcattgtgttgctatgaaggaatacctgaggctgggcaatttataaagaaaagatgtttatttggctcttggttctgcaggctcttcaagaagcatggtgttggcatctacccggcttctggtgagggctttaggctgctcccacccatggcagaaggtgaagggaagctgatgtgtgtagagatcacatggtgaaagggagaaaagggaggtgatgggctttttttttttttttcaaccagctctcatggaaactaatagagcaagaactcattcatagcccccctccaggagggcattaatttatttatgtgggatccacccccatgacccaaacacctccctctgggccccacatccaacattggggatcacattttatcatgagatttggaggatcaaatatccaaacattaggagcatgtcatactgttgctgccagcattctggtaaactctctatggctcagggccaggtctttgccaagaggaagatcttcaaaacaatactgcagaattcgggagtggcatgaatccacccttttggagcctgccaagctgcagggtgaccggtgcctgcctctgttttctcttacccttgctcaggattaattgtcattgtcctctccaagagccagcagtgacgctttccaactgtttgtgcatggctctttccttccatagtggagaaagtgaaacctaacctccaaattactcctgaggtgctcctaggaactttttgcccaagcccaaccctagggcacctttgacatcttgtgtttcggttcattgcttaaagtttgttatttgtttctctgatgtgcagagatcatagtggtcaagtgacttgcccagagtcactcagcagggagtggggagtagttgcaggtttcgtgactcagtttagttttttgcttagtcccaagctattccctgctgcctgctgcgaaaccttgtttatctgtcctttaggccacttctgggcatgcttagagaatagttgggatatttaaaagtctgatatcccttaagctggagatattgtccagccttacagtgcttgtacaggactgctaaagaaattattctgctcctctacttaaactactatggagttgttggtgtgtcttttctaaaaataagagcaaatttaacctgaaatatttagaatctttttagttgactaaaggattcctgtcaagggacttatggtcagaaagcatcatcaaagttgctttgaaaaaggtgcagaggttttctttcagggatatggcgaaggcggctgtgtgtagcatgtttttgtcctgaaggaatgtgtttatattcttgaaagttttaaaggtttttctgacaccaaatggaatctaaagcaaaagagacaaatctacctgcgatgaatgcacttttgtgaggcagatgcaatgaacaaagtcagcaaatggcagatcagaaagacattgagagcaataaaaaaaattccaaaaggctaatgtataaataactgctacaaatgaagaaggatacaaacagcccactattaagatggccaaaagttatgaatgtctgattatcacacagaaatagattttaattattgaaattcctggtgaagcgctccccaagaccgtttctcctccttcttcctccttaaaggcaaccgttaccacaaatttgatgggtctccttctgtccatacttttagtacatatttctaacaatcagaaaataacagtaacactattttgtatgctttaaattttattttattgtattgtatttatttattttggagatagaatctcactctattacccaggctaaagtgcagtggcacaatctcggctcactgcaacctctgcctcctgagttcaagcaattctcctgcctcaacctcctgagtagctgggactacaggcacgtgccaccatacccagctaatttttgtatttttagtagagatagggtttcaccatgttggccaggctggtcttgaactcctgcatgtaacttgtataacgaacatatttatgtatatggaaatgtttatatttttgcaatttgcttgtttttactcagtcatatgctttttgagatctggtctgattgacacattaacacctttttattcatgttagttttatttattttaatgtcggttaacaggaatgggcacaattgacacagcccccatttgacggacacctggttcatttttatgtcttgcttttgtgtagagtggctctccctcgggcattctgcagcctctttttgagggttctcctctgcatggacgtagacaggcagcatttctggcttgcaggatttgtgcgttttcggtactactacatcttcgaataatgtcatattgtccaaaatgtgtcattttatacatttctaaatgtattgagttttcatttctccatatcttcttcagcacttggtatcatcagattatttagtttttccaatctgttgaatgtgaaatgataggtcatggtttcaatttgtgtgggaccccgagctagctacctgtccttgtttaaaaaagggcaggaagaggctctcaatttagaaagtacatgggtcacatttgcctttgagaagtctctccaataaatcagtttaacacctagttcagaaagggggtgataaaatttctccagtctattggaggatgagggtaaaagctcatgagacagaagtcattgggactgttatgctggttggcttcctttagagtgacataccagaggagaaggagtcttagatttttttctggagaaaaatcaatcactatgtgtcttaatcttacttggagtaagactgcaagcctgcatgtatagtgatctgtgttttcaaggtaagacactgggaaaaaactcaagcatcaatactggtcatctcttggaggtggagtttggttgaggtttgtctaaatttttgacaatgagcatatattacttttgtagagataaaagcatgtttattttctaaaaggcctttggtgcaggttgcctggtaggtgcgacacgcaggtctcctctgggctgcctgcacgggtgggagcaggccagcaggcgtccacactgaggctcaggaggtgggcagacccagcttcgggttctgctgccgtttcttcttagttacacgagcttgtaaaacagatttttccatttacaaaatgtggataaggtaagtatagcttactctgagagttaaatgaaaaggcatataaagtgcttgctgcgtaccaggtactgtttggattgctgggagatactagtaatgataatggttgacttttagagtttcttatgccaacagttttgcctgtgctttttcacatttaagtacaatttaggcacgtttggctaatcattaaggcagtgggatggtaccgttcctgcaggtattggaaaacctgcatcgtatgcctgctgctttaggagacaacaaactcagcagcccctcccccgaagctgaagtgccaaacttaaggctccaggtaaactgcccttccgatgagagctttacatttaggcagtagccacaggcctaaacaaagtcaaatggatgaaacttgtgatctctccttggaaatatggccaagagtgaaacaactacttagttattattttaaacgcaggctgctaaatggcttgtgttggtatgtaatggcatcctagataatgggggctgccaagaaaatattcacactggcaagtcaattaaaataccgttctcttcctaagaggcctggctggattccagagcttcctttagggtaacgctcaaacctgtcatagtttattttgtttctgttttcaggcaacagatttggttattgcttttattgtatgagtgttgaaatggtgtcctaacagccatctgtactgccatcccctgggcgcccccagggcctcccaccaggccatcctcctgcctccttctcccaccaggccctcctcctgccccctcctcccactaggtcgtcctcccactaggtcgtcctgccaccttatcccttccacaaggccctcctcccactccatccctcccaccaggccatcctcccaccccatcctctcaccaggccgtcctcccaccccatccctcccaccaggccgtcctcccaccctctcttctctccagactgtcctcctgacccctcctcccaccaggcagtcctcccgcctcctcctcccccaggctgccctcccacctcctcctcccaccccatccctcccacaaggttgtcctcctcccaccctctcctcccacaatgctgagcccctggaggcccaaaagcactcctgtgcttgggaagatggcttggcacctctgcagttctgggtactgctttcctctctcaggagacattctgttcaccttagacacccagtctcaagagtgtttctttctgggaggccttggtgaatgattcctgccccactcccaccagaatcaatcaggttttctcccacccccaagttgtttccatgatcctgagatggggtgagtcatgctgtgttgtggctttgtgtatctggccgtttctccacttggttctgagctgctggaggtgagaccgtggctgcctgctttgtggtgccagccttcaccccagctctggagcctcctgcctaaagaaagattggtatccagagctgccaggtctttttaataaagattaataaattttacttcatactacatataaaagtagacatgaaaaaagtaaacacagatggattaaataagaagacatctaagaaatactaaaatgttctagaagatagcataggtcccaaaacatggaagtaggaggacctcacaaagtgagatataaaaaccatgagcaaatgctggttttgtaaacattgaacctctgtggggcaggaggtgctatttacaaaatcagaagataagcagcagaccaagaaaaatgtttgcagtgtctgcatcatattaaaaaatataactcagtaagaaaaagacaaatgccccagtagaaaaatgggcaaaatataggaaccagcaattcaggaagaggaaaaccagagagtcagtgtgcatgtgaaaagatgataaacctcagtagcatttagagaaataaaaaataaaactacagctggctgtggaagtggagacagcggctaccctagttgtggtggggagggaggatccccaccgtgaggcccaggggagggcgccgctgggaagggttccttgctgcctacacgagccctttgtgtgaaaacccacccagctgtgcacttactatatacattcttctgtatgtatgtcacttttcaataaattagcaaattacttaactcttagaaaacagcagctgccggcggggcgcagtggctcacgtctgtaatcccagcactttgggaggcggagacgggcagatcacgatgtcaggagatcgagaccattctggctaacacagtgaaaccccatctctactaaaaatacaaaaaattagccgggcgtagtggcgggcgcctgtagtcccggctacttgggaggctgaggcaggagaatggcgtgaacccgggtggcggagcttgcagtgagccgagatagcgccactgcactccagcctgggcgacagagcgagactccgtctcaaaaaaaaaaaaaaaaaaaaaaaaaaaaaaaagcagctgcctattatttttgcctctgacataggcaaagattaaagagccaacacccagtgttgaggctgtggtgaagtggatattctacattgtcctgcaagtgtaaattggtaccaactttaagagaataatttggcaattagtaattgaaaaataaactatcgctttctatgctgtagtaatctgtggttcaaaaatgctgactctttctatatatggaggcagcatttatatctatgtatatacacacacacatatacatatatatgtaatgtggtgcaaggattaaatcacagtattgttggtcataacaaaaaataggaaacaacctaaaggcctgcagataaagaaatggttaagtattggcacatccatccatgggggtgcatgcagctgctaaaggtgtttttgagatattaagggtgaggggcaaattgctgaacaagatataaaatagaaaccatttttgtttaaagaaaaaaattccaaatcatttgtatatgtgtttgtataaactggaaaaaaagatctaagtgtttaacagcgaaggttgaatcggcaggaggaaagcagacagaccctcactttctacttcagataattttcctgtgtttgattttgttacagtgtcggtatttttattctttctttttcctttcaacttttattttaggttcaaggggtacatatgcaggtttgttgcatcagtaaattgcatgtcatgggggtttggtgtacagatagttttgtcacccggtaatcagcataatatctgataggttttcagtcctcaccctcctcccaccctccaccctaaataggccccaatgtctgttcccctctttgtgtctatgtgtactcaatgtttagatttcacttataagtgagaacatctggtatttagttttctgttcctgcgttaattcaattaggattatggcctccagctccatccatattgctataaaggacataatctcattcttttttatggctgcatagtattccatggtgtatatgtaccacattttctctatctagtctaccatggatgggcgtctaggttggttccatgtctttgctattttgaatagtgctgtggtaaatgtaacctgtgcatgtgtctttatagtagaatgatttatattcctttggctatatacccagtaatgggattgctgggtctaatggtagtattctcttttaagcacttcgagaaatctccagactgctttcacagtggttgaattaatttttttttttttttttttttttgagatggagtctcgctctgtcgcccaggctggagtacagcggcgtgaactcggcttactgcaagctccgcctcccgggatcacgccattctcctgcctcagcctcccgagtagccgggactacaggcacccgccaccacgcccagctaattttttgtattttttagtagagacggggtttcaccgtgttagccaggatggtcttgatctcctgaccttgtgatccgcccgcctcggcctcccaaagtgctgggattacaggcgtggtggctgaattaatttacattaccaccagcagtgtataagtattcccaatgtctgtattttaaaatgttttttaaaagggcacaattgaatgaaatttttaatatgtagcttttgagagattctactctgctttgttgtaactgctggtcagatggatgtagctgactgctttggcaccagatttgcacaaggcataaggctgctgcagaaatctgggtccagaacggcactatttggtgtccacatggcttttgagcacttgaaatgtgactggtcaaagctgagatgtgttgtcaggtgtaaaattcccactgagttttgaagacttactatttttaaaaagcgtataaaatatctcaatagtttttaatagtgattacatgttgaaatgtaatatttgagtttatgagttaaataaaatgttattaaaattaaggttagcattttctttttacttttttaatgcggccactagaaaatttagaattgcatgtatggctcacagtatatttctgttggatgctggtctagatgttaagatttcaaagggtccacggctccagaaaggaattagtcaagctcctgttttaattcttcttggggtgggacctgcccttttggttattgcttaaagggaaataaccactcctgttacttaggtttgtacctttgatcaaaaatttgcccagagaagtctattgtggttttgttagcacatttatttttaaacgtctgggaacatatttaatgaattgtctatgattgtgctatattgtatcttatctaagatgctactgattgtaagacatcttccaatttcagaaacattgagaaaaaatgtgcaaattagaatagatgacatacagtattatctaacccttgacctatttggtgatgtggctttcttcctgtggttggctggtaaatgaatagaaccaatttttttgataactctgtgcaaagacctttagaactggttgaatcactttccctaacgttgaaaacctggctttcgaggctctgccggggtcaccttttccttcccccactgagtacctggatagactgcacagatgacttctctgtgcttccgtttcaccctctgtgaaatgaagataataaccgtggccacaatcatcttgtgagtgagtgaaagttaaacgagcccatgtcagcacttggagcagggcctggtgcagaacaagcccagcaaagtgggccacagcttttggtcctttgaggttggtgtgttgttcccatttcatggattagggagctgaatgaccaggtttatatgtttagtaagtggtagatccagatttgtcttatgacaccgaagctttgctattgtcgtattgtttttctgagataaaagtaaacacttctcatgaagtaccacaggcttggtgatatgttttacgtaattttttctggaatcgaatgagtactgtatttcatctgacctcatttccacatcagttattgattcttaaaggtttagaatgaacattcaggataatcttgaagtctcattaattattagggtgtggccaggattatttttagccagtgagtttggtgagtacacctgtttcctgtattggtggaggtcatgccaggagacagaaaccacaccattaattggaacagggcaaatttaatatgaaaaattattaactggtaataagggattaacttctaactttagtgttctaaacagaacactaaagaacaccctaaggctgagagagaataccaaggaaagatgggacttggaggggtcacagcccagggccgaggctgtggtccagtggatggaggatgacttcctgttctctaggctgccctgggccagagctggaccacagaggctgggctgaggtgggtaagctgggactctcaagctgggactggaagctggaatccttgagctgggctgccagtgcactcatatcctgctggcagtctgcactggaagagcccaggaagagaggaagggaagccccttcatcccaccagactcctactgtcacaaagcagggcaaagaagcgtgggtgtgcagctgagaggcaaagtactgatgactggtgctggtccttcatctgacttccctctgctgttcagagtttcttcctccatatccactctctcccagagtttccctgtgctgggtcacccaggaaggtgcagaaaggccatgaagagtggggggtgggcaggtcgtgtaacaggagcatagctggctaggaagagaaggaagagctggggttgctaagaagggcattctggggtgtgtgtgtgtgtgtgtgtgttttaagaatcgtggtctttgtgtgtgtgtgtgtgtgtgtgtgtgtgtgtgttttaagaatcgtggtcttgcccaggcctgagtacagatcatagctcactgcagcctggaactcctgggctcaagcaatcctcctgcctcgcctctcttcttttcttttctttttttttttttttttgttttgagacggagtctcactctgtcacccaggatggagtgcagtggtggaatcttggctcactgcagcctccacctcccaggttcaagtgagattctggtgcctcagcctcttgagtagctgggattacaggcttgtgccacaaccccagctaatttttgtatttctagtagagacagggttttgtcatgttgcccaggcttgtctcaaactcctgacttcaggtgatacgcccgcctcggcctctcaaagttctgggattacaggtgtgagccactgcatccggtcattgtattatttcttaaaattttttgcctaacccaaggcctcacagattttctattttagaacatttatagtttaaaattgtacatgtatggctatgatccacctgaattaatttcatggaaaatataaggtatatactaagttacatttctttgcatgtgaaaacccagttgtccagcaccatttgttgaaccctatcttttccccattgacttatctttgtatctttctaagaaatcagctgcttagatttgtatggatctatcgctgggctctctttatataatattgatccatgtgtcagtgtaacagtatgtgcccatattactttctcttaattactatagctttatattaagccttgaaattagatactatgtcatccaactacttttgcaaaatggttttggctattctgactcctttgccttccatatcttagaatcagtttgttgatatctacaaaataaacttctgggatttctattggggtttcagtgaatcagtacatcaagttcaggagaactgatgtgttaacagtattgagtcttccaattcatgattatggtatagcttgagttttccaattcatgattatggtatagcttgagttttccaattcatgattatggtatagcttgagttttccaattcatgattatgatgtagcttgagttttctaattcatgattatggtgtagcttgagttttccaattcatgattatggtatagcttgagttttccaattcatgattatgatgtagcttgagttttccaattcatgattatggtataacttgagttttccaattcatgattatggtgtagcttgagttttccaattcatgattatgatgtagcttgagttttccaattcatgattatggtgtagctctccactttatgtaggcctcctttgacttatttcatcagcatttcatggtttcctgcatatttaaggcatttttttagatttatgcctaagtaattcttgtgtatgtgtgctattgtgaatggtatttaacattttttttgattttccattattaattgctactgtgtagaaatacagtttttttatattgacctgtatcctgcaatcttgctgagctcactagtccttggacttcttcatagattctttgggattttctatgtaggcatttatgtcttatgtgaatagagacagtttcattttcaatctatatgctttttatatctttctcttgccttattgcactggctaggacatcaatatgatgtggaataaaattctattccggaatagaatctgtccagcctgggcgacagagtgagacagcttgccttattcccaatgttaaggaggaaagccttgaatttttcaccattaagtgtgatgttagcataggaataatagctacctttcatcatgttaaagggattcccatctattcctagattgctgagagttttaaaaaatatcatgaatgggtcgggtgcggtggctcacgcctgtaatcccagcactttgggaggccgaggcgggtggatcatgaggtcaggagatggaggccatcctggcgaacacggtgaaaccccgtctctactaaaaatacgaaaaaaattagccgggtgtggtggcaggcgcgtgtagtcccagctactcaggaggctgaggcagaagaatggcgtgaacttcagaggcggagcttgcagtgagccgagatcgcaccactgcactccagcctgggcgacaagagcaagactccatctcaaaaaaaaaaaaaaacaaacacgaatgggggttgaattttgtgaactgatttttttttttacatctattgggatgatcacataattgttctttttaaatctgtttatatcatgaatgacattgattgattttaaaaagttgaaccagtcttgcattcctgggataaactccagttggtcataacgcactatccttttttgttgagattttttttgcatatgtgtttggaatagattttttttccccatgtaatgtctttgtctaatattttgatattacggtgattctgccttcatagaatgagttgggaaatgtttcttctttattttctgaaagagattgtaaagattggcagtagttctttaaatgtttggctgaatgtggcaaaccctgggcctggagttttctgtgttgatagattttgaactacaaatttaattactttcctataaatagactaatgaggttttctattatttcttaagtgagttttggcagtttgtgtctttcaagtaatcagtccatttgttctaagttgtaggatttcttggcataaataattattcataatattgctttattattcttttaatgactataggactggcagtgatgtcccctctttcgttcttcatattggcaatttgtgtcttctctctttttattggtcagtctgccttgaagtttgtcagtgttactgttttttccctaagaaaccagatttgatttcattgatttgtttctgttgtttttctgttttcaatttcattgatttctgcttttacttttattgttttcttcttcctttctttgtatttaatttgctttttttcagtttctgaagatagagggttggattaacgatttgagatattcttctttattaatgtaaatatataatgctatacattttcctctcagcattgctttagttgaatccaatgatttaatatattgtgttttcattttcaaaatattcaaatatattagaatatttcaaaatattcaaatatattagaatatttcaaaatattcaaaatatttcaaaatattctaatttcccatgagaatttcaccttgactgtagattatttggaagtgtcttggttaatttccacatatttggggatttcctagatattcttttctcatagacttccacttcaattcaattatggccagagaacatactttgtttgatttctattcttttaagttttgtttcatggccagactataatctatcttggtaaatattacatgtgaacttggaaaagtcaggcattctactcttgggtggagaggtctctgaatgtcaagtagatcaagttggttgataatgttattcagctctgctataatcttattgatttttaaatcttgttctgagaaagaaagttattgaggtctccagcagtaatcgtggatttgtttatttctcctttcaattctgtttttacattatgaaattagaaaaaactaattttaaaattcatctaaatttaaacattttagaaattgtatttaatacccaaaatatgttaaatccaatataacacttttttagagcagctttagttccacaggaaaattaagaagaagggacagagatttcccataaagcctctgcccctacgcatgtatagcctcccccattatcagcaactcccaccagaatggcacatttattacagttgatgaacctacattgacacatattaatcacccaaagtccatagtttatattagagttcacttttggtattatgcatcctataggttttgacaaatgtatattgacatgtatccatcaatatagtatcatacacagtattgtcacagccctaaaaatcctctgtactctgcttcttgatcttctgcaaccccaacaacttcatgtattttgtagctctgttgttaggtgcataaacacatagagttgttgtatcttcttggaaaattgacccgtttagtgtattgtaatgcccttctttttctctgataacatttcttgtttcttaggtctactttttgagatattaatatagcaacagcaggtttctttagttagtgtttgcaaggaatatttttccattcttttacttttgacctatctaagtccatacatttaaagtagatttttttttctagatagtttagagttgggttgggttttgcttttttttttttttaattcggtctgatggtctgcctcttttttactttttgtttaatcctgtcacccaggtagtaagcatagtagctaatagtttttcaactctctccctctcccttcctcttctagtagtccctggtatctgtggttgccatctttatgtccatgagtacccagtgtttagctcccacttataagtgaggacatgtggtatttggttttctgttcctgtgttaattctcttgggatagtggcctccagctgcagccatgtttctgtaaatgatgtgattttcttcttttttttcaacagctgcgtagtcctccatgggctatatgtaccacattttctttatccagtccagtgttgatgggtacctaagttgattccatgtctttgcaattatgaataatactgtgatgaaagtgcaagtgcatctgtctttctggtagaacaatttgttttcttttggatacccagtaatgggattgctgggtcaaattgtagatctgttttaagttctttgagaaatctccagactgctttccacagtggctgaactgatttactttcctaccaacagtgtatgagcattcccttttctctgcagccttgccagcatctgttgtttttcaactttagtaatagccactttgactggtgtgagatggtatctcattgtggttttgatttgcatttctctgatcattagtgatgtgagcattttttcatgtttgttggctatttgtatgtcttttgagaagtatctgttcatgtcttttgctcatttttcatgttttcttttgtttgttgcttgttcaattgtttaagttccttatagattctgaatattagaactttgttgaatgaataatttgtgaatattttctcccaatccataggttgtctttttacgctgttgatagtttcttttactatgcagaagctctttagtttaattaggtcccacttgtcagtttttgtttctgttgcaattgcttttgaggacttagtcataaattcctttttttaattattattatttttaaattatactttaagttctaggatacatgtgcacaacgtgcaggtttgttacatatgtatacatgtgccatgttggtgtgctgcacccattaactcgtcgtttacattaggtatatctcctaatgctatccctcccccctccccccacccctcgacaggcccggtgtgtgatgttccccaccctgtgtccaagtgttctcattgttcagttctcatctatgagtgataatgtgcagtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatccttgatggacatttgggttggttccaagtctttgctattgtgaatagtgccacaatgaacatgtgtgtgcatgtgtcttgatagcagcatgatttataatcctttgggtatatatccagtaatgggatggctgggtcaaatggtatttctagttctagatccttgaggaatcgccacactgtcttccacaatggttgaactagtttacagtcccaccaacagtgtaaaagtgttcctatttccccacatcctctccagcacctgttgtttcctgacttagtcataaattctttccaaaggctaatgttcagaatggtgtttcctagtttttttttctaggattctcatagttttatgtcttatatttaaatctttagtctatcttgagttaatttttgtatatggtgaaaggtaggtgtttagttccattcttctgcatatggctagtcagctatcccagcaccatttattgaataaggagtcctttcttcactgcttatttttgttgactttgttgatgatccaatcgttgtagggatgaagctttatttctgggttctttattctgttcagttggtctgtgcatctgtttttgtatcaatatcatgctgtttggttactgtagccttatagtataatttgaagtcagataatatgatgccttcagctttgttctttttgcttaggctggatttttgttcaggctcgattttggttccatatgaattttagaatagttttttcaagttctgtaaaaaatgatgttgatagtttggtagggatagcattgaatctgtagatgttttgggcagtatggccatgttaacaatattaattcttccaatccataagcatggaatactttttcatttttttgtgttatctgtgatttcttgtggcagtgttttttagttctccttatagagatctttcacctccttggttagaagtattcctagatattttaggtttttggtggctattgtaaatgggattgtgtccttaatttggctctcagcttgaagattattggtgtataaaaatgctgctgatttttgtacattgattttgtatcttgaaactttattgaagtcatttatcagtttcaggagccttttgatggagtcttcagggttttctaggtatagaagaatatcatcagtgaataaattcgattacttcttttcctatttggatgccttttttttttcttcctggattgctctggctagaacttccaatctgtcttctatttgatgtgtttaaatcatttacatctaatgtgattattcatacaggtggctaaaaatgtagcagctgttttctatttgttccatctgctctttatttcttttttctgcttttgtgttaatggaacatttttatggttctattttatcttcactattgattcattatttatacatcttttttaaaactttagtaataaccataggatttaaagcatacatctttagttaatcagaggccaccttctaatattagactgcttcacattctttgtgccattgttgtccctttacttttacatgtgcatttacaatgcattgctgctatttttgctttgagtattttggtatgttttagagcaattgaaaacaggaaaacatttattttaccttcaattatttcatttctagtgtgagtctcactctgtcacccaagctggagtgcagtggctcaatcttggctcactgcaacctccacctcctgggttcaagtgattctcctgcctcagcctcctgagtagctgggattacaggaatgtgccactatgcctggctaagttttgtatttttcatagagacagggtttcaccatgttggccaggctggtctcgaacccctgacctcaggtgatctgcctgccttggcctcccaaagtggtaggattataggcatgagccaccacgcccagtgtattctttatttctttgtgtagatccaattttctgtctgatatcacgttttcttctacctgaagactttcttttaaaaattattgtagattgattaggtctgctgaaaatgaattccataagttgtttctctcagaatagttttaatttctgctccatttgtgaaagacatttttgctgggtatagaattctaagttgatagttttttttctttcagcacttaaaaaatgtcattgcattgtcttctatcttgcattaactctaacaaaaggtctgtattaaaccttacctctgcttttatgtatataatgtgactttttcctcttactgctttcaatatttctctttgtcttctgttttcagcaatttgaatatggtatacctaggtacctagaaactttttggaagggagaggtgtatattctgctttgtgttctctgaccttcttggatatggaatttggttactctcattagttttggaatattcttagctatcatttcttttaatttttcttctgtcctattccgtttcttttacttctgaggtcccaattacacatatgttagattatttgatactttcactggaagtcttggatgctctgtttattattctcagtctccttgctctttgtttttcattttgtctgatttccgttgactagcctttaagttcaaagattctttcctcagctgtgttgagtctactgatgaaccaaagacattcttcatctctgttactttgtttttcagttttagcattctctttgattctctgctgaaattacccatacgatgttgcatgttgtctagagttttcattagatattaatcatagctattttaaatttactgtcagatttttccaatatcagagtcatatagatcttttgaaagatcactttctcgggtgtgtgttgtttttctcctgcttttttgtatacctcgtgattttttgtttttgaaagtcagatacctgaataggagagtagatactgaggcaaacagtttttatgtctgtgaattggcaagcattttcttctgctctgctttcattgtgggcatttgaattaatttagttgggaattgagcaaggtataaggtttgcagttgttatggttatccttagtgcattaaaggtttcaagttcctctagtaatgccttgtatttaagatgaggactggttggccagagggttttgtggggttttttttcctccttagtacttgctccacctttagctttcagttttccctttgcacttccctcatagaggatctctttccatgttctcattctgtctctctcccagaagtattattctgttactttttacctaatacttgtcagcctagggagggggggtggtggaagggctctgatttagtagtaggaggcactgtgtccctgcaacttgggggtcggacctactcagtgctcctggctctccctggggtaggggcgagggggagcagcatcttttcctgcctctcccccagggataaaggtttttatttctgttctctttccccaaatactatgagttttcaataatgggagtttgtgtgctattgtctctagtcacttcagtgaattaaactgtatttgtatcatatattgaatgaatcagatgttgggttgctcttgatgtcacaaagaaactctgttggtcctgattatttcccttagatttttcctgtggacatttgaactttaagaaatttatgatagtagtcctaagtggattgggaaatcagtgagcctcatcatctactggtaggattgcctgtcagttgccctgtgccagaagtaattctgttaatctgtgtgcagctccaaaagctgttgcagcatggactagaacatttcagctgctggttaaatctttctggcatatgtataaacttaaataattgctaacaaaaaattccaactagattataaagtggtttcaccacaaatgaagggctcttttctttttcagttcttagtagccacaatgaagattttgaagtgtctctgaagcactatccccaaattaaaggctctagtcaatgcaaaaatcatcttggtaagtcattaataaaaacacacactctaccaacaggcataattagagcctcgagattaacaaaattgcagtccttcttgatttaaaaaacaaaaaaaattctagaggtgagtcacaggtcttaaattaaaagggagataagtcctattttaagaatggagagcctaggtgtgagaatgagctgacagcagcttttgtcaccctattggtcatcagctgattctctggtctggctagttctcccattctgctcaatggggaaggctcaatccctcaacaaagaataatccctcttcattcaaaagcatgcaaggacagtcagagtaccaatcagtgggggccttttcctttttttacccagctatgtatgtcattcaaactagtccactatataatttttagccaggtgcagtggctcatgcctgtaatcccagcactttgggagaccaaggcaggtggatcacctgaggtcaggagtttgagaacagcctggccaacatggcaaaaacccgtctctactaaaaatacaaaaattagccaggcatggtggcacaggcctataatcctagctactcgggaggttgaggcaggagaatcatttgaacctgggagatggaggttgctgtgagccaagattgtgccactgcactccagcctgggcgacagggcaggactctgttacaaaataaataaataaaaaataaataattaaaaaaaatctactgaaaactattttgggttttaaaataagtaaagtagtgcccattctaatcttgtatactgtgcttagctttaaagcagcttagtgtatagttatgtgtgtctcaccattgcattaatttaagcggtattcttggctaggtaaagatctgtaggaagccagcttgaagacagaaccaactgggctggttaataatatccacacatctgtccattgttaaacccaacaaccatgccaggaaattccttgattctcttatgataagccagctaatttttattatttagttgttgactttccatttgatttttgtcatagttttactttatgctgaaattgtttaatatccttttagtttcttaaacatcttaattatagttatttcacaatttatgtctgataccaccattatgtgaatgccctaagggtctatttctaaagtctgttttctctcttggttttcattcaggtcttccctaatattgtctatttgtttgagtatgagacattgcttatgaaaaactagggctctggttgatattatcatgctccagagaagcttcactagaaggcaggtaggctaggagcatatctccctaacttaattgtggattgagataaattgagaccaagtttcagtccttgtgaagactggtctgttgttactattattcctggtataagggatgctcaagggatatagcccttgagggttccaactggaagcctggggcagttaccaggccctgaatgccaacatttcccccagcactctgagtatgttaaaaactctgcttgtcattttagccattttgtctgtgcttttgaaataaacagttacctcataggtaaaagtggtgccaagtgtaagccttatatctctgggttccccactacctggatcttggaaataaacctgaattttcaaaaatgaaaatgctactgtgagttactgatgtccttcacataaacttttttatgttccatttttcttctttaaaactcactctttacttaaagggtctccaattttatgtttcgtgctattcccagcactttgttaaaaataaaaaaggatttgttacaggctcactcctgtaattctggcactttgggaagctgaggcgggtggatcacttgaggtcaggagttcaagaccagcctggccaacatgctgaaaccccgtctctactaaaaatacaaaaaattagctgagcatggtgctgcgcacctgtaatcccagctactctggaggctgagtcaggagaatcgcttgaacctgagaggcagaggttgcagtgagccgagatcgcaccactgcactccagcctgggtgatagagcaagactccatccccaaaaacatttgtattcaaaactctcacttgttccttatgagaaatactagaaatgcagtaaaactatataattgcaggattaaatggaatattttcagttgtattattttttcatgtcaagcattttaacacaattctaaagaaatgatttcacaaacggtacaaaaacatcattggaatgaggatgggacggacacataatcaggacagcaaccgatgcctgtgccacggtggccccctctgggttctctgcggtcacctggagaaaggactgctctttaaagcaaacaacaataatccttgtaactggaacacctaagccccaggaagtcacattcttaaactcagtctacactgatttttactttggaaagatctctctcgattgggtataatttcttctcaattatggcagaactgtttaggattggtaatatgcttttatttaattaaaaattaaaccctttattttgatttttaaggaaaaaacaagctcctggttagagcatagtgcagttagttgcctgtaatgttgaaaatagatgtgctctttccccttttacttaacacattatttattctagagcaaaaagattctttttttaaaaatgtaaataattatggtgtccacctcctaaaaagtgttgtcacagcagtctattaatctgacagattttaaagattgtactcctgggagaaatggtgaagagaaactggggtgttaattaggcagattaaagccagagatgtaactagtgctaacagagtttataatgtagaacgcctccatcttcagcctgagagtggatttccttttgctatgattgcagtaggattctaattcatatttcctttcttaccatgtcttttcctcttaaaattatctaatagatcttctttgcatgtaaagtactctaagtattgaagtcttctaatttgttttttctttctgtaaagcacgttgaaagctgcttccagatatcttgcactagccaatacagattttctagcaacaggatgcctatttaaaatgcctgggttggccaggtgtggtggcttacacctgtaatcccagcactttgggaggctgaggtgggcagatcacctgaggtcaggagttcgagactagcttggccaacatgatgaagccctgtctctactaaaaatacaaaaattagccgggtgtggtggtgcaggcctgtagtcccagctacttggaaggctgaggcaggagactcgcttgacataggagatggaagttgcagtgagctgagatcatgccattgtactccagcctgggcaacagagtgagactccatctcaaaaaataaaaacaaaaaataaaaataataaaatgcctgggtggatttaaaaacaacaataacaaacttgacagaatttttttttcaccatgaaaatgtatgttttggaaaatgtatgttgcataagcaagtggctaaacttcagaagtgagtacttacccagcacacccttcccctgggagtggtccagttagcagacttgctggggctgtgccagttttccacatcagggccctaatgagttgaattaaccacacaggtaacttttactaaccataaaacactgaagtttataaatgatttactttaaaaatacaagttagagagcactaaaagtaatgcctggaatagcatcatgtcgtttcttcccttcaggaaaggcagggaaacaccagtgtctaaactctgcctcacctgtcagctgctgatactgcctgagccagtgatcagtctaaggaagagggtgatccttctgacagaacagttgtgagaactaggaagttgtattgtgctttacctctccccagagttttatttgtcaaaatcagggcatgccgatggtggttgtgcatgagaatattatttgtcatgagttgtgtctccctcccctgcctcaaaacaaacaaaacccaaacaaacaaaagtcagtgctttgaaagatgctgtcaacctttaattaagcaaagtcaagctgattacctttagtagtggtagaatttttgctagtgcttcacatttggtgcctgtctctagaaagggcccctgaaagacagagttgagagtgcatgggttgcatctctctgggttggagagggagtgcaggtgccttctcagctgtctcactgacattcttccctgcctgtcctcccagtccctttagggcaaagagaatgactgcagcttctctgagctttgtaaccaactgcaagtgaggaaggtgctgataaatttgtcagactccctttttcagaccaggggtatctgaatgaataatagcaaggaaataaactcagttgtgacatggacagcatccttataaccccagcccagcacatccaacacaattgggtcactcttaaaaacagcaacaactacagcaacaaaacttcaagcaaatgtgccattaaaaactcttacataattgtaacagatttgagtttcctctggttcaggttttcttgcctctttgataatcaaatgatctgaagaaaggcatagaatttcaagggagaatctgcatgacaggattacaataaggctattcatggagactcttttattagcttacacaggatctgcatcattcttcgtctctggctttgctacaaggctccatttaaacttaacccaacttgcaggcttaactgatccaggaatgactcaatacaatgagccagctactgtagctctttttccccttttgataaggggagttaacacaatgggctttacagttcttaaatgactgattttttttttctgtctttgagatgtggtgctcatgcgaacttttgtttctttaaaaagattcacatggtttgattatatttttgaaaagcataaacaaatccaaaatggactccctacccttagaataaaacttcaaaaatcttgtagatgatatagatgcaaaattcatgtcacactatttacacagctgatttcaatatattagatattaactattagtattattcaattaaacttgaaaacatttatttttgaagggtggttctgatataatttctagcagtacttcagcattgaatttcacatttgcacatttcttgttatctgctcgtgtttatactgtattcatgacctaatatgatgtgtaaatttaacattttagtgaaattggtcaggtggttagagaccatgagatggctgcagtgctaatatacttcccatttcccgtcagggcaccttgtttatccctgagtagctgggatggagaggaaacccttgaggatgcatttggtggcacactgcactgagagcattaaggacccccgctttggacacacacctcagaatagtggttcccaaactttagtgggaacaggaatcatcagggatgcttgttagaactgcagatgcctggaacccacccccagagactctgattcagcaggtccgggatggaagcccaataatttgcatttttaacaagacacgccgttgattctaatgggtggttattgcaccacactgagagtcattctcctgaagtcactggggaacgttgggaggccctacctcctcccctacagcacctgttgcccctaggtgagcagagaccttggttaggagtgacccctggtgtgatcccagaggtgcagatgtcaggaggggaaggacagctctagtatttccaaagtgtcagagcagctcttgcgtcttccacctggtgtgcttccatccacacagcagggcggtgtcctcttcatcctcatgtggcagggaacacctcgcctgtggaccagcgctggatgtttgaaggtgtcatctcactctcactctagctttgtaattagaatctcagagcggtcgttatctgcagcatttaatccaaatttgcatctttatcccactcccctaccccgattaatgtagttttggatttttggaaatggagatctttttcaaaaggacctccaattagaaatggattctcaagaagccttttgggaattatggatgtaacgtgtttgttcatttcacgaggatgagatttttccttaaagatctgttgatctgatggtcaaagcagatagggaaaataaatgttgatgatagctaccgatgtttttaacagtttgcctggggtgctgttgtgtgttttgtttgtagaatccacccccatatcgttggcagacttttttattatgagaatttccaggctattcaaaattagaaagtacaagaaactcccatatattcctcacccgctttccaactttccagagttatcaagatttatcgtattttccagcagccttttctcatccttaaatcttgctggtggtttttgtaagggagaacaagtaaaatcttttcttcacctacggaaagtttcatggctgagggccctataacaaaagacagatgaacaagagagaaacatacagatgtatttattgtaagttttacatgacacagcagccttcataagaaagtgtagaccccaagacacagggaaacctctgtatttttatgcttaggtttgataaagaatggacagtctttcagaggtatgacaggacaaaggggtacgatctagctggcatgaaactggagggaagttggcaaggcctgtttgttcagattcttccctgtgtcttcagagacaaggagattgtttttctctgggtgtagggagggcacctctggaatgagggtcttatgccctgcttcatgggaagggcagaaaattcttttatggcttgctttaggggaggagagagcagaagggcagagggacctccctgcttccgctgttttctcagatgccaagttgccatattttgggataacacgtcttgaacctcatcattttcaaagtggttcatttgaggaatgaaacaaacatgaaatgctttgcttggggcctgagtcgagtggtcatgaatagtcatttaaacgtgtccttttcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgagtattttaaatccagaggattgattgtatctcatctcattctgtgttttttttttttcttttttttttttttttgcgggggaggggggtcaataacttgtgagtaatccattagtcttttaaacggctttattgagatataattcacttacacaatttgccagttcaaattgtgcagttcagtggttcttattgtattcagagttgcacaatactagtattttaaaaaagaattttatccaaaattccttggatttttatctgtgtacctaatgtgcaacggaatagagtgaggactgctttgaggccttcacccccaagtaactgtgtagctgaggaggccgactaataaataattctactatcaatataaaagtgctacatcaaaaatgtatacattgggtaggattgtatagatacgtcacttgcactgtgtagtttactcaacacaattcagagtagggttggttttgttaaaatgcagattctgggtcctgctcctgagattctgactgtaggtctgacttcaaggactttttccccttgtggtttcccttccactcactcattgtaattaactatgcaagcttgtttgccaggagtacattatgaggtgcctgggacaatgagtttcagattggcgtgcaagcactcaaggaatctttcagcgattaatgtattgaagtgaggaaaggggaatgagagaggagattcagtgaacgacgtttgagccccaactgcgagctcagtgtgaccttggaggaccaggactgcctgttagaatgggaaaggtgacttagctcaagctatgataaatataatagtacaaaatagtgaccacacccttggcaccaccaggttgtcagaggttcggatcagggagaagcaacacagagggcccagcctggctaggacctagttgggctgatgaagggaagagagggtctgaggctggggaagagcataagcaaagaccctgggccaagaacacgctcggtgtgcagaattgtgggaggccagcctggtggcatgagcacacatgccttggagccatgggagaacactggaaggcttagtaacagttgggtctggagaatcgtgagggttactctgaagagctgggacagacagcttgggtccagagcagcagtgtgaggttgtggaagtgctgcttggggagggtaacatgaaggtccttcctgggatgaagacgggtcagagaggggagcaatgatgtcacaggacttgggcagtagtccaagcatgagtgagcagggcctaggatcgagagcagggcaattcctctttctgagcaagagccatttagaatgtggaggtaacagactcctaccggatctgtagatgcccaccaggttttatgtgctaagaagagcagcagcttggaccaccatttacatagctgcatggtcctgggacatacgatggaaagaatgaggaatggttataaaataaggaggctgagatgcataaaaatagaagagaaccagtcacatttggttaccactcaattacgagtgagattagcattacgagggaccctaattgaaagcaagtcccgagaagcctgtcgtgcctttgctttggtgacatatacatgtccacggacagggctcctggagacctcagcactttctaggttgctccttgattgcttcagtggaagctgtcagcctcctaatttctaacccatgttcttgcttctaagttagtttgaaacaaaactagtctaaataaagttgctcagaaaatacctcctgagttatttgacgagacgtttactgcatctctttaattttaaattgccagatgggtgagaggacacctgagtcactttcttctccctcacacccagcccagtcccttgaccagcaggagttggtaactgttgaataatgacacttctctccctccttcctactctttttccatcccactattgctcacttatttaatgaaacagcataaagtccagaccctattttaaaaattaatcttcccctttgggaggccgaggtgggtggattaggaggtcaggagatcgaaaccatcctggctaacacggtgaaaccccgtctctactaaaaatacaaaaaattagccaggtgaggtggcggtcgcctgtagtcccagctactcgggaggctgaggcaggagaatggtgtgaacccaggaggtggagcttgcagtgagccgagatcgcgccactgcactccagcctgggcgacagagcgagactccatctcaaaaaaaaaaaaaaaattaatcttccttattgttacaaattatttttaaacaaaaccgatgttaattaaagcaaatcaaataacccaagttagccatctttggacctttccctttctttcctctatgttccagctgcccacctctctctctctctctttttttattctttctctgtggctctttcacccaggctggagagcagtggtgccatcaaagctcactgcagccttgaacttctggcctcaagcaagcctcctgtctcagcctccccaaagtgatggaattacaagacaaaggcaccacacctggccccacctcttgctcaccccacgggacctctaggggactggacaggcagtccctacagaatcaagacccatttgtaatctctgaggaaccagtttccgagaagcacccccaggccagctaggagcccaccctgcagcccccagtccctgcttggggccctttgtttcaatcattagtgatttctgcctgggccaaaaataggatgaagaaaaaggaggcttgttcatgccgtgccaaagtggatattcagcaaattggaaaggttgcttgtctctgcccacacagagaagcctgcaaccctcgttgcacggccacgtgttccctcagtgagtggggaaaggcgctggccaggcgggctcgtactcccagcgcaggagttcaggctgggttttagggtgggcttccaggactagagctgctgacggccacactgaaggcccaggaagaggctgggcccggctctgttgtggacattttcttctccagtgtcttttgtgctgtttcctcaactcctcgtggcagtgactcccgaattcccacgtggaggggctgagggaggagaatgtgacggctggggcctgtgggtgacaacggtgtgcatgttgcactgcagtctcagtccttactgagctctatgttagcattgacagagtggcagttttctactgatagtttagccacactttacaaagaggctccctgcttttttctcttccttagttcagtctgggaaggcgatggtccgacagggctggtggggtcttcggagcccaccaagtactgtgctgtatggacaggcctgcttgggaagggggccgcggctggcagactggggcgtgcggtgggcgttgggggagaggccaccagttagcccgctcccccgccccttgcttgtgcgtggccttttcgaactcacctcacgtctcacaccgaagtcatctgccctggtattggtggtaaatattggatgtatgggcttgctgtctgcaaagcgcccgtgctctgtgcgtctctttgcacatctgcacggccctgcggccgctccgagctgcctttgagccctccctgcgagcgcgccgccgagaggatgggctacccatgaagcatcgaacaccgagggctggcaagaggccccagcccggctgcctcccgcgagggcgctgtcggccctgtgggcctcgccgttttggttgctcccggagcgggggtgaagggagtctctgtgggcagccgcgctgtcggcgcggtcacatggggcccgggcggcggggaagaatgcgtcccttgtgctccgccggcctgcgcaggcccaggcccctgcgctgcgctgccgttgtatctgtcgaaccctttcgggggcgtgtttccgagtccacctcgcacactcccacatggaaggtttggggcgggggagctgcctcctctcctgtctcgcctcctctcctcccctctactgtggtaaattcaaggggcacccgaccttattgacaagattgacctcttgggccagaggctgagggctgtggttagggagactgtttcccagccgggagacctcgaaggtccttttgcggcggcttccgtaggtggacacggaggtgtggatggaagtcggtgtgaatggaagtctgttttggggggctgcgtggggcccagtcgctggcccctgcgtcctagtcagccgtgtgccttgtacagtgggcgctgggcagcccttcaagatttttcgttggagaaggcatgatcaaagtcctgttttttacttttaaaatgtataattgtggtaaaatatacataacaaaatctaccgtcttaactatttgtaagtgtgcagtttggaggcattaaggacattctcactggtgtgcagccaccaccaccaacaatccatggaactttctcctcttataagactgaacctcctacccatgaaacactaactttccacagctccaccccagccgcggcacctgaacctagctttctgctgctgctgtggatttgataggctcccgctacaacacggattgctctgggaggatgagatagaggggctgagaccccagcaggagtcccatgaagggagtgcagaatatatatggaaacgggggccctgagctgagggtggcagtggcaatgatttttttgagagaagagtaaagagaagtaacaggacttcagtaactgatggtgtgtccggagttggtcttggtgggttgtggtcttgctgacttcgtgaaccacagacttggtggtgattgttaacagctcttaaggatagcacggacccaaagagtaagtggtagcaaggtttattgtgaagagcaaaaggacaaagcttccacagcagggaaagacagcggagtgggttaacgctgcaggtgggggtgtaggggtgtgggtgggggggcgcgtgtgggtgtgggtgggcggtaggggtgggtggggggagtgaccagctttttttccctaattggcccctcccctgttccatttctgtcctatcagagttcccttttttcaatccttcccccgattagctacttttagaatcctgctgattggtgcattttacagagcgctgattggtgcgttttgcagagtgctgattggtgcgttttacagagccccgattgatgtgttttacagagcactgattggtgcgttttacagagtgctgattggtgtattttacaatcctcttgtaagacaggaaagttcctgattggtgcattttacaatccttttgtaagacagaaaagctccccaagttcacacttgacccagggagtccagctggcctcacctctcaatggaaagtgagaggggctagggagaggcaggggccaggaacatttctcctggtactgacttgggtgtggggatgtgacacattctcactgagatcaggagcctgccagggttggggaccatggggataacccacatgagacaagtctgtgctggggtgtgcccaagggaaggcgtccagcactcagttgcagatgtgggccagggtgaggctgggatctgtgtgagacatgcaggtgtattctgtgtcctcaagtcttggtggtggtgacaccagggagtgggcacagatgggccactgtggcagactgggggtcaccatcactcagtgaaagtgtgagcaggaaaaatcgcagagaagactgagaggagggaactggtgagttgtacatagaaatgctttctaactccttgtctcagtctgtttttgctaccagtgaggcttacaatgtttgaaagaccccaatcccagcatgcctgctttatataaaataaggtaaaattcatctgagaaagacacacttccagttcttctaatcttcatttttcaaaaggtcagaggttaagcgtttctataagaattcagtaggtgacaggtgtttaaccgaggcatcgatttaccatctgtctatttggaaacaggagccgtcttttcttgattcctgagagggcagagcaggtgcccaggatggcccttatttctcctttcctcttctgtgggagtcatctttaaatggaagcttctgctcatggaagcatcacttagcaaatgtgacattctacctatcacccatgtagtggaggaaaacccattgaaaagcatcatttctgtttgctgtggtatacttggctcagtgctcaggccagtcaggttctaccaggcactgttttctttggacatttgataactctctgtgaggaatctctaagaacagtttctcaaagtaaaccaagaacaccagagttgaacagtgaagtccagggtcctcccttggggcatgctcacctggacaatgccttcctgtgttgggctcgtcggggtgctggggctgctgaggtgtgttgatgcctgttgatttctagagcaggaaggtgacattagactggaagaggcagacacttaaggtacaatatggaggaattaaggaaataccaggttttgggaagacactgctaataatttatttttgagatgatctggcactgtcacctaggctggagtacaatggcacaatcatggctcactgcagcctccacttcctgggcttaaatgattctcccacttcagccttccaagtagctgggactacaggtacacaacaccacacctagctaatttttttattttttgtagaaacagggtctcgctgtgttgcctaggctggtcttgaactcctgggctcaagtgatccctccacctcgacctcccaaagttctgggattacaggtgtgagccaccgcacccagcttgccaataatttttaacactgacacagaagaatgtcagagcctgtggtgactgcagatgggaagacatgattctggggggtggtgggctgggaggaagctttgaagacaagacagatgggagcagagaaactctgtcctggggaggccaggggcttgaagattagccataaacatacaggatagcaagctgttcctccaaattccaactttgtattttgggtatttttttttaaacaaaaccacacaattctgcatcaggttccctttttctctctcctttgtgaataaatttctttctcaagtatcttgttgttggccactgaatctaaaggcaccattccaaagatgcatctgctgctcctgaccattcagggtgggtgcagttccccaaacccaggatcatctccttgactcccccacttctctctctctcctaaggtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggtgtgtgtgcccgtcctctctccctccctcccttcctttctccctccttcttccctccctctcaaagttgagcaggacagtgaaagttgttccttgggcagcctggaagctgggaaagtcagaggctgcttgcttcttcttgctctattctggagaccaagggccagctttagaaccaaaataaaatgcagcgattcactgtctgcctgagaggttcttcttacagtcacctgataccaggacacgatgacaggcttctctccttcctgccctttcatagcattagacataataacctatgtggcccactgcattttcccacagaggcagcttttacccctcagtgttataatttttcaaaaggaaaaaaattatattttgtgtaaacttctgtctcctgaaggaacctaattgtttcaagagcttgaggaagaagtgatgaatagacttgttagagtaaatgcttgtcttacctataaagaggaaatgatatgtaaatatatttaacatcatcctctaatgaaaggattttacatggaggtgaagaaatggcctggctgcacgcattctcgtgtacatttgcatgaggggccgtggtgcctggaggagataggtcagctggaccccaggacgaggcggagaagtctcgggatctgggagtggaactgtccggcctcccttatggcacttgcccagcttctgcagggggaaggcaagactctgcccacgcctgtgttgcaaaaacattgtggaaggctcaagggccggaagtacccagctgcaccgcgtagggaggacgctgctcgggctcgagtcatctgcacctggctccacagttccttgtttggactcgcatggacacacaccgagccttgcctgagatggcaaccaggaagctgactgtgccccagcttccttgagtgttgcatttcaatttcccagcagttcttccaaaccaggcaggtgtgcatcacagatgtggcctcccgcggcctgcttctcttgttgggccaaatccccgttaggtacattgtctgactggactgccgggtgcatttgccacgcggttgcctcgattctgtgtcttgatgtctaaatccacttaaggctcctgtattttcaagaaacagtgctcgggtttccactgttagggcggcggtttgaatttcttagtaatttcttgaatatcagtcagtgtcaaggtatttttaaagaaacacggatctatcagaacctttttggagatttatttaaaatatttccatttgtctagaaaaggggaacaactttagactccttgcccatgttcacttgttgaattaaaccttgtggggttttacaggcaatctcagctttttatttgtaagatattttagcgccctgagtaaactcttgctttctccaatatgaaaggtgtgagcccactcaaggaagggtttgggattctggtgtaaggggatcgggtgggaggtgtacacaaagaactctccattgcaagagccatggaggactctggtgtttccttttgctgctggaggagggcaggcggaggggtgagttgggctgctctggtagttctgctgactcacgatgtccaccctgcttttggttgtccctcttcatgggtcatggcagcctgagtgacattgtgttactggctagcgggaacattcttactcctggctttctgtggtgacatacctcctgagaaagtgaagcctgcatatgtctctgtgttggctgctgtgggactcagatgcctggagtccctgtaaggaactgagtgccaaaatctagcaggatacagtttgtgacagaacaggaagaggtcaagagaaatgggaaattaagaaaatgtgagtaaaacccaaagaattaccttggtgaaagtctagaagataatttgtttctaaaaataaggattatctacaggtagtggggcccaaggcagctctagaaacttcaggtcctctcctggcaggggtggggtgggaatggcactaccaggcaccccgagccccacagcgatgacttccagggtatgaggggctttagttatggggcagggctggcagagagggagcatggaggagttcggggaggaggagggggcttgtcgtggtgctgaccttgaccatcaccgctcagtggcagcacctccgttggccagctacttcaggagcaaggtcacaaccagcgtgccagcattccagtagcaggttgaagtttgacccttgcttggcatgttaattgggtagagccaggatgctttcagggtaagagaggggccaggtgacttggttcagggcgctaggggagcctgctggaactggagcactggcacactggtcatgaccttgttcgtgaagtagccgctgacatgcacacctgagcatccacttggatgccctgtattccataagactctggggctgcgcggcagaaccgtgcctcgtctcagtgtggccctagagaaatcttgcctaccgtgattgtgctggctacagtgtgcctcccacctagcagacagtggtgtacctgacactgttctggtgggttggtttaaggattcttgattttattgcaggaaaatctatgctgctgtggccggtttccatgccagatactgcaagtcagcaaaagtgaacaaacctctccagggcctcacctccccgtcttgcaaatccgtatagttgctccaaaccacagttgaacacagggtgcaatgacacccctttgactcacaacttccaagccagatgaacttgaatttgcattttggagtctttcaatagttgagcttagatttggtgttttccaagtttgcctcaaaactttcaagagcaacttttaatagaaaaggagcagaattggggaagttttacagaagaggctaagtaggcttgtgcatgttttaagttgaaaagctccaaaggccttgcagagcttctcctcagtgaggcctggtgtgggttccatgtgtggccggagtgcctggctcctgagccttgactgtagtgaatggaatgagcattggtcggggggcaactaggactcactgctcctctaggactcactggtgtgggcgcttctgtttcaggatcctctgggctcataaagcaagttgaagtttgacagccttttctgtttgacccttggcttggcatgttaatggattagagctggatgctcctaccagggtaggagaggtgccaggtgacttggttcagggcgctgagggagcctgctggaaatgagctgtgtgcctgtgtccaggcgtgtgggtactgggtcagcaggtcagggaggaatgccgttccctgccacccctgccatctgcaggtgaggcagctctgcacaaatcatatgaaagtatgaatttccaggggtctgacctccaatttgaggtaggagctagagcaggatggaaggacggcttgcatttccacccgtgacagtgtcttgctgctgatgtcagctgcgttgccactcactaagtggtgataacaagggatcccatggattgacttttgcatgttcaaccagcctcacatactcggaataatcctacttgggattgctggattcaacctggttatgctttgttgtgaatttttttttgcatctaaattcataggacatatttgtctgtggatttctttttttgtattatctttatttgattttggtatcaaggacgtacaggtggagaagcccaatgcttgggaccagaaatatttcagattttggatgtttgcagattttggaatattatatacttactgttttagcatccctaatccgaaaatctgagatctggaacgctccagtgaccatttcctttgagtgtcatgttggcgctagaaaagtttcagattttggagcactttggggttcagattttcagattagggatactcagcctgttctagctgcatacaatgaattgggaagttcttcctcctattttctggaagagattgtgtgtactttttgttaattcatttttagatatttggtagaattttccagtgaaaccatccgggccagggtggggttcctttctgggagctttctaacgatgaatttaatttctttaatggttatggaaccatttggattgtctgtttcatcttgattgagttttgatggttcgtcgtttctgagaaattggtccatttcttctaagtcgttgaacttaagagcataaagttctcggtagtcctcctttttattctttcaatggctgcagggtctgtagtgatatccctggtttccttcctgaaattggtgattggtgttctctttctgtctttgttctcttgctagaggtttatcaattttattgatttttttttttttgaggagcaactttttgtctcattgatttttttttccttttattttcccgttttcagtctcactcactcactctgggaccatatttttacacctgcagccgagcattaaagagacattctaagaaaggggcgggggtggcagggaggctccctcactgtgggggtttgtggaggggagccacgctgccagtgccatttctaggtcagaaagagaaagcactgggaatgacaagcattttcttttcttgtctttgtggcatcctgggctatgagacgctcccctgtcatcacccattctctctctgttcccttgcagctctgtaagcccttagaccttcgtggggtagaatggacacccggatagccaagggagtgaaggagccaggtctattgtgccatctcacagatgttcactccgttttgtttctcttccagttggcttcagttttgggatgaagcagccctgtggtcttggaaatgccagatggacatgtctggccacaatctactgacacttacttcccctgccggaggcgtgctccctgggtcacgtgatcttattggctgggatgtcatttcaagtctacatttttaaggcattagcataatgaaggacattgtgttgtgacaatagacttttggctggacagtagctaagtttgttgcctgtaaattctttcccatgagggcagggtatgtggaggtgcctgggaatgaatctgcaaccctcggcaggttctcagcctgctggtgtgagttggtggtgatgagcttcggaaattgctgaccttgggttctgcctgtccttcggaatgatgtcatccctgtgctggactgctgtccttagggcctgggccgcagagattgagttcttggtctcttgatttgtcagggtgggtgtggtctggggcatctggatggggccctgagattccagaacttcatcgttgagctttacttcagacatgtctgccaactgttaggagacattgttttagttaatgaagtgtatctcaaagatcatgtagtaaaattgacagatgaggcttttttgtggcaaacttattcaaaggtttctgttgaatatcatttgtatgcacataccacgtccctggctctgtatgtgtctctgtgtgtctctatgtgtgtctcttgtttctgactccttctctctgaccgcaagctcacaatagatacacatgcagctctaaccagcttctgcttagttggagattctcatgtggtcactatagctgtgattcacagtcctagttttaagacactgaatacctctggttataccaaaagatgtaaaaattgattttaaaaaagtagctgggcaggtggcacacgtctacagtcccagctaccgaggaagctgaggcagggggattgcttgagcccaggagtccaagaccagcctgggtaacatagtgagaccctctttttttttttttttaaataaagatagacagttcacttttaattaaaaacaaacatattagaatgaatgaacaataggttgtaactgcacagaggatgagaatcgctcttgcaaatcaaaagctcacccagccagacctgccccgcttgggcctgctggagagtgacgccccaggggatctcccttgtcatcctgcttgcatgcttagcctcagccacccgcctccagccatttgatttcctgagcagggatgcaaattgtgatgaggttttccttttaggaggttttccctttaggagtcatgagcctgtgtgggcagaagcaggtccctcaggagggacacccagaaacagcactcccgtatagctgattgtagctgaatgcctgtgcttgggtgtatcctgcctgccgactgtacagtggggcctctgtgtactggggcctgatctcatgctgtcagccaggtttgcgcataatccactgcattatgaactgttatgctgaaattagaatgtaaattagaagctccttggcagactgggaggttacacaaaggggagccaagggcatgaacatgttctagggggaagatggcctaaaatgtttaaatttgctgctgtaactaccgcttacatttctctcacatgtgctatgttcacttggaggtgaatggtcctttgatttcttctctcctcttatcaaccaacattcatatgggtctagttctccacctctgcatgaatacccaggaaggtgccatctcacatatttcattttctgagcaggaagccatctcagcaagctgcctgcgtggcctgtccttttctggcagtccggtgaggctctgccgtttcactaatatcattgtcaacgtgagcaggtgccctgagaccctataacagagcaaggcaggctcactgacggttattcagatgtcgactctggaagagaatcagcacaaagcgggcactccaaggaggagcagaactgggctccatcatcgtttcacaggctttgaggtcaaggacaggaacagcagtcttgtggctggaagcagcagagcttgacaagaggaagcctgtgcggagccaccgccaacaggagacggggtcctgctggcagcttttctggggaaggacggcgttggaagtgaattgctgtggtttgcttcagactgtggtgcacctggaatgtgtccgggggaaaatgttgaggcttgagtaaaatagcacagcgcagacattggcaacatctgtgtggtcttggcacgaagtcacatagagcgatgggcccagtgtgtagggaagttgggggagccaggaaacagccaagtctggcctccgcaccatgcctcagctggaggggttctacatcttacctacttgaaaactgaaccctaagagtttaggatttttttttaagacacaacatttgaagcatctgagtgaatcgctgatggggcttccagagctccgtgtatctcagcgctgccttttcttcctgttgctctgaggctcacatcaccccagaaaggatgtgttctccctctgccggctttgccctgggctaggcctgtgcgggctctgcagggggttgggggaatctttcccctgcttctcctaccaggcttcttctgtgaccggttcagtctctgtctcctctgacagcatctgtccaaagccccaggtgccgcttagagctgatccctcgggcaccccaggatgctgtgcctttctttcctctctcacatggcctgggccattgtcccttcgctcagctggcctctgtcttctgcgccttctgaagtctgggtggtcagtgtgtctgtgggagtaagtgccttaccagagggtactggagagctctcttggctctgactattccagctcctagtccctgggaggtttgctgaagaccatcctagctccactgtgcctgtcctcttcctcagctcctttccaacagagtccacatgctgcttctcagtccagccactcagcagcacctctgttgggactgcagggtcgttagagcggatacatcacccacgttgctaggaccagcctcctggttaattgagacctgtgtttttgttggcttcaaatgcagagagctctgtaagaatgatcttctgccagaagcaatgagagaggtgatatttttcatctacagggaagtactgaaagattattttgaggagccctagaactatatcagagcccattcccggccgggcgtggtggctcacacctgtaatcccagcactttcggaatccaaggcaggggaatcacgaggtcaggagttcgagaccagtctggccaacaaggtgaaaccccgtctctattaaaaatacagaaattagccaggtgtggtgctgtgcacctgtagtcccagctacttgggaggctgaggcaggagaatcacttgaacctgggagacagaggttgcagtgagccaagatcacaccactgcactccagcctgggtgacagagcaagactctgtctcaaaaaaaaaaaaaaaaaagaacccacacccccacacccatgaatcagtgagtactcagtgtccaccgagagagcctccagtcaaatagagagtagagtctggccttcctcaacaaaacactagcaaactggattcaatagcacattaaaatgatcctatatttaataacataatcaaggggaattcatcacagggtgcagagatactttaccataggcaaatctataaatgtgatatgtcatgttaacagaatacaggacaaccatatgatcatctcaacagatgcagaaaaagcacacgacaacattcagcatcattttataataaaactctcttcaaattagatatagaagaagtgttcctcaacacgataaaggtcatacgtgacacacccacagcaaatatactcaatggtgaaaagttgaaggcttttcttctaagattaggaacaagacaagggtgcctactctcaccacttctatccaacgtagtatggaagtcctagccatagcaattaggcaagagaaagaaataaaaggtattcaaattggaaatgaagttaaattgtcactgtttgctggcaacatgatctcatatatagaaaaccctaaaattctgttggaactgataaataaattcagtaaagttgcaggatacaaagtcaacatacaaaggtcggtagcatttctatacactaacaaggaactacgtgaaaaagaaatcaagaaaacaattccatttacaatagctgcccccaaaatgcttagaaatacatttaatcaagaaagtgaaatatctgtacactgacaactataattacactgatgaaaaaactgaagaagacacaaataaatggaaggacattctgtgttcatggattggaatgattaatattgttaaaatgtccatactgcccaaggtgatctacagattcagtgcaatccctatcaaacttccagtggcatttttcacagagtagcgtggccctttgtttggaaagactgtagataccactcgagatgggttaggatgcacatgacaaactgttggaatgtggggctcttccaaaaggagagcaggagtgcaagacttttccagaaaggctggtggctttggcagagaaatggcatctaagcatatttgtaaagctttctcctcctctatgttagagtcagaagctgcatgccacccgtgtgcagagccaagtccagctcagctttcccacaggtttgcttacacttgctgggcgaccccagcctggctggaggtgcaagggagcacgtttgtaccttgtaatgatttctctctagagtagtgcagatgttcgcagggataatgtcaactgccacagcaactggaattctatctgcaaacttttatttgctgtgttggaatcattagttaattaggacttttttttttttttttggaaatggaatttcactctgtggcccaggttggagtgcaatggcgtgatctcggctcatggcaatctccatctcccaggttcaaaggcttctcctgcctcagcctcccaagtgggtgggactacaggcgcatgccaccatgcctggctaattttttgtatttttagtagagatggggtttctccatgttggccaagctggtcttgaactcctgacctcaaatgatcggcctgccttggcctcccaaagtgctaggattacaggtgtgagccaccgcgcctggccttaattaggattttttttctagcagcaattttccataagaagtagactatttttataccattatttattattttgtgggtggccattttctgagtagtcatattggtgagcaacaaaaccctattgaaaagagagatactgctgatttatgaatttagagatacctgtatccccattaataagcaaataaataacatcaaccacatactcattaaaaatccccaaaatgctgcaaagcttctatgttagtattctaactctaaaaataaataaataaataaataaataaatgaaaatgctgttactataacaccttctagcaatcattaccaataggtgcttgagcagtgaatataaatgatggatttcagctccctcagtttgaagttgggaagttaacaggccaggggtaagggtccccagaagtagaggatgggggtaaggagcccccaagagaaaaggcaaagagaagagaggtgggaggtgacaaatgacactgcatccctcttcccttgtgggagccagcctttgtgccttccatcagctgcaggtagaagccaggtgagaggccactggagccctatgggccatcaaggcaggaagcatctctgggtaaagatgtggggagtaggcagatatggggcttgtgctccatggctgtttttggagtcagggcttacactctttggttcaaaacttattgtagtaaactgtattcccagaggacccctcaattaaagtatcactaccctcatagaatggaagtgaatgtattcacattcatacacaatgatggattctttttgctgttgtatttgttgtaaaagtcgaggctttccctttctttcaaactctataatactgttgtttttccccctaaaagcatcattatacacacagtgttctaagaaaaagtgcaccagggaattagcactggggcctgaagtactctggaatgtcccttttattagggcaaagtctttcctctctttcctttccatttttttttttgtttgtttgtttctatttaaaagctctattttaggctgggcgcagtggctcacgcctgtaatcccaggattttgggaggccaaggcggacggatcatgaggtcaggagatcgagaccatcctggctaacacaatgaaatcctgtttctactaaaaatacaaaaaattagccaggcgtggtggcgggcctgtagtcccagctatttgggaggctgaggcaggagaatcgcttgaacccaggaggcggaggtcgcagtgagttgcgatcacgccactgcactccagcctgggcgacagagtgagactctgtctcaaaacacacacacacacacacacacacacacacacacacacacacacacacaacctctattttaaagaaaagtcaaagggaaaaactccacctgtgtttgctctaccctaagtcaattgctttcattttcctttgttcctgtctagtctctattatgaacatgctactcaagtttttattcattcttaatggctttatgatatttcatttagctggtcttttttttttttcttttaaatccaatctttcccttactgcgggatgttttaaggtcaggcctcagtgagcctctatgcacatatggtttcttcttctggagtcttttctggaataattctgggagtgggctcagcctgcgggagagtaacatttttataacttgatagatgtagctgagatgcctcccagaggggagacccgcctctcctccggcagctgtgcacgtaggcttgttcccagcagcctggccagggtggtccacctggtgtttctcatcttctttccccggagcgctgactcctgcgcgtcctcttggaagactcttgacaggacgggtgttttatgggtgtgattcagtgtcctcttgcatcagttcaatgtggtggtgttcaatcaacccttgtagcgttagcaaaatttgctcaagtcattccgcaggaatgtctgtgtcttgcttccaagaaagcttgtaagtgccggcaacaggccaagcagctcacaaacctgaccacaagcctgtgagtaattgtggggcagcacttagcagtcttttattttcgacttattaaagtctcatcttggcctcaccttctccctggaaggtggcgtgggtgggaaccactgggtcagatctttttcacccttgccgtggagccagtttcctgttgcatgtgggggaagcaacatgtggtgaagagtatagaaaacgaaaacatgtgggtacagtatgtataagtggagggaacaaactcataattccaactagtttctcatgagagactcatgaatcattgtggtagttctcaatataaacttaatctaggccggatgtggtggctcacacctgtaatctcagcactctgggtggatcacttgaggtcaggagtttgagaccagtctgaccaacatggagaaaccccatcgctactaaaaatacaaaattatccagatgtggtggctcacacctgtaatcccagcactttgggaggctgaggcgggtggatcacttgaggtcaggagtttgagaccagcctgaccaacatggagaaactgtgtctctactaaaaatacaaaattagctgggcgtggtgacgcatgcctgtaatcccagctatttggaggccgaagcaggagaatcgcttgaacctgggaggcagaggttgcagtgagccgagatcctgccattgcactccagcctggacaacaagagcaaaactccatttcaaaataataataataataataaacttaatctctaactctgttactccctgtagcatttgcaaggaccctagggctggatgtttctcagagggatagtctagtaccctagctcatgctcgagttacttctgtgcaagtgactgttcttgtctgggtctgtccttgaacatctctggagatgagaaaatcaccgagatttaactttgttccatcctttctttcactagagattgagatggacgtgctggtgtaatcctttcttcttggccgctgccctggggtgatccacacaagcccagtgctttcttcatgtcgccctcgtagggctgaaggtggcagagtactctacttctcgctgttgcgtttctttatttgacactcacctaagataaaaccttttgtgactcctgactcttaatttttctcctgtttctcagttgacagtggacttatgcccaaactctagctgaggagtggaagaacttgaatagaacctcatccaaattcctgggtagcaagtctgtgttcctgctggtgatagtagtagtaaagttattgtagtgtttgcacaagaaaaatgtgaaaattcaggaccaagtttgggggaaaagtagagcaaaacaaaatagaagatcaaaagctgggaattagtaaaaaagaagtggatgaggaagaatggtatgaagaaaaatgagaaaagcaaatgaaaatgaggccatgcaaaaaatacatgaatcagaaaattaaatctaggaatgggatgattatagagaaggaaagatggttcggtgtagctggtgatcagtagaggagatagtcacggaggaggatttatccatcaaatatcgtgtgcctccaccacacaagtttctctcctgccttcctcttcttctgggactgtccgaaggaccagagtaagtaccacagcatctgttaaccctttgctattgttaattgttagatgtgtcttgcttcctcttctccccatccccaccccacaaacaaacagaagtgcttgatccaagatccctgagggtatctgtcccctgagagggtcagctcggccaggctagagcgtccagtcactcagtcaaactcagtctagatgttgctgggaaggtatttggtacatagttgactttaagtaaatgagattattctccatagtctgggtgggctaaatccagtccattgaaaggccttgcaagcagaactgagatctccctgaggaaggagaaattccacctgcagactgtggggtagttcctgcctggagttgccggcctgccctcctgatggcctgtccatggctttctgacttgccaggcccacagtcacatgagccaattccttgaaataaatctcttgatgtatgtgtgtatgtgtgtgaatcttactggctttgtctggtagaaccctgagtgatacatccctaaacctttcattcgacttaacatttgtttcatagcagttgggtacgttattaactatcttgcattttctcctacttcacggatgtcttgtggctcctctcagcctgggcattttctcctaccaaatcaggtgcaaaatatgtgccccagctatgcatgtgttactccactgtggaaaaatctcaggttttaactaaggaagcagaagcaaggagtttttcaataaaaggggttccttaacactgtctgggatctctttgcccaatgattttcaggacgcgaaaccatgttttgaactaacagtgattgtagtattcattgctttgtatgatttttaaataatcttttctttgtatgtgtgacttgagaattttaccttaaaatggagtaagtactgattgctaaactgatcaatgttaacagaaccacagaagggctggactcaggtagggttcccatctccgcacagctgtgttgcccgtcacctattataaggaatcgcttgtcagttccctgtttcaacacaagcacttgtttctgcctgtcatgctgctgcgattatttatcaatgacaaatgattatttgtcattgttatgataatattaggccacagatgtcacaaggctttgggtggaattaagctcagtggcaaaattaagcaacctgagcttcaaaacatcctaaatggaaaagctttagttcagcaccaagtgcagcagggagaaactcaaacgtttgccttggggacatgatatcctagttgtggagcttctcaactgaatgccttgtggtccttttctttctctatatttagcttcttggtaaaaactcaagctttgagaaatccatttcagaaattcaaatgggcagaaagaagcagtgaggaagggaaagtatcaaaacgtttttccctttctaacttgttctactggtgaatagtgactgatggaagacccacagccctcctctagatgaaatcaggcagaactgagaacatgggagttggagggaatgtggttcctcccaggtcatggggcagcatggagaacccttctcaggcgttagttaggggctgttagctcagatgatacaaaccaaaaaggacctactcttgagtggctcaccttttttctattttgcaatcctaaaaatgattttttaaaaatcagctctaaaaatactaaatacgattctaaaagagccaagccaaataacactgcaagtatagggtggcttccatgtttgcatacttcccagtttgaatactaaaatgaaaacttggggctgtttggaatgttggcctggaaagcaagggtgagggagcgactgcaggccgcctggctgcctttcacagcattccagagcccacgggggtgcgaggggccacagcccaggccttccagcagcctggagagagggcagggagccacccttcctgcctccagacctcctgccagggagaggaggcgacaatgcctgtgttccacacgggattcttgacggttccgggagtttctgtgggccttaggtagatatcccccagcccccgtgatgccccgacccgttacagcttcgctattgggagtgaaaggaggcgaccctcctcagcattgcagtgacttgcacagactgattcactctccttagcagtcagtgaacatgtggtagggtgatttagaactcgaaggaaacctggtgagataccatttcaccctaccagattagcgaaactttgcaagggtgaggacaccaagcgtggcgaggctgaggcgcgacgggacctcttctacacaattctggaggccggggcgccgcagtgacggggagaaggatgctctgggccccagccgcggcccgggccctgtgcgcgtgaccctggctgccctgctcacaggagccccagactagccaaaggctcatggccgcagggtggatgactaaactcatatctctgcatcaaggagatggacacatgacgcaggtgaatctgagaaacaggatggtgagagacaagtcacgaaagaacgcgcgctcagtgattccacttacaggaagattagaaatgggccagcagcaaacgctgcagctgaggaatgtgaacacgggcggccagtctgaaaagcgggaaagccgcaattgcaggagtcagggtgcgggcctctagaagcgggcggagtctgcggcaggcgaggccaagcgtttgctttgtaattctcctggaaacgtggactgtggcttgttcagcctcgatatgcttgtgtcccgtgtgcgcaaacaaaacgaaacgcaaagtggctctctaaaagggagtcgcgggtcacagtgagtggccctggccctcgccctcgccggtggtggcgtggctgtggccgtcctggctcctgggccaggccgcctgctcccgcttcaccgccgcgctctctgcagacgcagggcggtgtccaagccagcacacggacctgaggcacctggctgtcgcccgccgcagccggttgcggggcacggcgggggtttcgaaccccttttctcgcttctcgggggacccctggggctgccctggaggcccaggaacctcgaggccaggcccaggcgccccaggctcgcagcagggcagagggtgcctccctgcaggccgctgtgccagggtccccgcagagccctccgggcggagcaagcccccagcttggagacggccttctgggcaaagacaggctctacccgcaagcctgggagggactggggccgggtgcgggcgaggggaggtgccccggggtagggaaaccgggctcagccgagggcaggcgggcccgcccaggccgcgatgggaagggcgcgacgcatcgtccacggtcgggctctcgcaggcgggccagcgctactgcctcagtcctacagagctctggtgaaagacagcgctcagatgagacctggggcggcggattccgcgggagtgctgcctgtctgagccgtgaaggcgtaggggaaaaggtggcggcttccctccgtccgccctcctgacagtggaaatgcccaagggggaggcatcctctgacgggagggacctcagtggagcgcagctcttgcagatcattatctgcgcttgcctgcctccatcccaaagccacgtgaggccaaggaacacaggtggctgatcagacgtctaaccttaatacataacaacttgcctcttgctttgcaatttacattgcagaagattccagggccccaccttagcaaacaaacccatggttctaagctgcatttcatcaaagaatatcactttttacgaactcattaaaagctgaacaaggccggacttgcaggcatgtgaagcctggagagcaccttcccacgtcttttgatggctctaatcttactcccccctgggtcctaggcagaaatctagaaaatccttcatgtccttttactacgatgccccgtcctcacgctccccttgtcgtcagcttctctcactccctgcagctgcaggcggtccgtaggttgtagggtgagctaaggaggcagggaggtcaagaggaattgatttcaacccctagtagattgcagggatggaaaaggtgaatttgtgtttgaccatttcacacacacacacacacacacaaaaaatctctttttagtgtatacatatgtgtgtgtgtgtgtgtgtgtgtatttttttaatttttatttatttatttattttgaaacagagtcttgctctgatgcccaggctggagtgcagtggcatgatctcagctcactgcaacttctgcctcctgggttcaagtgattctcgtgcctcagcctcctgagtagctgggactagaggcatgcaccaccatgcccggcgaattttttgtatttttagtagagacagggtttcaccatgttggccaggctggtctcgaactcctgacctcaggtgatcccccacctcagcctccgaaagtgctgggattacaggtgtgagccaccacgccaagccatttataacatatgataatattatagttttgtcatgcaaaattcaatcaaaacactatcataggttgaacatccctaatctgaaaatccaaaatccaaaatgctccaaaatccaaaactttttgagcactgaaatgagatagtgatacctttgcttttctgatggttttgtgtacacaaactatttcatgcacaaaattattgaaaatattatataaaattactttcaggctaggtgtatatgaaacagaaatagattttgtgtttagtctcagctcccatccccaaaatatctcattatgcatatgctaatattccaaaatctaaaaaatatcagccatccaaaacatgtctggtcataagcatattcggtaagtggtactcaccctgtatagtgctttggagaagattttgggatcctgctctaaagaagttaggatggaagtggtggtcatgaaattgtctttttacaaaactcatctatgccgcccaatttctccacgtaggaaggaatcgtgtctcctagtgacctggaccttgtcatgtcagaagggttgggcatgcggtatgcattcattggacccctggaaaccatgcatctcaatgcagaaggtatgcatctggggccaggatgggaattccattctatttagtgttgtcatgggttttgtaaacagtcacattttgccttttcttacaactgaatagagacagtatataggagatgatggccagccctggtgattcacagacaaggcagggattcgaaacgctgtgtactgagatgtaaatccatgtggagtgcatgcacctcagggctccgtgtggtgcattgtgctcaggtgagagctcaaaggaagagaggttggtgatgtcacagaaacttcgcagcatgtcacccagcctggcagaagggaaagtggtagtttcctgaggaagatgatgacattatttacagaggcaagacgaaaagataggggactgacttaacccacagggacctctgctggatatctcttctgcccaaatatgagcaaggttttcttctagaaggctagggagcctatagtgagggagggcttccacaggctgggagctgaggaggggcatatgggtggggcagaccagacattggccagacgctgcctccagaaggcttggggggaattaggtctgagcccattatctgtgatctggtaactctaaaggaaagacgacttgggaaggacaagaaacttccaagaatgaaactctgtcaaccagattttaattgatccaaaaagaaaatgtcatttgataaccaataaaacctatagcaaattaaaacaaagtaaaattttaaaactatgtataaaatctggagagagatgtaacctagatgttattattgccagctatctcttggtactgagattataagtaacttttagtatctttttgcttgtctgtgttataaatttctacaattactatagattaataacattactaacttagaaaacatatagaaagagaaaagaaatattgtatgcagctccatggcctgcatttaacaaaggatactgagaagctggggcttatccagaaaaaagtgaccagagtctctcgtatgtctctcggtctgtatgttttgtgggggcggaagtggagtgaaagactggaaatggcaagcagacagacaggtttgggctcagtacatggcaggaagaacttcctagtaacaggagctgatgtccaggaaaggcccatgctttaagtgggtaagctgaaaaggggatgtggttgcctgcctgtgggaggtttagatgttgagaggaaactccctctgcgagaggggaggttgagagttggtgacctctctcagtctgtttgacttcagttctataatttcagtattacattttggtaatagttcagtcaattttcacagtagttaatgaaatatgctgtccaatgaataattcaaggaagctttactagacatgttcctgcatacagcaggtgcacagatgatttctgaagtggatgggccgtgtgttctctgcttcagtccttatcagaatcaagctaagaagagctaagaggagtgaagggaagaggggaatctgctccagcacgtgtgtgttagttttatgggaagataaccactgaatagaagaagataatgtagagaaagatggcctcatgcagtgaaacaagagttttcttgtattattaacacaaagtcttagatcatttcaaatggtgttttcaaccagaacctcaaaacttgtgagcatatttaagcatttgaaatgtatatagatttgtatatatacttaagcatttgaaatgtatagaaatttatacatttgaaatgtatacagacgctgcctgataaccactgtgtttttctttctcccttttttttcttgagaaaaataagataattgaggaatcataagaaatagatagggacagaactgagaacagctttgactttcaaacaaatagaaacagaagccaatgaaaccagaaactcaagaatcaaatagagtggcagacaggaaggaggcccataacaatttttcaaacaaagcagatacgataagaaaacctaattggcttcatatgataatggtggacggatgtagttttcaacttcagagcattccaaagaccagagttggagagttataagatctggctgggaacccatagaaatgtttatcattcttccctgtgtcacccagaatatatcaagattggagttgggagaatttttcttcttttctgatactgttttcataaagccagcatctcaggttaagggtagttattagcctgaaaagctaccatttatctagaactagtgcaaatattttaggatttatttttaatctaatgaaatagtttctgagaaacaggaggccagcgtgccattgccttttggctccttttacaaacaacacccctgaaagacgggccctcagaatggtggttctggcctgtggagccagccggccggctccttaccctggctttccagcctactggctgtataaccttgggcaaatgacttaagttcactgcatctcagtttccccatctgtgaaatggggacaacagtaactgcttcctcagggtggtgtgagaattgaaccagatggaagctcttagctggattgctggcacctgttaagtccttaatatatgttatattcaaacagagctttgtcttgtttctttcacgtactacttttctagtttttttcgttgttgttttatttttggtttttaaaattcttccaaaaagattcacaagtgcagagagaggaataaatacagattaggattttatttatttatttatttattattattatactgtaagttttagggtacatgtgcacaatgtgcaggttagttacatatgtatacatgtgccatgctggtgcgctgcacccactaactcgtcatctagcattaggtatatctcccaatgctatccctcccccctccccccaccccactacagtccccagagtgtgatgttccccttcctgtgttcatgtgttctcattgttcaattcccacctatgagtgagaatatgcggtgttgggtttttttgttcttgcgatagtttactgagaatgatgatttccaatttcatccatgtccttacagaggacatgaactcatcatttttatggctgcatagtattccatggtgtatatgtgccacattttcttaatccagtctatcattgttggacatttgggttggttccaagtctttgctattgtgaataatgccgctataaacatacgtgtgcatgtatctttatagcagcatgatttatagtcctttgggtatatacccagtaatgggatggctgggtcaaatggtatttctagttctagatccctgaggaatcgccacacagacttccacaatggttgaactagtttacagtcccaccaacagtgtaaaagtgttcctatttctccacatcctctccggcacctattgtttcttgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgcttttttcttgtaaatttgtttgagttcattgtagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtttaaagtctttaatggtttatgttaaagtcttttatggtttaagtctttaatccatcttgaattgatttttgtataaggtgtaaggaagggatccagtttcagctttctacctatggctagccagttttcccagcaccatttattaaatagggaatccgttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagcttgaagtcaggtagtgtgatgcctccagctttgttcttttggcttaggactgacttggtgatgcgggctctgttttggttccatatgaactttaaagtagttttttccaattctgtgaagaaagtcattggtagcttgatggggatggcattgaatctgtaaattaccttgggcagtgtggccattttcatgatattgattcttcctacccatgagcatggaatgctcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcaggccaaaatctccttaagctgataagcaacttcagcaaagtctcaggatacaaaatcaatgtacaaaaatcacaagattaggatttttgctatggcatggagaagcctctggaaccaggtacctagagtttcccagccgggtttgtttctttgctaagctttagactcgcaggtcagtagagagagaaaccgctcagccttgtccctggggctgtttgggttcctcctgcattttgttccacttgaaatgaggacatctcagaatctggcagcgtggaaatcgcctccaggggaagtggatgtttatttaccattttgcctcacagatttcctctcctgtgtagacacttgcctttttcaaaactgagatgcctggtggctggtgggtttggttgattgatgggaagcaattatttgccagccagtggaagcaggtgagctgatgggcggggacttgctgaggtgaggtgaggggcccgggtcggttctgcctcccctaccctgggcaagtcctcactcaggtgggaatttgatcctgagagtaggaatgagataatgtcgctctgtgctttgaggcatttttgatcttccttaatgagttctgtgaaaccctgtctctaaaaagcaggtgaattcatacaggtgtgggttcatagctgcgtgaaagaaaaccggacttcccatgtatgggtggcaattaaggctctccaaggagctgatgcctggaatccctcctagtggctgtggcctcgggctggggttaaggcctcctctggtgcctgctgcatacatgggaacagaaaggattcctgcctgtgcacctggggcattcaaacccactgtccctcagaggcccacagcccaaggctcgcaagttagaaagcagcaagttaagctacatccaatctcatgagaatcaattcttttttctactctttgtctttttctggataagcatctcttaagaaattaggttcagaatcttctaaaaagccaagctctacaagggttttggaagaattagaactcaaagggacagagggcatggaagcacagaagaaaaaatacaggggaggctggattagatagaaatagtggggaagggcagaccaggggatcaaaagtgaagtgggctgtgttgtatttttcctatttccaaagaaattggcattttagagtaatttacacccaattctcctctcgtggtgtagagaagccaaaataattgttgaaaataaattacacctccctaaaatggaaggggaggagttgcaaataacagtcacagtcataagtttactgggacatggttgtaaataatcaggcagatgcaggtcgtgagtctaagtcactgagaactcctgcccttggagcacccggaggctgcacccatctcatggtgagcacgtggtgtgggcgcctaaacttcatcacagacagtgaggctcttcatcccaagagcatgttacagaaagtttttatatcagtaagattgacattttaaagggtttcctgaataaaaatggggaaaattatgaattgcactattatgaattccagcatgataagttttaaagggacatttatttctacaaaacagaataaaacagaataaaagttttgtagaaataaatgtccctttaaaacgttacaaaggcagaaaggaaagaaagttctagaaagctcctgggaggttcaaatggtttcacagaacagggagagatgaacacttgctcagagaatgtgacatgttccagagagcaagtgctgcgtgaactgaacccctggcctgtggctgctctggtaggagagggagatggaactggctgctgaggggtctcgtgagggcgcctgcctgcctgcaagtggggggatatgcagccacagcagctctttccattttcttctaatttaatgtattttcaacttgattcttgtgtctctgccctcccccaccccaaaaggaaggaataaactgtatttgtgtctagattttgtctcctttagttttaataaataagcaactagcaaaagtgaagtaaataatttcccaaatgaaataaatgtgtaggttgttttctgttctccagaaatgctaagccatctacagtacgtatccagtgctggaaagctcaggagacttccagaattctgcactgccaaattaacacttaggttaaatgagatgacaccccttcttttataaacagagtacccatccgttaatttcagatgctaatgtcagaaaagttggtatgtttgagtcttttacccttcaaaaccattttgggggaaattttaacacactgagagagaagaactatttgaagcaaataaattgcaacccaatgattttaggctttcaaatcagcataggtcaatcaaaactaaaccccaaagatgatgtttgtttattttttgctttttgagcgtatctagtaccgatggttcgtattttaacttaatcatccacggtttttgtggggagtgggaagctgagctggggcaggctctgcacgttctgcagcttcgtttgtccccatgttacctttgtaggcggactgaccagctgctgagcctttaagggtttgaaagatgtgggaaatgagtcagggtcgcagcagtagcccagcctatgtcctccatggcgcccaggactagaaacgcctcctcctcctcttccaggatcccggccctggcttctgacttgacttgctaagcacaggccggcaccagcccgttcgcctcccggcagcagggaggggaggaatgtgagggagagtaagtctgcggggcccagcgggtcggggcaggccagtgctgggtgggggccgtgactggcctgcgctttcccctgggcgcaccccattctcgcacagtcagcctagcccgtgcggctccctccctctccctccaggataagcctcttcctgcatctcttcaccaaagtcccagggccctctccttagaatctgagaaatcatggctctccaaggctggggagcagcaggagcgtggggagcgtgcatgggggcttgtgcagatgagcgcctggctccatccacccaaaccagcaaggtacaagccaacgtgagctctccaaccggtgtttcaagtacctgcagccttgaccgtacccaatacagtgctaactgagatctgtggtctaacagtgacataagtgacaggtttacctgagatctgacatttttaattcttggaaaatgcattcaaacgttgtacacaaataaccttgtacacccatggttggaggaaacacttggtgacattaggacttactgtgatagccaacaaatcagtgtgtgaacgcaggccaaccggagggtcccatgagatgcaccagcagaggtggcatgcaaggtctgagggacctggcactttttttttttttttgagacggagtctcgctctgttgcccaggccggagtacagtggcgcgatctcagcccactgcaacctctgcctcccgggttcaagcgattcttctgcctcagcctcctgagtagctgagattacaggcacctgccacgccacctgactgatttttggtatttttagtagagacggggtttcaccatgttggctaggctgctcttgaactctcaacctcaggtgatctacccgccttggcctcccaaagtgctgggattacaggcatgagctaccgggcccagccaggaccagcactttttggcattcgaacccccaggagccagcgtggacagtgcgtaatggggagggtcgcttctccagtgccagcaggcccttacacatgccccagctctgtcttgtcttcacagggagggaagagtgtagcttatctgaccccagggtgaaactctctgaatgcatttctgagtttgaatataactaagaatgtttttttctgagattgtggattcttgtcttcatacaattccaggtatgttaagctactgcgacagatacagcgaaggcataaaacatgtcctacagacttttggacccattccagagttttccagggccactgctgagaaggttaaccaggtatgtaacttctctgcaactcactgcagagaagcatgttggctacctggagcacttgctgcccctcacctctgcagcgggtgggcctgcctctgcagctggaatctttacccttgatcttggtggttcctcattcataactttgttcatacttccatcgtgtcaccaggacaccttaaggacagggtgaccagtgaactggtagctcattgtgacttgtctctgagggactgaggtctttcaagatttggaaagctgctgttcattgagggtttattgcttttgtctttgaaagcagtttctgcacagtttgcataaacaagagcaataattacactcttgataaattatttcctctttattgtccttttttttccttctccttcttgcaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattcctt

SEQ ID NO: 38625 - DNA, 12782 bp, Homo sapiens
ttttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtggggtgcgtgaggaacgcaggggcttgaggccctgcggggcggggacggccggggagagagatctggggccttgggcggctcgggagatcggagaggatgaggggctgggagcggcacgcgagggtcaggggagggggagaggcgccgggggcggacgaagtcgggccgagggtgggcgtcagggggaggggagagagatctgggggcggggcaggagggggcgggtatgacccgggggcgcggcgggggaggcgaggggaggggaactagcgcagggggcggggcgggaggggaggtctcgggggcggggccgcaggagggtccgatgcagtggcgggggattagggcgacggggctgtaggcagttgggggtcagtggaacgacctttggggaaaaacgggatcatgagtcctgagccgggtggtgagggagagctctgtctggggacccggctggccgaagaggccgggatgatttggggcaatctaggtgaccatggatgggagctgagcttggaggaggacgcacagctgtggggtggggtggtgaagagttgttttgaggtatccatgggaagaggggttctggatttggtatctggagcacgtgggaggctgatgggagactagaaagagtctggaaggccagggaggccggggtgggcagcgtcgtcagtgacctgggatgtcctggcgaattgagagggaggggctgaggaaggtgtgtgaggagagtggaggtgagggattctgacagatggactcttacccgggaggggcctgagaggagaagacgggtgagacagacgcgtcttagcaggctgggagaaagagcttctctgcgaggcttctctgccacgtcactgtgccaagtggattatggaagtgggagaggaggggaaaggagatagatgccgggcaggcttccggattgtctagggaggacttggagagaagggcctgagcagggctgagccagctgggagggccggggaagaagtggagctagggaaggtgcaaggctgagggctgttgggttgagaaaagggaaactggagagctggggccgctgcagggagctggctggccagagggtggtggggactgatggagagggactgaggaagtcagccaggcagccaggacacgggtctgtaagcaatagtggaagggattgtgagggagtgggggctgggagaggcagggaggtggcaggaagtgggggtcaggaatcacggggcagtggggtggtgatggaggtaggggcatagtgaggacgtcagggttcctgggggagagcaggagagcaaaggctgagtgagggagggagaggggtcagggagagaagggggcaaatcgggggagcccttcattgattcaaccaatagtgggtggggggtgctggggccactgggactgggcatgataggaaggatgcagggtatcggggtgatggctggatcagcccagagcctgggcggagaggggaaggttggaggggaaggttgggaaaggaagcggtgcggaggtcccttgtggagcgagactgcatatccagggtgtgtggggtgggtgggcaccaagtcctgttttaggctgcagtggtggacaggagaaggcctctgctgtcccagggctcaccttctagagggagccgatggacaaataaaccaacagaccttggatgagcgctcaggcgatgagtgcttggatgagtgcccagggcctccaaggagggtgagcaggggccgtcaggtggtttgggaaggcctctcccaggacacagtgagactcagctgtggggaaatctgcccctccttctctccctgcggcagctctagccctttccagacccccatcctcctcccactcccccggagaacattctgggcagaaggtgcagacagtgcaggggcctgcagtggggagcagctggggtgtgggaagaactgcggggagcccaggggagacaggccacgggagggcagtgggccaggctgggaagggctctctggccaagggaagctttaggattttgcagtgggagggcgttgtgcagtggagtgatgctgacgctccctggctgaggttccagaagggtccctgtggctgcccaggggggcagggtccatggctggttggggtgaggtgccctgggaaatggcattttgttggaaagacccagatatcggatgaggccggggtgggtcttcatgagtcatctcctcttccacccaagatgctcagctgtgggaggactagataggcaggggtgggacgaggagggagggctgcccgggtatgtaagcagagccagaggagtatagggcttgaactgagagcctggcctcccagaaggttttaatagacctacggcacagaaattgacacagcccgtaagttcatgggaggggcctgagaggagacgggtgagacagacgcgtccgagcaggttgggagaaagggcttctctgcgaggcttctctgccaggtcactgtgccacgtgggttacggaactctccttggtgtagggctcaacagggtggagccacgagtccatgagctcttcgtacttgcacagccctaggcctggcatggagtggccagggcgaggctggttctgctgtccgctctccccagggtcccgccacgagggtggcgtggcatggggcacatcgcccggacttcctgtccctcttgggtttaggaatgggatggtgaggcctccctggcagcttgttaggaggagtaaaccaagcgagccgaccagctcccagcagggtcctggcacacagtaggtgctcagcaaacgaagctgtgacctgagggtggagagtcttatggcagggagggagggaggatgtgacaccccttgagtctcctcaattcctgaggatgcgggctgggtgctgtggctcatgcctataatcccagcagtttgggaggccacggtgggaggatcatttgaggcaaaagttcgagaccagcctgagctacatagcgagaccctgtctcgatagaaaaattagccaggcatgatgatgcttgcctctaagtcccagcgacttgggaggctgaggcgggaggattccttgagcctgggagctcaggattgcagtaagccatgatcgtgccactatactccagccttggtgagagagcaagaccctgtctcaaaaagaaaaaaagcactgaggatgtcaaggtgccttcacctcaggaggggtgctgtcaccccattttacagatgaggacgctgagggccagtgggggcaggacttgcccgatggtgcagagctgagtggaaccagcatctccttcctccaggggctcttccgcctgcagtagaaccatctggtggctgcaggtggcccctgggaaccaggtgtcctggcccacataggcagggacacgtctggctgatggtgctggggaggggcagaagctcctctgtgtgactgcacgtcagctttgccggccacctcgggaggatacactcactctccctcggtctgttcccagggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccagggtgagatatggccctcctcgggcccaggttggggctgtttgaggttctcggccctggtgcctggccctggatgcagaagtcacatgagcaaccgtgggggtgtgagggtcacccttgggagcggctcatcaagggcaggtgctgggggaagggcagcttcctggggagggggtgggagcagagacttggagcagaaacgggctgcccaggcagtggggtgcttgctcaggctgaggggtggctgcacagcaagtcctgcaggggacctccagcctgacctccagcagaagcaggctggggcggtgtgcgtggcccccaggcccaccccgggaatgagggggcttgggccaggacagcggcgtgctcactatcccgtctctgcctctctttcttgggctgccttccagtgagaaaggaacttcaagccgaagccaccgtcagcgggagccccgaggccccagggaccaacgtggtaagaacagccactggtggcactgtcccatgccaaggggtggggacagcttgactgtgtcacgggggagatgtggcctctgcccttggggctcaagggctgttggaaaaccttgccttgcaaggtggacacaggttgtggtggaacacggtgttgtctgggaccttcggggctcggcagctgaggatgccggctcaggcctggagaagtgggcctcaggtacacgagcccatcgctccctccccttaaccccttaagggcagatgcagttacagtttccactattcaaaaagagaaccggggttgagagaggtgaaaccagctgtcctctctcctacaccccaggaccagcaaaggcaggaccagagccagtctgtggtttcagagcctgtcccctagcactgcccagtcctgcctgccttggaggtcaagaggctctgtggagacgggtggaatcagggaggccttcctctaggaggtgggccttcagagctccgctgaaaggagttctaagcagcttgaccctcgaggattcagtgaattttagcacgcagggaccttagagatggcctagaaatggaggcccagaagtcatgccttgtccagcgcactgtgcccgcagacacccacacagagctccttcctcaacagcttggggacaggaccagcaggaacccagctgccatctgctgggtgtttcctgcgtgtcagaagctgctccgtactttccgttccttacctcgtttagttctgagcaggccccacagggacatttgacataccagggaaaagactcggggatccggtcacttggccagggtgtctcccacggccaccaggtggaagggacagcatgggggctggagatgtctggttctacgggccacactcaggactgtggtgctcggcgagggtcggggtggcctctgtccacggtccagacttggacgctttcaccgccccaggtatctgagcccagagaggaaggctctgcccacctggctgtgcctggcgtgtacttcacctgtccgctcactggggccaccctgaggaaggaccagcgggacgcctgcatcaaggaggccattctcttggtgagtggcaccctgtgtgctcctgccccaacctgtagcttcctgtgcctgagccaccctccatcggaagcccaggtggtacagatccctcccagagtccccagaggccactgctagtagtgaagcccctcctctgataccccaaatccaggcacaccattgtgtatgcatctgtatctcctctctcccaactaggtgtctttttttttttttttgagatggagtctcactctgacacccaggctggagtgcagtggcgcattctcggctcactacaacctccgcctcctggattcaaacgattctcgtgcctcagcctctcaagtagctgggattacaggcacctgccaccatgcctggctaatttttgtatttttagtagagatggggtttcaccatgttggccaggctggtctcgaacttttgcctcaagtgatcaacccgcctcagcctcccaaagtgctaggattacagacgtgagccaccacgcgtggcctggttgtttttcataaaaggttaagtattatttgcttcaatacagaaagaacttcctacaaaattagccaggcatggtggcacatgcctgtaatcccagctactcgggaggctgaggcaagagaattgcttgaatccaggaggcagaggttgtggtgagccgagatagcgccattgcactccaacctgggcaacaagagcaaaactccatctcaaaaaataaaaacgtccacagcatttttttccaatacagcaagtcctcacttaacaccatcaataggttctcagaaacttcggctttagcctgggcaacatggcaaaaccctgtctctgccaaaaacaaaaaaaaatagctgggcatggtggcgtgcacctgcagtccctgctactcagaaggctgaggtgggaggattgcttcagcctgggaggtagaggctgcagtgagctgtaatcatgccactgcacaccagcctgggtgacaagtgagaccctttctcagaaaatagtaagtggctgggcgcggtggctcttgcctgtaattccagtgctttgggaggctgaggcaggtggatcacctgaggtcagaagttccaagaccagcctggtcaacatagtgaaaccccctatctactaaatatacaaaaattagccaggcgtggtgacaggcgcctgtaatcccagctactcaggagactgaggcaggagaatcgcttgaacctgggaggtggaggttgcagtgagcccagatcacgccattgagctccagcgtggacactgggtgacaagagcgaaacttcatcttaaaaacaaaacaaaacaaaatagtaatagttccatagactctccagactcacacccactccagcagtgtgtgcaaaagcacccgtgtccccatcctctcaccatactgtaaatcaccaaactttgatctttacgcctgttggtaggtgaaaataacatctcaggatagagttaatttgcactttccttattttggattggccatgtttcatatgagaatgcgtcctttctacattatttagtagatagtttgtctttttattagtgatttgtaggcactcttttttttttttttttttttttttttttgagacagagtctcgctctgtcgcccaggctggagtgcagtggcgccatctctgctcactgcaagctccgcctacgaggttcacaccattctcctgcctcagcctcccgagtagctgggaccacaggcgaaccgccaccacgcccagctgattctttgtatttttagtagagacggggtttcaccatgttagccaggatggtctcgatctcctgacctcgtgatccgcccgcctcggcctcccaaagtgctgggattacaggcgggagccaccgtgcccggcagcactctttacatattaggcaatttaggcttttgcctatgatatgagttgcacatgtttccctctagttgcttctatgttggctctgcttatggtcactttgctgtgtaggattttttgatctctgtataattaaatgtgtcagttttagttcatggcttttgggtttggggtcattcttagaaatgccttccccatttccatgctgagagaattcttttgtggcctctccagtgctttttttttttttttttttgagacagagtcttgctgtcaccaggctggagtgcagtggtgcaatctcagctcactgcaacctctgcttcccgggttcaagcaattcacctgcctcagcctcccaagtagctgggactacaggtgcacgccaccacacccgggctaacttttgtattttagagatgaggtttcaccatgttggccgggatggtctcgctctcctaatctcgtgatccgaccgcctcggcctcccaaagtgctgggattccaggcatgagccaccgtgcccggcctccagagcttttcttctggcttctccttgactgcttgcttgtttccatggttgaagctttgatccagctggagcatgttattatgtaacatggtgggatggagctgatgtaattttttttttagatcttggctcagctttcttctcagccccacctgtcgagagcacctgtcttttgcttacagctgtgaaatcccacctttctcacaaagtacattcctgtatggatttggaccccttcctggctgctgttccttcgtcccttgtctgtgcatgtacccagctcctgacctaagcctggcagccagtcgcccaaaacgcccgaggcccgcttttggagctgacacgcttcccttggctggtgtgctgtcccgggcgctctgatcccaaggaagctgttgtcttggggacatgcccatctggcagctctgcctctctgcatccacgtgctctgtcccgctccccacatcatctcagcaactaaaccggcagactgggccgggtcccaattttcagttggcatgagccccggctcagtgtgtaggtcattggtccgtgtgacgcagggggctgctgagggaccctgctgtgcagttgagggtggggggtggtgggtggagctctgggctgcctgggcaggtggcccgaatcctgacacatggccctgggctgcccttctgttcacccgccctcgtctgggcagcccagggaggtgcgggtggcagccctgcttcccaggccatgggtggctctctgggtgtggccgtgtgtgatggctgtgccgagcgtggatttgtgccccaatcttttccaggtcttagggtacgtactgttctcagcctctccatgctgggacgctgttcgcagtcagcagggctggttctgggaaacccccagagttccagctatgacttctcccctcccccggtaacataggtggataggtgggacctcggggaggggcaggggctgggggtatccgtcttccagctattgagtttcagacattgagggttgcagactcatttgtgtcctctctgccacctgccatccctgtgaccctggacgatgggcctctcggtctctttgtaaacatgaggcccgggagtggttccagaacgtccatcatggggctgcgagagcaggagggatggggcgtccatggtggcgggaggttctgtaagtggcggtggccttgatggatctcagcactgaggtcgagttctaaagccagagtgtgaggcacagttctgtcgcgtcacactggcttccaagtcccatggatctagccttgagaaggcggaaggggagacttgagttctgctgggtcttggctgcgtcgcctctgccctggggcgtgggcagggctgcggtcttggagggtctctcttttcctttctgtgatgagcgcacagctggggccgctccaagccgctgttctgccttccttttcctgcccctgttacctgggcagcggagggccgtgcggcccgggctctcagtgagtggctttccctgcttccctcctcccagcacttctccaccgacccagtggccgcctccatcatgaagatctacacgttcaacaaagaccaggaccgggtgaagctgggtgtggacaccattgccaagtgagcgtgtggcccctttgccctgcctggcccctccagctcatcccagcacccctcccactggggctgtcaccccctctggccccctcattacctgctgaggtgggttgggaaggagcataggccgagagtgaggcagctccacccagaggcctcaggcaaagggctgggcctccttgggcctcagtttacccgtgtgcaaaatgaaggtgttgaaggaatcaggggtttcccaccctggcttccttggggaacatgtggaggaggcagggtcccaccccactccccgggtctcaggatcgggggcaggcctggaggtccacgctgcccgccaacgccgagggagcaccccgcaggagccccctgctggcactgcggcccttcagctctggctctccactcttccggcactgtggcttccccaccgctgtggttaattgtgcccttccagggctggtgggacggtgaggggttccgtggggctcctgctggcaccaggggtgggctccatggggtgtccgaggtgtgccttccacccggagatggtctgctgccctcgcgtcactgggccgcttcttccctctgactagaggccaagtgtggctgagctgctgttacctggagcaggaggcacagaggggccgggtgggcagcctgggctgtgccccactcaccttctccacctaccccaggtacctggacaacatccacctgcaccccgaggaggagaagtaccggaagatcaagctgcagaacaaggtgtttcaggtgggcgtgccttctggcccccggggcccaggctgggggtgggggcagctggcctgcaggagccggtggtggcccacaccaggcggtgggctccctggaggagctagcgagagttgagccacaagcagtgaagggttcggccagtagaaggtagcaggacaagatggagagcaagacttttatgcaccggtcaccccaaatcaacaaattctgcctctcctcacctgcatccttttcctcctcttcagctgggcttgtttgggaacatgtcgactctggggaggtttctcatgcaaaccagatgtctggttcttctgggggaaagggcagggactggggtcctgggcggtgttagcctcgcatcaggccccagcagtgtctggctcctcagcctcactcttcgtgcctggttgtgactctttcctctgtgcagagctgttggagactccacagcccccaccgtagaaaagcaggtttgcatccagcactgaggcacccccagggctgggccccatccaggggtcgacagctgctcccaatagcgagagccgggcccctggactgggtggggtgtggccaggccatggaggaagccaggggcccccagtgacgcccatctccacccccaggagcgcattaactgcctggaagggacccacgagttttttgaggccattgggttccagaaggtgttgcttcccgcccaggatcagggtaagtggacagggcctggctgagtagggaatggggacgaggggcctcggggcaggagggcccggcttgggggtctctccattgcacagtgacacccatgtcctgccacgctgtagaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtgggcctgacgtccgcggagcagagtggggcggggcggggtggaagaaccccggccagccctcgtgacctggcccgcgtgtgcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggtgggcaccaacgatgcccgtggagggcggctcgggttggtagggggccctgggccccacccgctctgactcccccactccccaggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgagtgtcggcccgcaggagcaccgctgacccgatgcctctgcaggttctcctgggaccggcacagacacccccaggagggagcctccttgttctcagagcagggggcctgggcaggtccctgggtttgaatcctgctttcccacttactggcagcagggcctcgagcaagttcataactactccacgcctcagtttccccatcaaatgggagcggtgacgtgcgttagctagtgcagtaggtttaggcttaggtcctggagtcccggagggagagggcaggaggcctgggtgcgagccacagcctccaccagctgagatggcttccaggccggggcatccccgcgcccaggttgcccgctgagttccctgccgcggcaagggccgactctcggtctcagagtgacggcctacccctaccgcaggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttg

SEQ ID NO: 38626 - DNA, 69821 bp, Homo sapiens
gaattcaaagtggagtaccgcaaacttgatatggaaaataaaaagaaagacaaggacaaatcagatgatagaatggcacgacctagtggtcgatcgggacacaacactcgaggaactgggtcttcatcgtctggagttttaatggttggacctaactttagagttggaaaaaaaattggatgtggcaattttggagaattacgattaggtaagactattttgtttattccattatgttagaaacattttaaaaattggaagatactttttaatgaaaatgatttagttatttaattgtttagttgtttaatggttgtggtaattttaaagaataaagatgttggaaatttcttttgtagttgtattttcatgtgtaaggaattccctagtataggagtgtctactttagccatccagagattgactatccagattatgagaaaacaaacaattaaattaaaatagcccagtaggctgaaatagctgccagtaaagcctttgcaatgttctttaggaatgatatttaggccactttttcagattcaaaaatgtttagtaattgataacttttggggcataggtatggcttaaagtcaagttaatatactgaaactgcatacaattaatgaaatttacatcattgtaatttaattttttccttttacccttccttctgccccaagtatgtttggggtggggctcaggagtctatattcttaacaaggggctcagagtattgattcaggttattataattaggcaagtttgggaaacactggtctaattaagcttcctaactctatattcaaggcaattggaactcagtgagggaaaatgaattgtcagatgttcacaacaattgaataacaagctcaggatcaaaatctaggtattttaacttccagtacagtagtgatgtagcttttccattgcaaaaaactaagaaggagggtgttatggttataatggttgtatagaagtcagtattcaggtaccaggagggctctggtcagtggaccaccaagagtgaactttagatgtaaaaagaaaatctgacttctcaatttattttagattcaatcctgctgctagaaataaatccaattttatgtttatgtattcaactacttcttcttttcatcttgtgaagtaccctaatttgtagtgactcattcatcttactagttttggaaagttgatacacattaaatatttgaatgaagcaagccaataaaaggcaatgatatagtttatacatacttgttacatgatgtgactggcagactcaaatttagtagggactcaaatatttgaaagggtgaatgttttatgttttattatttgaagggtattgaattagatactatgaaattcttaaattgtttcagactttggagttagagaaaacattatttacgtgtttataatctgttattattgtgtataattctcaccaacatccatccagtacttattacatatttatcatgtaccaggcatgattagacattgataatatgctggtaaaatataaaaatagtgccttatggaacagataagtcatttaaccactcagggcttcacgtttttctttatatcaggattattaccacttcctaggttattgtgaggattaaatttagatgatactgtaaaaagaccaacactatacttgcatatactttggccatttttattcagaatctgattcatataatttatttcaaaataactacacacacacacagatacatatgtatttgtgtgaatacacacacatatatacacacacggcacatgtatataggtatgtgtctgtgtgtgtgtgtgtgtattcacacaaagctagttgaccattttaacaagggcaatacgagaaatatgagaaactgtatgtaccatatactgaagctatatatgtcatatactgaaaaagaggtaaagcacccctttcttttgtagtctgtgaataagcaggaataggagtatcgtggcttcttagtacatctgtctgtctattctatctatctaatttgtgtatgggtctttgatgtgtgtatatatatatctgtgtatgtttatttaaatttatttaaatgtattatctctatatatctgtgttttatgtatacttataatatgtacgcatagagctaatttaatcatttattcttcctttttcatagacttctaaaagggtattttactgctttttcaaaaagcctcagatggtttctttgttaagaaaatgttattatgagcattaatctttctatacctggataaacactaatgttaaaagctggtttatattcttaaagtactttctttaaaacctcattaatagatacatcttgaacatttgattactggtactgaaattttatatggttagtattggctaagaaagactataaggtatacatgttataggtaagtgattttcaataaaggtactgttggtatttggggctgggcagttcttttttggggtagaatactgtcccagacattgcagggcatttaaaacttgagacttgtggtgcttggcatggtggctcacatctatcatctcagaactttgggagaccaaggcaggagggtggcttgaggccagaagttcaagaccagcctctgcaacatagtgagagcctatctctacagaaaatttaaaaattagccaggtgtgatggtgtatgcctatagtcctagttattcaggagcctgaggcagaaggatcacttgagctgaggagtttaaggttgcagtgacctgtgattgtgccactgcatttctagcctgggtgacagagtaagactctgtctcaaaaaaaaaaaaaaaaaaaggccatgagatgaaaaaaaatgggtaaacatttgaaataataattttaaattatatttatttatttgctttcaaatttaaatacgtgtgtttatcatttttatctggattctgtttttcgtttagaatgaacagtcaggtgtggtggggcatgcctgtagttccagttactggagtggagtggctgagttaggaagacaggaggatagcttgattctaagaggttgagtctagcctggacaatatagtgagatcctgtctgtaaaaaaaaaaaaatgataataaggaaggtgaattgatgtgcaaatactccttaagatgggtttacatcctgataagcccatcttaagttgaaatatcataagttgaaaatgggcattttatagacataatgacattggaaaccccaaaacacaatatccagaaaatgctggcaacacagtacgctgtacaatattggttgtttactctcatgattgtgtggctgactgagagcggcagctcactgcacctgcccagcatagagagatagtatcatacttcatattgctagtccaggaaaattcaaagtatgatttctattgaatgcatgttgtttttgcatcattatataaagttgaaatatctcaaattgaaccatcatagttgagaacttctgtgtttgtagttttattttatgtgttggtagtaaggtttgcattctgccattggtagatgtatttctagtttaggcagtcaaactcctaggaatgtttttgacaggcactgaataagaccaaacatagctagctaaaatatagggttgtattatatatgtatttttatttttctgtatattatgatgttttgacatcttaaaaaacctttctggctgggaagagattacccctccagaggttagccaattcttagaattagccaaaaactcagctgggagcatgcctatgatatgtgctctaaccaatccacactccttttctatctggcccatacacccaagaggcaatattcctctaccttatcttccccagggccaggtacctggaagctagagacccattcttatagcccaaaagtcactggaattattcaaactaagtaatcctttaccatttaccttgccctgcattgcctttcgctgggaaaccccagtaaatgctttggcctaggcactccgcttgctcttgtttttctgccacctaaccaaaacctagtgtttcccctgtgaccctgtgtggcatgcgatgtgacttcctgtttagaatttgttaagtatagtaacctttgttttcatgagggactttcctttgtgctctgtggccacatctgtctatcataaaagagcacagaagagaatattatgtattgtttaatgaataaccatacctgaaataagatattgtaacttttgacataattaagtatgccacaggagcttccataacatctcttatttttgttttttcttttcttattcctacatagctaataactccttattttattgtttatgtttgatagttgctttgttgaaaattctgcaggccttatatgtatcaaatgaatatgtagatttggatgggttcatcattttcatgtttattgatttttctgctgtttctaactgaagctattataaaacttacctgaaaaatgtaataactaaggaatagactgtaagacggtaacgaaaaattccaatatatagtggtttcaagcaaatggtttattttcatttcacacgacacagaccagagggagaaacccgaaggctgtcagggtacctctgcatccttaatatgtgacttccgtctctgtgcacaaggtaattgctttagctgtttccatctcccagccaggaagaataaagaaaaaaaggggcaggagcatatacattcctttctggaagtgaggaggaacatacttaatgtctactgacattcagaacttaagtcacatggccacactaagctgaaagagaggcaggcaatgtagtctttagctgggcagccattttcaagcttgggcattctgtagggggagaatggctattggtgggtaaatagttgtttctgctgtaaacatatatgtgtagtttttgaagaacatagtttttgataattaccaccccaaagccacaaaattggtaaaactatattttcaagtttaatatggcacaatgctttactggaaatgtcttttaaaattggattaaaacatcacttaaccggcaccagtttacttggatttttcttttaatgggattctcactacatgcacattccctccctttcaatcacaccatacataaacacatactttgtgcatcatttgtttgtttatgtttataacaaatactgattaaaagtgaggctgtggctatgctaggtgacaaaaatgcacttgtgttattgtttaatctttgttcataattgtgacttcaagtttcagcaacatctctagtattcaaaaaaagatgatccttttaggatttagtgctttctgctgtgacctcaaaggtatgaaagccaacaaaaatagtacttttagaggcatttgttatattttgattctttgagatctgtagttaacctaacttcttgtcctgtgaaattttttccttgtgtacttgtgaataaacatcatatacaaaatagttatgaaaagatgataatatgtttgggaaataaaaattctgtcttggaactcaaaaccagaattgtcttttgttaatgttctttgacatcaagttcttcattgtgaatatcattaaattatttactgccaagtttactagaggaaacctaacttttcattcataatgcatttttgaaaatgtatatgaaggcacatctaaacattgaactaattgactaaaaatatgaaatattccgtaatttttaaaaatatgtatataggttcaatgagtatatgaatagagcttaaagttgaccacttttggaacttctgttgagttccatcctttttgccaactgtattgagtttatgacacctatgttacttagcgttaatatgaatacttcttttttgccctttattttctctcaattttgtacaataaggacaaaattcagaaaagtattataatatttgtataaataaacactactgtacaaaggtggcaacacaactgaagctgaaattttgcctagaagttttgctactgttcatcagctgctgtatggaaggaggttcaggccattatgctggaaaatcacatgtgtcatagttgttgattgcttcttctgtgttcagtagccaatgtgaccagggccagttactctcactattaaaaaaaaccccaaaaaactatcattgttttgttttcctcactataaaagtaatacatgctaattgaaaaaatactggaaattcagaaatcatattgtacagttttttcattctttttagtgtacttatacattaatcaaattatcttcatatacttagtgcttccaaaattctctttagtactctactttgactacagatgctgaccaattggaattttctagattatttttgatttgcagtgctaaagattactgtaattcacttgaattctttacaagttagtgatattaaatctctagtgatattagatattttaaatattttatgtaatcaaatctgtataaaacgttatgatcctaattttttttttttgatggagtctcactctgttgcccaggctggagtggagtggtgtgatctcggctcactgcaacctctgcctcctgggttcaagcgaattctcctgcctcagcctcctgagtagctgggattacaggcgtgcgccaccatgcctgtctaatttttgtatttttagtagagacaggatttcaccatgctggtcagtctggtcttgaactcctgacttcatgatccacctgcctcagcctcccaaagtgttgggattacaggcatgagccaccacgcccggccatgatcttcttctgctcagaatatccttaatatgtggatgtgataaatattctttcttgtttttagcttatatttaactcaagatatttggaattaattttgttgtaaggtgaggcaccagtaactatttttctcctcaaagtggttagtttatcacagccaattattgaatgtttttaaatattatttcagatattttatgtttatttaatatacttactggattaaatatgagccctagtaagattacatctcataataatgatgaatttaaaatgaaatgatagttggaagaggaatttggtattcttattcttatataggagttctcgttttgaaattttttgaccatgcatttgactattgattacttttaaattgtatacaatattccaagaaagtcagaatctttccatttttataagtgggctactagtatctgtagtgtctgtatcactttctactctgaatctaggtgaaatactaaatacatcgagttgataataagtttgaatatttccttgttaagtttttttgccaaatagaagcaaaaacctatgctttagttaaatgtattatgtgctttttttcagagtacagttttatataatgtatctttaaaatcaattactggcagaatctgatttttttttctttttcaagggaaaaatttatacacaaatgaatatgtggcaattaagttggtaagttcctgtttcttaatttttcttaatgatttctttgttactttttaagtaacttatatattttaattattttttgttttcatgtcatttataatttggatgtttatttgacagttatatgcatagctaatctttgttgctaagctcctaacatcatcctgctcttaaagtatatggtaatgtgtaggacattcatgtttgtctgtgccacaaaaactcaatccctttactttggcagcattgtagaactggatcttggccctatttttaatttagggaaggatttttaattagataaaaattaacaagattttgccttctgattcaaacattttggtaaaacaaaagtgttcttagtattcaggattatattctttgaaaacatacttccaggtagcttctgaaatttctttttaaattgttacttcatatatatggcaaagctggctattgcttgactttgagggatgcagaaatgcttgatgtggtaggtgatagataacagggaaagcaaactcccgtggaattattctgaagttttcaatgtgcccagtatgacagctgcagagcagagcgatctctttggaaaaattgggatctaggaattatttttgtaagacatacttttcctggtacaacttttctgtctggtttgcagccaggtttccctgtttcattcattaagtggtgatccttaggtcctattgtttatagatttggaactttttcataccattgatgccttactaaacatttatcatgtcatctttcagccttcttatatacatacacatatatgtatgtgtatgaggtttagcatggcttggttttctctgcctttttcaaccttgtctctgtcaatataacctctgttattagggtaatatgaaatgaatatataaaagagagactattaggagaagaggcaaatgggaggaaatagaaaaactccactatttaattttaagtatcttttgaatatagaccaagttttagtgtaacaaatgtttattttcacttgaaataaagatgtggagtagggttgcagtgccatgaagagagattggttggctgacatgtggctttagactggattttacctagatgagtccgtcttggtattaagatctggtccttggcttatgaaacaaaacgtgattaggttatctcaccagttgtcagcgtttcttagaggtggattcacagtaatcagttcacactatcaagctctcagattcaggaaagagtgaatttctaactaataatgaggtattttacaggtctagaaagcccaagtttctttctatgggccgatgtacatagaaagccaagttaaaatttcaaggtcccctcatgagcatgaaatcagaaagaggttggtgaatattaatcacagcggggaggcctactgtgggatccgcctgcctcggcctcccaaagtgctgggattacaggcgtgagccactgtgcccagcctggacgttgtttgaacaggcattgctgactttcatttctttgaaattcttccttttctcatgttgtaggccagtggtcctgaacctacaacaatctttgtggtgtgcaaggataaaagtgtggcagtgtttacagtctgtgctattgatacaacagcctgtagtgggcagctctactcatgggagcatgctttgtatgtgaatgatagttatctgatatattaaggcagataaaccatcgtgtcaaagcagaaacccctgctctaggctgagctttccttgtctgtttcattcattaagtggtgatccttaggtcctgttatttatagatttggaacttgttcataccattgatgccttactaaacgtttattatgtcatctttcagccttcttatatacatacacatatatcacttttttaagtttatttttgtgctgtatctctgtcctcttaactagttttctcccctttttagggggaaacattcttcctcctctctgttttgtctttctttaaagcacaatgatcagcattacatgtaataattatggttatacattgttctttgggggaactaggaatatttttggatctatgtctctagtattttgaggttgtagagtggtatctagtcacgttcacctcaagttcatccaaaatatcggaaggacagaaaacttttcacatacattgttgaatgatagttcatgatttccttatatgttttttcatttgtgtctgttatatctgtttgtgccagataacatgattttgtttagacctgccataaaagtaatcacttgaacatcttatgtctgcatacctcagtgttatctggcttttatactttgctcggtacaaataaaggcattatttgataacctgagttcagagagcagatttctgtgactgctttcactccattatctcttacaaagattttttacatttatctaatattaccctagttcagatcaacagtttgtttcaggataatttgttaatattacctcagctaccatccttatatcttgttgtacatgaataatgaaaatgtcatcctggggaaggtgacttttattatatagtgttaaaattttactgcttaagtactggaatctagttgaaatgactcaactaagtcagatttgggtcagtatttttatcctaagggggagtagtgattgaataagttatatatttaatttcatttgtgattgtgtacatggacatctttttattgcatcttaaggttatgtacttctaggtagttaactgaagaattataggtaatatagtgctatatgtatagaaggcactgttttaagtactttatatataagaaaggttaagttttaacccaattttacagatgagggaactggaaagtacagaaaagttaagtaacttgctgaaagtcacacagctagaaatagaggatttaggattcaaacctagtacaatttagtttcagtgtctgtgctcttaactactgtactatcctgcctctcaagaactaagctgattgttttctcctgtaataaaacttataagttttgcagtgggattttaatattgcttatgtgaattcttttgttgttggtcacagtttcattatgatgtgttggtgtaaaattctttttagttatcctgtttgggattcacattcctcttgaattggtgggttgttaacctcatcaattctggaatattcatagcaataatttatccagttattgcatctgctcacttttctgtctcctttcctcctgatactgttatcaaatccatactaaatcttctcactggattgtccaggtgtctgatccttttcttctgttttccagtttttcttccttcatgatgcattctatatagtttttctgtctgccttacagtttccaaattctctcttctgttaatctgctggcaaaatgagttttaaatttagttattgtattctcttatttttcaaagttctattgattctttttgaaattttctattaccttgttatacttttctgttggttctttttaaaatttcctgttaccctgttacagttttctacttcttgtattttcatatttaatattatttctaacgtctaaaacccatgtttcctctgtacatgtttgtgtgtgtgtgtgtgtgtgtgtgtgtggtgtgtgtatatgaatctcaaaaacatttatgtcgaatgataaaagctggacacaacagaaagcatatactgtataatatcatttaggtgaaatccagcaacaggcaaaactaatccaaaggtgatagaagtaaaaaaggtatgatggaaatgttctatagattggtgtggtggttatagggatatatggagttaatatgtatttaacgcttatgaactgtgtgttttattgcatataagttatactttagtgaaaaaaaattaagacattgttgctactatcaaaattttcaaattaccatctttgttcttactatcctatgacttaactttaatctagaacctttatgtaagaaatacacagttcagaggtgaatttggagaacaggagaaatagcataagagccatcatttctctagtgatgaatgttcagaacatatttttctcagggtcaaagagtcaaacttaagggatttttctcctgcctgatctaatggctacttagtttatgtacatttgtagtatcattttattttacattgaacagaaagttgatttttatatgaatctaatcttagacaaagatgcctggtagactattacataatataggcattgacaccaaaatttataacatttgtgttgggacctagtgctcttttaataacttaaatgtctttttttgtttgtttttcaattaggagcccatgaaatcaagagcaccacagctacatttggaatacagattctataagcagttaggatctggaggtaaagtcttatattaatttttaaatttgaaataaagtggattgtcatgactttttagtttcaaggaatggtattttaagtttggttaaggaaatcactttgcaaggctatgtttactatacgttttcttactatggtcttaggatcccttttttattttatgacaaatttggagctttttatgtttatgctgatatgagtagagaacattgtgaaaaaatttaatttgcaaatataaaatgcatacttcttccatattcttagtctttttggaggcactattatagctgttgaagtgacttacaatatagtggtaggctgaaaaatggccacatagaagttatctgtatcataatccctagaacctctacatgttactgtatgacaaagactttgcaagtatgataaattaaggattttgagatggagagattattctggattatctggtgggggcagagggacatttacacacacagaaaaggagtaggcattgtgactgtggagcagagtggagagaacctggaagaggcttctagtactttcgcctagagtctctagagggagtgtggccttgcgaagacattgattcagaccaatgaaactgatttcagactcttacctccataactgtaaaaaaataaatttctgttgttgtaagccaccaaatttgtagtaatttgttacagcagccgtaggcaactaatatgggtatgtttttagataaactctaaattcaagtgagattatttcatgccactagagaaaattcatggaaaaaatttctattgtttgttacatttcctttatgttaaaaggttctcacagcacttttctgtatacttctattcaattaattgtaagaattttacttgtatagcttcttgtataatacaggtagaggaattttgtttctccagatttaataaaatggaatttcttcatgtatctttttgtaagcatgtttacattctagtgggtagagctgtccatttcatactgatatcagttttacattctgttttttctaagagcacactttgcaaatgagtagtcattgtaggggcaataagttttaaatgttgtagtaatgtgttcatcactacagacttcttataatacatatttaagtctgatacagacaggcctcagggagttatcaaaattatcactgacaactgggatttaaaggctattgggataaaacgaattatatgtgaaactatacatattagttattatactagcaaataagaagttaagtgggtataaaacgaatttattgactcatgtacttggaaattcaaggaaatgacttgatagattagacattgctctatccagtgcttcaaatactgtcatcaacatgtcaagtctctatgatatgccttatgagtatgtgtaagcttcactctctagttggcccttcttaagagattctggaggttgccaccaataacctaggcttagcaattatgaaagcatctctttcctaaaaatttcagcaaaagttgtaggactaaatcttactgccttatgtcatgcttatccctgatttaattactatgaatttgattgcctcaagttagatcaaatgcttatccgaactttagagactgagaatgggggaggtgattgcctactgggaaatcgaggtgttatataagggggattggatgccacggtgatgaaaaaaaaaaccagatctatctagtacagtaataaaactgtcatttggaagaataggattgagtggtttagttagaaatgagttagtcagtttagagtttagcaagtcattgaattgagtaacaaagatgtacttttattattttaacttttttctgttttatatttaaaaactatgtcagagatagtaagaataaaaatgaaacatcttttaggacttgtatgccataggactgcagtgttgcacaactgcagggaccaccatttacagggtagtctctgtttactaagggtgctatgctcctctctgctctatgggtgtcatttacatagattgaaatacaaatggtcttactgaaggtttgcatcatggtggctctgagctgtgacacatgtggatattttttagtattttgtacgagtcatgaatttgggcatattttttgtggttttttttttttttttggtcatttgtgagttttgtgaaagcatttttaagtacctttgtgagctttgtagaaaaacaagagtgcttaattgttttggaagaactgatgacttttaaacagtttgattttggaattcatatctgaaaagattatattttcagactgctcttaattataaacgggctatttagagtaactcaacctataattttcctatggtatgctgaatttcatttatatagcaatttgcttgttaatattctctttaaaaatagatatatttaagtaatatccagcatatataaagaacttctaaaactcaccaacaaaaatagacaacccaattgaaaaatggacaaaggacttgaatagacaaatctccaaagatatacaaatggctgatgaaaaacataaaaaaatgctcaacaccactaatcattagggaaatgcagctggaaaccatgagataccacttcatacccctcaatatggctgtaacaaaacaaaacaatacacagaaagcaagtgttagtatggatatggagaaattggaatccttgtgcattggtgtaaaaatttaaaaaagccaccgtggaaaattgtatgttgattcttcagaaaaattaaacatagaactaccatttgatctagcaattccacttctggatatatacataaaataattgagagcatgacttcaacaggtaattgtacattcatgttcatagaagtattgtttacactagccaaaaggtagaagcaacccaagtgtacattgacagaaaaatggataaaatgtggtatatacataagatggaatattatccagctttaaaaaggaaggctaggtgtggtggctcacgcctataatcccagcactgagacttgtggtctcagctacttgggaggctgaggtgggagcatcgcttgagcccaggaggtcaaggctgcaatgagctttgatcatgccattgtactaaaaaaaggaaaattctgcaaagtgaaataaggcggtcacaaaaggacaaataaatttcacttaacatgaggttggaatagtcaaattcatagaggcagaaggtagaatggtgttttctgggggcttggggagagggcagaaatggggaattattgttcattgggtaagagtttcagtatgggatgatgaacaaattttggagatggatggatggtggggatggttatacagtaatgtaaatgtacttaatgccactgaactgtacacttaaagatggtttaaatgacaaattctatgtgtattttaccacaaataaattggaaaatagatttatttagaattatttagtggggtatctgtgaaaaaatatacaatttggttttgcccgtttgggttttgatcctcctgtaaatccatgtttctttcctttatgtagcttctctgacaatatccctctttacattacattatttagctttgcataggattagactattgttttataccattatcactctctgggatagcaaaaatttaatgtattgaatagtcttgttttgtcacatctactcagtattcgttgagtcaaatgaagacctgggtttgggagtcatcagcacatagatggtttttaaagctaaagaaatggatgagatctccctgaggagagtatagaggttgacaagaaaagaatagcaagaacaaagctgtgtggactactccattggatataaatagatttgactcttaataacaaaagttgtgaaagcagtagcttaaacaagtaaagggatgtaatgtgagacaagtgagttcagaggtgggcaattgtagggttggtacagctgctcaaaagtaaggaaccaggctcctaaccttggtgtgtggcttcatcctgcaatcctggactttttgtaacaggagggaaggaggaagaaatgaaattactatttgtgtaaagacaacttccagttctttatctcctgcttctattcttaaagtctagctgtatatgaatatccctactgaaatcagaaattcatatagctggaattgagttccctaccttcttttccccttattttctcgacagtttctctctctcttaaaagaccttcctgcttgatcttctggattacctagttccattagttccacatctgttcaagctgaaatgttagcctcctctgattttggcgtattggtatagtaaaaaagttctgtcaattttgtctcttaaaatctctcttgacttaattctcttccagtccccattgttacttttcttcgaattgggcttccttttgaatatctcaaccagctttttacctctacctgcacagaggggcacatcatttagtataaagtccaaattcgtttctctttctactgacctactttttagttgcactacacttactattccttgagtagatcttactattttcacgtctgtattctttctcgaatatctttcttttctaatgaattctatttttctttaagccctagctaaatgtcacctgcttagcaatgcattttctgacatcttttcctctccagaaaatcttcttatttgatctgatattttgaatatgtaaacctttgaaacctttatttttcttttatcgtatggtaattattatttgtctatgtctgtcttctccactgaattttgaactctttgagggcagtgataatgatatgttcatctttttcttcttggtagcagaatgattggcacttgtaggttcttggtaaatggttgaaagaataaattcttaactaacaataatagactgttttctttcattagatgtgaagttgggatgtataatcttcaaatttcctatattttctaacttctgtgaccctgtgattaaagtttgatattttaatattacacaaaattgtcgtattattaattttgagtttattctatttctggacaaataatacaatttcaaatttttaaattctaaaaattaatttcatttgtattatcctatgattaggtaaatttattttctcattttggacaactagagatcaaaggaaaaaattattggtgagaattttttaattaatggaagtggtaaccaaggagatatgcagaaagttttatattaaaacttgctgaactatacaactcagccatctaaaattagtcactttcttgagaagggtgggctttaattattagaattaactcagtttcttcatttacttgaaagtaagtatatctgaattgttgatatttcatgaaaatgcatagaacatatttgaaatttatgggaaaattgtttttggaggtctgtgattctcagtaacacttcttaattttttttgacatgagtttaaataggctacattaggagaaactgcaattaatgcattccttggaacatcttaattagctgatatttttaatcataggaaaaaataacctttttttctgtcataaattactacttatcagaggaagtaaatgatctttttctctgtcataaattattcttggcaaatctctgactatagagatgatattaaaaatactgtttgacaccattcatatgttaaatcatcatttctcgagtggcttgactttttgagattccttggactatgtagttctaagcaataatttgatggtagccacaggtgctgttactgaaattataactctttataatgctgtcttttaaaaggtgtttgaaaagccccctctttcttctttatgctgatccttctgccttcttgatttgtgccttgttaaaaagtctggatttatgtgctccctgcagttttttacactggtttatcgatgcctacgttttcactttatttttaagatgatttagttccgtctgctggttaaatgaacgttggtgattttgtaatatacggaaattttattgtactgttcacttctgagaagtattatgggtaatagtataaactttgttaaaagttgtgggtataaaccattcagtagtatctaaaactgatttaattcacagttaccagatcaagtttctcagaccatgttttaggtaagacattcaaaaaattctgctctatgtatattataagctgttgtttgaaaaaattgaaaggaagtactgtaaaaagcatgaaagttaagtgaataaatacttagactattgcttactgtattttgatattaacaaaaataatgaaaatatgatatgagtgggttagtcagtagtgtaaacttaatctcagcccaggtaaccaacagtttatgtagcagattcttagaattcctttttctgtcatagctaaattgcttttagaagaagtttttaaaaatatgtaatacttctaattctttaaagttagagatctctctgtatggaaatttctacaagttttacactgctaaacatttacttatttatatgtgaatatatacttacattgttactactatcatagtagatggaagtatacaatttttttctgttaaagttgtagtttatggagaatgggtacatttaaagaatgttatgcattatcagaaagaggtgttaactgatagtggttttagtttggtttatatggtgcaggcattagtgttgtgtgtggtgtggttattatagtattttcaatgattaattaagcacataggaatcttaagcaaaaagcaaaccatacttttgaataggatattactaaatatacataatttttgtaattccttgtgtaatagtaaaaagatagaaagtataaaaccatgaaaaattatgaaaatttcatatttagttttgctttaagtgttatataatgcattgtaagaagaaaagatttgtaagcttgtagcttagggactagggggaagaatcatagagtccattttttccttaaattttataggcccaaattggataacaacttaagttccattcagtttttgcaacagttaaatttttacttgtttgtaggtgatgttatttttttaatgttgtttgaatgttagaataatttctaaatgtgtaaattaaatcatcacagaaaggactgttgctcttttttacagtagaataacttgattccttttatttggggttaattgatagaattttactgctaaatgcagatattgtggtcttttaatggaaggactgttaccaagtccataattcagttcacctgttggttcatagcagcgcttactattcagctaggacagcacttcttaaactttcgggtctcaggattcttttatgctcttaccctttttgagtatctcagagcacttttgttgttgtgggttgtagctattgatatttaccatattagaaattaacacagaaatataaaaatgttgctatatttgtttaaaataaaaataataattgagacattttaaaatcaaggcaattttgttgatatactttccaaaacagaaaaaatgagaaaagtaacattgttctacatattttgcaaatgtctttaatgtctggcttaacagtaaacagctagattcccatatcttctgcatttaatacattgtgataacacaagtcccatagtctctggaatgagagtgaaaaaaacatatttatgttattacaaaataattttgatattactgacttcctgcaagggtctcacggaccacctctgtcctcaagagcttcaggccacatgttgaaaactgttgatctaggagtataagcatttgtgctaaaggttaagaatgccttaatgcaaaattaccctaaaaaaaagatagggtgatactgtgtgataattctgtacttagcatttctagccacaatttaggttttcttaatcagagctgtttaaattaaatcaggaagtttaaatttcctaataagtttgttagtacttttgttctaattcttcttatttgtgttaggctgttcttgtgttgctataaagaaatgctggagtctgggtaatttataagaaaagaggtttagttggctcacggttctgtaggctgtataggaagcatggtgccaggcatctgttcagcttctggtaaggcctcaggaagtgtacaatcatggcagaaggcaaggggaagccagttatcacgtggagagagtgggagcaagagagagagaaagtgaaggggaggtgcaacacacttttaaaccaaatctcataagaactcaaaatcatgagaacagcacaaacccatgagggatctgccccattgacccagttaactcccatcaggccccaccttcaacactgaggattataactcaacgtaagatttagaggggacaacacccaaactatatcactgttttacattttacatgaagaattctagacctgaaaatggatcatgatattactgtgaaatggatcatgatattatttccttaatggtctacttaactaatacttacctgtaaggaactgaagtatttaaaaacttgacacaaagtaccaagcagtctttaatagtttctgtgtattactgttgtgtgacctaattttgttttgtcacttaaagggaataccaacatataaaatgagatatttaatgaagtgaattttgggggagtgagggtgagattgtattttcaaatatgtgaattttgtattcatactccttgagcttttcttgggaaaaaataaacttctcttgaaaagtaaagatattggaaattatcagatgtaactttcatgaattcacagtggatagctttttatattagtatcaaataaaaataattttagaaccactggaatgggtggagtaagattttataattgaaaattcaccaggtgtaagaacaaacctttctgagcctgtcgtgccctctttttccttacctctcccatttctaaagaatctctaccttgtgacctaacctaccatttacgttgctctggtggttttggtttgtttttgcttaggatataccctgcctcaacctctgtttgttaattgcaattcttcttaactcttaaaaatttaagttgtttgctcagtgattaaaaaaactgtccagacttgttctgggaaataaaattatagtttggtgtaaatatcattttaagtttttctttgtggtcctagaatctttaaagtaagcactttttttcctgattgcaaaaatagcatatgttcgtaataaaaattaggaaaagtttaaaaaaaaaagtgaaggtagaaatcaccagtgcttccagtaatgttagctttctgcttttttcttatgttatcttttctattcgtatgtatgtttaatgattgtattcgtccgttttcttgctgctgataaattgccctgaggcggggcaatttacaaaagaaagaggtttattagacttaacagttccatgtggctggggaggcctcacaatcatggcggaaggtgaaaggcacatctcactggcagacaagagcttgtgcaggcaaactcccatttttaaagccatcagatcttttgagactcattcactattatgagaacagtacaggaaagacccagtcccataattcagtcacctcccactgggttcctcccacaacatgtggaattgtgggagttacgattcaagatgagatttgggtggggtcacagccaaaccatatcagtgactcattagaaatattttattttaaggccaggcgtggtggctcacgcctgtaatcccagcactttgggaggctgaggtgggtggatcacttgaggtctggagtttgagaccatcctggccaacatagggaaaccctgtctctactaaaaatacaataaaaagattagctgggcgtggtggcaggtgcctataatcccagctattttgggagcctgaggcaggagaatcacttgaaccgtgaagtggaggttgtggcaagctgagatcgcacaactgtattccagcctgggcaatagagtgagactccattttaaaaaaaaatattttaaaagtaatacatggtttaaaacaacaaaaattttaatcagcagtattataagaagtaagtaataaaagtttgtctttcacagttatcgccaaagatagtcaaaggctgtattatattccgtaatatgggtatgacatattaggttggtgcaaacataattgcagttgtgggctgtgaattttaaatcattatgactggtctcaagcacatctttattaatcaaaataggaaccattacggtcaacacatttttgccaataagaaataagtgtttattcttgtagcataaaaattagtgcttcgggatttgatgaactcttggaaagcatttttactgcatcttgctggttgtggaaacgttttccctgcaaaaggttgtcaagatgcttgaagaagtagtagttggttggcaagaggtcaggtgaatatggcagatgaggcaaaacttcatagcccaatttgttcaacttttgaagcgttggctgtgcaatgtgcggtcggtgttgtggtggagatgaattggatcctttctgttgatcaatgccagctgcaggcattgcagttttcggtgcatctcattgatttgctgaggatacttctcagatgtaatggtttcgctgggattcagaaagctgcagtggatcagaccagcagccgaacaccagacgtgactatgacctttttttggtgcaagtttggctctgggaagtgctttggagcttcttctcggtccaaccactgggctggttgtcaccggttgtcatgtaaaatccactctttgtctcacatcacaatccgattgagaaatggttcattgttgttgtgtaaaataagagaagatgacacttcaaaatgatgtttttttaaaaaatgtttgctcagctcatgaggcacccactaatcgagctttttcacctttccaatttgcttcaaatgctgaacgaccatagaaaggtcgacgttgagttctttggcaacttcttgtgtagttttaagaggatcagctttgatgattgccctcagttggtcattgtcagcctctgatggccaaccactatgctcctcatcttcaaggctcttgtctcctttgtaaaacttcttgaactgccactgcactctatgtttgttagcagttcctgggccaaatgcattgctgatgttgcatgttgtttccactgctatatacgacccatttttgaactcgaataagaaaatcactcaaatttgctttttgtctaacatcatttccatagtctaaagtaaatttaaaataaacagcaagtaataagtcattagcaaaaatacataaaaagagaaacatgcattaaaatgatgtataacatgacgacatttaagaatgtattccagtatcaaacagcaatttgcaacaatgcaaaaactgcaattacatttgcaccaagctaataatttgtttaattagcttagagttggtggatttttaggtagctgccaactctttttgtaactgtaacaaacaatgaagcttgaacatgattatatgcatacttatgcttgctttgaaaatgatagggtaattttcctccaaaagcaaaaggatagagtaattttccttcaaaaacaaaaggatagggtaattttcctccaaaaatgtgctgctttctattctcatcaatgttttaacccacaactttgtcagtcttgactaattaatttttaaattatgaatatgcctttgaaactacaccaaaatttgacaagtggtcatttcttaaaggtcagttacaatgtagagtatagaaatcataccaaaaaactttttctattctcatacattaaaatccattgtagtttgaatgaaccatttctgactacatgcattgtcttttggaggacactggttcattgagttatgcatgtatttcaaatactaacacatttcactacccaacattaaatcataatagctaatatcaccacaatttcatcagaacaagcttttaagtattggaaaactgtcaaggtcatcatagcatataaaaatttttacaaaattcaaattgcttgaaagctttaattttattattggtaataaatgtcagtttttcttgaagtaagagtctcttcattcattcttgagaatgctttttatttatttatttgttttgcttcgttgtactcttgaatagaaaagttaaaagttctcttgctctcagtcattaatggaaagcattcaatctttcaccattaaatgtgatgttagttggtaacttttcctagattccctttatcagatttagaaaccttctattccaaatttttgagtgttaaatcagatgctttcttagcaccctttaagataatcttaaggtttttgccatttcttctattattatggtgaattatattggtggatttttgaatattaacccaactttgtattcctggattaaaacattcttagcatggtttctcattcacttatgtatccgtaatgcccaacccagtcccataaagatatagtatatgtccagtaagtatttgttcaattaattaagacagtgaaattccttaaatggttttcctgttttggaaactgttgaaaacttttgaaaaaaccagtcattttataaaccaaaacatactgctatctatcttattcagaagtcatttctcaacaacgttaactattgggaatatagatggtgattcagaaggaagtagagaacgttttgacagtcctttctttttttttttttttttttctttttgaaacagagtcttgctgtgtcagccaggctggagtgcagtggcgcgatcttggctcactgcaacctccacctcctgggttcaagcagttctcctgcctcagcctcccaagtagctggcattacaggcacacgccaccatgcctggctaactgttttgtatttttattagagatggggtttcaccatgtgggccaggctggtttcgaactcctgacctcaagtgacccaccggcctcagcctcccaaagtcctgggattacaggcatgagctaccgcgcccagccgacagtcctttcattgaagaagttcaaaacctttttatttttacattttttatatagttctaacaagctttgatctggtttccatgcaccctgcatatcagaagtaacaaactgtagtggaataagttattagagattgttaaattgagaggatgtaaattaacaactttcagtggcagagagggggaaaaagcattatggaaagaattttcaaagcttagtagctgagagctgtcgatgttgtggtagctgagagctgtctgtaaatcttaattgcatctccagcttcttaatgtatatagcattgtaaaagcaggattttagagttggaataaacttaacaagcctctcattccctgtttctgaaccttttctccacctttacacatgtgaggggtagatatgacaaatacatctaagagtggctgtggtaggagtgtctttgattcccagtagcaagaggagatgggacaagcgtgtgtgatgtgtgtgtgtttgcagggggtggtgatacatacacattggggtgtatcagaatctctgtttctggggagggcaccatgtatgcagtttgaatttgtatccattcctgctatgattacactatctttttttgtttgtttgttttgttttgttttgtttttttgagaaggagtcttgctctgtcgcccaggctggagtgcagtggcgcagtcccggctcactgcaatctccgcctcctgggttcaagtgattctcctacctcagcctcccgagtagctgggactacagtgattacactagcttacattcccacctgcagatgttctgctgcctcactcatattcatatctgagaaatacttgtctcatccaaatcactaatattataatagataagtaaactgaggcccacttgagaggttgaatgacaagctagccacacagctgatgaatattaggttagactaagaatgtagttttcttggtttttagttcagtgttttctattctgtcctgcaatgatttatattcaaaataatagggtaaataataataatgttatatttaaaaaacgttttattaaaaagaatgagaagttttcattagatttgttttctctttcaatatactgaaaaaaaatcacttggaagtaaaactgagacatttgtggtggaagaagttcattttttcatgctaatagataaatgcagtgttaagtgtcaaactaaataatagggagacttgtctaaaagaaaatgatagttatttacgagtgggcattacaatgggaatatatgtgagtatattcagggaggtaaaggaagacaagagtttttaaaggaaaaatgaggagggtcacataagttgttttgagagagttacccttggctacaaggatcattaacaagaatggcctcagtctgaagttggacaggcagttcctgggcagatgtcctcacagagtaattttttgtaaagttgtggtggcttttgttccaggttgtggtttttgcagtcttttgtggtagttcttcttatcaggcatatatatatatatgtgtgagaaccctcccttcatctccttccctagctctgtttgtcagggttttaatacaagtgactctgttttgattctgacaacttccatataaagtaaattgatcacttacatttcagtttattgggagtctgttagttctgaaaataaaatacagatgacttcatatttggagtttgtattattcagacttcatatttggagtttgtattattctatatagcttcataatgaattattactatctcttactggcttaagatgaaagactttattatctcacaatttctatgggtcaggaatacgggcatggctttgctgggtcttctgtttagagtcttaccatgtggaaattaaggtgtaagcctggactgcaatcttacatgagcctcagtgctctcttccaagttcactgattcttgtcagaattcaattcctcatggcaatagaactgtgtggcccttacttcctcaaggattcctatctggcatgtggctccctccactgcatggtggtttgctactttaaggccagcaggagagtttctctgctgtttccaatatctctgacttctagactatctttttaaagtctcacctgaataggtcaggtccaccaggattctcttccttctgatcaacttacagtcaactgataggagccttaattacatttgccgtataagttagcctggtcacaatagtgagatcccaggaatcatgctcacgttcaaagggaggggtttatacaaggtgtataagccagaggatgggaatcttgacagtggtgatcttagcagtatgcctatcacatggttattaaagccagtagtgactctcttttcagtagaactggaatctctcctatgtgctaagcctttctccaggccatggaaatataaagctaaaaagcccagcttttgtccagtaataaggtggtagagagaaacaatgaagtactgtttataatgtaattcagtcatgcagctgcaatagaggtgtatccaggctacaatgtgaacatcaaagagaaggtattgggaggttgggaggtttggtcaggaaaagtatgtatctggaaaaagtgatagtactgctttagttcttgaaactataaaattttaaatatcagtttttaagaggaaaaccttagtatttaagatgatgaaattattaaatgagtatttcttttcccccagatggtatacctcaagtttactatttcggcccttgtggtaaatacaatgctatggtgctggaactgctgggacctagtttggaagacttgtttgacttgtgtgacagaacattttctcttaaaacagttctcatgatagctatacaactggtaagtaaaataaggtatttgaagttgtttgaacaattacatggttgttggtcacaaattcatattaaaagtttaaagttctgtgatattgtcttacagagcgtttgacgtaatacaaatgtttctacttttcatgttgtctttctgggatccatgtaacttaaaataactgagtcaagtatattttatttgtataaaaactaataattgctttaagatcaaaatgctcagtttgcaaattaagttgttgctagccatttcttcatataaaagatgattacttcaaaagagaaccctcagaaacatagatttttttttttttttttgagacggagtcttgctttgttgtccagggcggagagcggtggcgagatcttggctcactgcaacctctgcctcccgggttcaagcaattctcctgcctcagcctcccgagtagctgggacaacaggtgcatgccactacgcccgaccaattttttgtattttttgtagagacagggtttcaccatgttagtcaggatggtctcgatctcctgaccttgtgatccgcccgccttggccttccaaagttctgggattacaggcgtgagccaccgtgccgggccagaaacatggattcttaattttggtaatagactttatgacctggaaaaacaagaggcagactaatgagagagtcttgataaactacttagacttcagggaatccgttggataacaattagagagtgattttaaggcagtttcgaaataaatgccaatagaagtgtgctgcagaagtcttaaaattgtttttattcattgactcattaattctacaaatttatcctatggatgttttcataggtacttaaagctttatatgaaaggatgtttataataaaaaaaggagaagcaacccaaatatgcagaaataacagggttagttgaataaattaatatccagaggaaaatatgcagctgttaaaaagtgcatattaaagattgttttataggctaggtgtggtggcttgtgcctgtaatcccagcactttggggagtctgaggctagaggatcacttgagcccaggagttcaagatcaatctgggcaacatagtgtgactctgtctctacaaaaataaaaataaaaaaaaaaataagccaggtgtggtggtgtgcttgtgtagtcccaactgctgaggaggttgaggcaagaggattgcttgagcccggaggttaaaggttgaagctgcaatgagctatgcgttccatcctgggtggcagagtgagaccctgtccctgcccccacacacaaaacatcaaaaaaccaaccaactgcccccaaacaaaacaaagaatatttcatgactttgcaaatgctcatatcattaattaagaatatatagacatagaatattgtacattatatgctgcaaagtttgttaaacaaactagaatggcctgtgtagccatatgtttacattgcattgttaaccatgattatcactaaatgaagcagttttattttcttatttgtaatactctattttatgacagtttgtacaatgaacattgagaatctgtaaaataattaacaaaaatgagctatattattaatattagagttggatttcagacttttctagctttatgatctttctagcttcaagattaatcatttttaaatgtttaatacctaggaaaaagtaaaggaaacatgttatgaaaaagaaaaagatactgaatagtgctgttgtttttacttaatagtttagactcttaagtttctttaatatacttgtaaaagttgcttggttattgaactgataaggaagattatattgcaatgttttgcatatgtctgcttatacttttgggttcaaggtcttatatcaatgtggctttttgattttatgaagtagcatcctctgaaagtgttcattgaatcaggcttgctgatatgaaaggaattcataaaattcaaatactctcgtttagcagtgaccataacagtaaaggcaaagattttaaattgcaatttgctatgtgaagaatgataggctgacatcattttacttttaaagggttgaaacaatttctgatttatttcttttgtatgttttcattctgtcttgcctttatcatacttgcttaggctagtcaaagcccaaaataaaacttctcttctttttttcttaaaccaagatttctcgcatggaatatgtccattcaaagaacttgatatacagagatgtaaaacctgagaacttcttaataggacgaccaggaaacaaaacccagcaagttattcacattatagattttggtttggcaaaggaatatattgatccggagacaaagaaacacataccatacagagaacacaagagccttacaggaacagctagatatatgagcataaacacacatttaggaaaaggtatgtgtacctttcgtaagtatggaagtttgaacttagcagctgtgctaacactgtgagtttttatttgttatggttcagtttttgcagattataatagcttttattataattttcatttatcacatctacctagagtttactttcacttatattttaataaaactctttgaaagtaagttactatagagtaaatgagtgacagctatctttacattcactgtattttttgtatttatataacttgaagtgttcaactttgatacagttatggggatgcatttaatcatttctcttacaaaatatgagagaataccaaattttaactgaattcagtacatgtggaaattttggattgagaccatagctctccaatatggctagccacagaaatagcaactagcctaataagtataatgctaacagcatataccttagaggtgggcagagctggcttacctgtatgctaactatgacttcggacaagtttaacctttttaaggggtttcttattggtaaaaagagtaaaacaatatcaacttcacaggattttttatagcattcttccttcacccagattcatatttatcatatcccttaaatcattttcatctggaacagttcctcagtcgttcgttatggctcatgaccttaatattttttaggagcacaggctattttataggatatctccaatttgggtctgttatttctttttgactagatttgggtaggcattttgagcacaaatatcacagaagtgatgtgttcttagtgcatcatgttgggatcacttgcttggacgatatctgccaaatttctctactgaaaagtttcttgtagttagattttgggattatgtaaacatgttgttcctcatcagatttttgccctctagatttagcatccattgatgattttctaactccattatttctaatatttacatttccttatttgtcagttgatattctaatgtcagcagaagctttaccttctcccccagttattgacttatgtctatatgaacttattaattcttatcttatttaatgtaatgtattgaatgcattatcattatttattctgatagccaaagggttccagatttggccacccgttgctccttcaagctggcttctctgtccttttgacatgttctcatgaatctttgagtactttctttcttttggtgcagcaagttcttataaacaaactcatcttgtagtttctcttctgcagccccataatcagtccttttctccaagaagttctgaatccttttattggataatggtatttagaaaccaagatttggccactggatatgctcattactgtggtatgttgttactgccaggccctttctgcagcagaactaggaaatgtttgtgcatatatgtatatacatacacacatagaaatatgcctacatatatacgtatgtatacacacacacagagacatacgttaatatctgttaaaaattttgagtttatactgatacacttttaatttcagtctgtcagtacaaaatagtatttcccttttctatatttgtaattccatcccttttccatatttgtatctttttttttaacagtgagaaatctggctatcactacttacaatatatttacttgtttttaaaagctgaggatactcagaaagtagtttcagattgccaaatgataccactttatatagcaagtctaatagaattataacatttgtaattcttattttattgaagagttttttttttattgaagtaaaatttacattgggtaaaatatacaacatttgattatataatttgtgagtattgatgaatgtgcatactatgtaacccacacactatcaagatttagaacactatcattatcctatagacttccattttacccatcttagtcattcccctccttttctagaagcaatcactgatctgatttctatcacaacagatgagttttgctgattctattacttaatataaatagaaccatccaacttcttttggtgggtataatgtctttaagattcatttatgttgttgcaagtatcagtagtttattcttttttaatgctaagtaatattccattgcataaacatatcacaaactgcttatccatttgaatgttgatggatatttggattaagtttttgacttatgaataaaacttgtataatattcttacaaatctttttgtgggcatatttttcagtttggtcctatggcaggtattatttaactttataagaaactgcctgtctgttctcaggagtgttcatacctttttttatttccatcagtaatgaatgagaattttgtttgtttcataatcttgacaacatttagagttgtcagtctttttcattgtagctattctagtggccaaggggtagtcttttaattccttgtgattattgtttctgagatctgtttcatgtatttattggctatttgtatatcttcttttgaaaagtgtgtgtcatttcattgttaatttacagagttctttatatattctgggtataattattttgtcatatatatgcattatgagtaatttctttcagtctttgcttgcctattcattttcttaatggtatcttttgatgagcagaactgttaaatatttttgaagtctagtttatcagtttttttgtttatggttattgccttttgaattctaacaaatctttaccttcatgtaataaggtaaacaaatctttaccttcattacattttatgctttcttctagaagctttatagttttagccttttatatctgtgctccatcagaattgattttttatatggtgtgagataggggttgaggttctttctatgatatcgtattctttcttattgaattaccttagtgtgtttcttaaaaagtcaattctagattacatttgccacattcagtattcatatcagagaaagtacaaacttaattatctgcttttagatattattctgctttcagatactattagacatcttacaacagatagacagaaatgtgaaccaatcagtatatatccatcactgctgctcaaaagtaccttcaaatatacaatcacagatttggacagaatcttggaggtcgtctaatccaactttcaaatcctgatcttagcttttcctctaaacattctccccagctttagctactctatagagcatgtccctgctctgcctctcaatcataactcagtaggatgtggcatctttcctaacagctgacctgacggtaggcttatggtatttttttcttttcagacatctgaaatgcctgaaaaatgtaaatttgctgttttttttttttttttaagaaaagtaagtttcaaatatttaaaattatgaaacacaagttttattcagttaatatgttcagggagtagctttcaatagctgactttcctggtagacttaaaaatatgattgggtagctatacaacttttggggttgtgacttcaattaaaaccaggcacacctatatttatttacatgttcagagtctgtgagaaattttcattttacgggagttgttaacagactattttataacaactaacaaaggttcaccactattttattgtgagacatgaagtcacaacttccttagggcctaatgttccttatctgaacaatggtaaatgtaacagcattctatttgtagaaatggcgaagtgagtgtgatatgtttgtcattgttaggaaaagtcatcagtacctaggaagtgagattgaactattataataatctctctttactcctctttcaggaataaaataaaaatgtatttatttggcaggtatagcaaacaacgaatgcttaatgtttacttttccccatttataaacactctgcttctcagttttcatgtaaaactcaggagtaggtgggtaatattaacagataaaaaattttgtttctaagattacatgaattcctatttaaaaagttaagagtaaggtaatatgagtttggatgctgaggaattaaagcatttggcaaattgcgatgcctttggatatggaatacatagcggtgttttaagtttagagtacttggttttgtgaggagtcaggaagagataaagaaggaaaaggagcagagaaaacatgaccttttaatgtgattttaatttgtgcgtatcttatttctgccctccctgctttgcctggatcttggtgattacttttaaagccttattcattcacccatctttccatccattcattcattcttaggcactcaaggacttcttgctcacatgaacttttcaaaatagagagtttggtcaaaggaacattatatgggtttgtaagtatttttcctttttggagactgacactatcttagacttaaaaaggaaaaagatgttcctaatataataatatagaagaatagtgtaaaatcacataataagaattaacattttattcttgtagtatctgttgatcttaactaggttatttatgttcagaaggcagatgttgcagttcacatttatacctttcttatagctgcttaagtctctgtccaagatgcaatcttgataaagctttatgttacagatgtggatttccatgtgtccttgcatgaaaactttctttagtgttgacatattgaattgttacttttgtgtcacatctgatcaagtgtctgctttttaatatctttttaaagacttttgttagctgccctgaacctcataatcttcctttggatgactatttttcccttttatgtcttctcttgttgaagtcatttgatattaagtaaataatgtctatttctctttggtgaatagccttgaaataaaaatcagatcttttatttttaaatttttattgattattcaagaataaaaaaactaggatttgagggataagttgggagttgctttgtaagtgttaatagaagaatgatgtttcaagcttctaagtggtaagttctctgaataggagagaaggaaccacagaattatggtgttccaaaaatgccttctttctgtgctatcattctgtggtgtgattcatataatttaatttctaggttaattgttccagtttctgaggcctgctctttaagctgctcacacagcttttttgcagtttaaaaacatgtatttacattttataattatattttaacagtttaaaatgtattatataattttttgttagagtataatgaacataattggtattttcttgatgtttcagggtatagttttttttatatgattactattatatagcaatattctcaagatcagttggagaaggttaggatggatatctttatctaaataaatttggagacaattttatttatactttgtaatagattctctttttgttttttgggtttgttttttttttttttttttttggccttcacctgtgttgtcccttactttttgatagtgtgtgtagtatagctactgctggcaacactttgcttttctctacctttgatttacttcttttgaccttgtcaccaaacttacaagaattatgtctaaattaagagaactagatttcaagagaactttaggaattaagtgaatgcatgtactgggttcagttgcacagaaaactttttctaagttttgtttatattactagattaggtgtttagattagtgaactgttcctgtgtattgtcttgcataattgtgttttgttcttttcctttttaggtttgttttctctttttttaaaaaaaaaatccttgttatataattttgaaaactgagctcaatgaatcttgaggaagaggtatttttgttttttttagggtagtgccaactaaagtaacttttaatatttaagaaggaaatatagtgaaccttttcttccttgtagtagataatttttatcttttttttacttataagaaatgatttaaactttattcagggagaatttttgttgtttgagctgtcttggctttgtcttctcatgtctgtgctttgcttagccaacatgtcttttggcctcattgtttttcattatggtagaaaatgcagtagtaagtttatttttgcaaatatatgcatgtatcatagaaaacttcctgcttctgtgtgaggcatcgataaatttgagttaacgaaaaagggaattttttttgttgaaaattgaattgaaatttcaattgaaatggaaacagtgttaggcaagtgaggaatgaaatctgatttaaagaaaaataaataatgttgagatataagagtagaatttttaaatagaaaagcattgcagaaggtttccaatcaacattgattaagtgatgaaatgctttccaaaatgaaaaaaatgcagacaagtgggctgaaatcttgccctccacttattaggtacctagttttgaagtagtcacttaatctttctgagctttactttccttatttgggattacaaataactgttttcagtgtagctgtaattttgaaagatagtatatatgaaacatggacacagactcttaatacgtgttgattattttttatggtacatatattcctgaagaggaaaattttaatggactatgtacctttttaattggtttcaagacctatttaaaataatctttaatgatacctattttaaagaaaaataatcactttctggtttccttaggtgctcatagcaagagttcttataatgattcttggccttgtggaaaaacattcgctttcaaacaggcctttgtagttaagtgctttaaaaaatgtgaacaggctttaataggggccagattactgttgggagacttttttcatgtaaaagaactgttaaagaccctagggggtgttctttagttactgtgtttcaaagagaaagccttcctgtgatttctgtaacttactacatggtaaaatttatttccagatatgtcagttggtgaaagaacacaaaaaaagaaattatgagggtaaagagcatttcagactgagtttcagtaatagatttgttttactagctaatatttatggcttgaattttgaaatgctttgtgggttatgagactaatactgttctctgatagaaccatgtaggcgagatcaccttatgaccgtggcttattggcactatgtgactaaagcttccccttggatagaattcaaagaggaagtgccttttatattgagttcctctccataacagagcgtcttactgtagggctcagcatacttttacatgtatagtattttaagttttttaaactatatgcatattatatataggtcttgcatatacattgataaatgtatccttacatatttcctgttttttaatgctgttgtaaaggtattggttttaaaattcaattttcacttgttcgttgtgagtatagaaatccagttttttttttttttttttgagactgagtttcgctcttgttgcgcaggctggagtgcaatggcgcgatcttggctcaccacaacctccgcctcccagattcaagcgattctcctgcctcagcctcccgagtagctgagattacaggcatgtgccaccatgcccagctaattttttttgtatttttagtagagacagggtttctgcatgttggtcaggctgctctcgaactcccaacctcaggtgatcagcccgcctcagcctcccaaagtgctgggattacaggcgtgagccaccgcgcccggcccagaaatccagttgatttttatttttattttgtagagacagggtcttgctctgtcacccaggctggaatgcagtggtgcaaccatggctccctgcattgtcatcctcctaggctcaaggaatcctcccacctcagcctccctagtaactgggactacaggtgcatgccaacacacccagccaccagctaattaaaaaaaatttttttttgtaaagttagggtttctctatgttgcccaagctagtcttgaactcctggtctcaggctatccacctggctcgacctcccaaaagtgctgagattacaggtgtgagccaccgagcctggccccagttgatttttatgtattaaccttatatcttgtaaccttgctaaaacttacctactagttgtaatagaccttttgtaggttatttggatttttctacatatacaatcctgttgtctgcaaagagcaatagttttatttcttcatttccaatctgaatatctgttaattttgtttctttgcttctttgtactggcaagaacttccagtacaatactgaatagaaagggtaagagtggacatctttgttcgttcttgatcttaggagtgtcttttatcatttaagaattatgttagttgacatttttcgtagttgttgtcaggatgaagttggcttgtaattcctagtttgctgagatttttttaaaaatcattaatacgtgttggattttgtcaagtactttttctgtatctgagatgacaatatgatttatattttattctattaatttggcgaattacattgattgatttttaaaagttaaaccaaacctacattcctagaatgaaccttacttagtcatgaggtattatctttttaaggatttcatgtttgtgtttatgaggaatatttcttatagtttcctttaattgtaatgtctttatctgttgttggtaacagggtaatgcagtgagttgggaactcttccaatcctgggtttatgtagaattggtattattctttaactgtttaataggattcagtagcgatgctatctggattgtattttgggaagtttttaaataataaatttaatttctttaattgatgcagagctattcacattttcttcttgaggcagttttagttattagtagctttcaagatatttgtccatttcatgtaagttgtttaatttacatgtaagttgtttcgtagtattcttttatcattcttttaatatctgtgggatctgttctgatgcctcttctgtttcttctgttattggtaatttgtgtttctttcttttagcctgctgagaggattaatgattttattgaactttccaatccagcttttgttttcattggttttcattactgattgtccattggtcattgatttcctcatttgtcattattttgtccttctgtttattttgggtggtattgatatgaaggcagatacagataagttggtcagaatacagagtctgaaatagacttatacatagatggccgattgatttttgagaatggtgcaaaagcaactcgaggggaaaggatagttttgccaagaaactatatgagagtagctagatattagtattgaaaaaaatatatctaaatccttactccacaccaaaagcaaaaaaaaaaattacttcaaaatgagtaataggtttaaatgtaggaaccataactataaaatttctagaagaaaaaacaggataaaatctttgtgatcttgtgggtagagatttcctagattggacatcaaaaagtatagaaaataagaggaaaaaacccctgataaattggacttcatcaaaatgtaaaatttcttttaaacatactcttaagaaaacaaaaaaatagcaagctgttttcttgaagggaaaaggtattggcaaaacatatctgaaaataacttgtgtccagaatatacaaggaactattacaactttttagtaagacaatccaattttttaaacaggcaaacacatgaaataaagttcagtgttagtcaccagtgaaatacaaattaagtcagttaatccatactttgaagtttgcttttctgaaaggatttattactgcttatacttcatagccactagcatggctaaaatttaaaagaccatacagaggttggacaggtgcaactgaaactcccatacattgctggtagaaatgtgaaatgacataacccctttggaaaatcatatagaagttttttataaagttaaacctatacttacaacatcatgtagcaatcccccttctagatattaacccaacataaatgaaaatgtatgtcaacatagactagtacaagaagaatgttcataacagctttattcacaatagccccaaactggaacctattcaaatgtctgtcaacagatgaataaacacattgtaatatactactcagcattaaaaagtaatgagctatggttgcacgtaacaacatggataaatcctgaaaacatagtaagtgaaagaatttggacacgaatctatactgtatgattccattcatgtgcacctgtctaatctgtagtgatgaaggcagataagtggttgcctgaggctgatggtattgtgggggttgggggagagtaataggcaagagacattttggagcattagaaatgcctcttgattgtggtggtagttatgcaggtgtgtttgttgttaaaacttaccaaactataccctcaggactacgagaatctaatgaagtaaaattttcgttataaaagttataactagtttttttcatattctcatccccactttcattagtggatgtagatggactttaaggccactacttattttggaaaatttgctatttttaatagcatatacttacattttataataaaaagtacaagaaataaaaaaacctctccgttatatcacatttttagcatgcgaaatgggaagttgaaatctcttctctagtcttccaatcttgtagccttaatgactgtcaattttgatgtatacttctgcaacttgcagtctggtggaagcatatatattgattaaataaaaacacaaacatagtatctttaaatcataacaagtgttattgaaaacaagtgtattagtctgttttcatgctgctgctgctgataaagttatacctgagactgggcaatttacaaaagaaagaggtttaatggacttacagttccacatggctggggaggcctcacagtcacggcagaaggcaaggaggagcaagtcacatctcatgtggatggtggcaggcaaagagagcttgtgcagggaaactccttataaaaccatcaggtctcataagacttattcactatcaggagaaaagcatgggaaagacctgcccccatgattcaattacctcccactgagtccctctcacaacgcatgagaattcaagatgagatttgggtgtgaacacaaccaaaccatatcaacaagtatagaatgtttacacagtaaaaatcaaaaccttttctgacccttcatcctagttcagagccatactttgaaaagtttgcttttctgaaagcattaagtactgcctagatagtatgattgttcatgtggataaaacatcttgcacataaacagacatcctcttattaaagtattttctcattggtagttagcattttggtattattttgaaacatcaagaaatcttaagtatttaacttcagtgacagaaaaattgaaatatcattcagtcagcaagtatttataagcatctccctgagccttagtctgtaatctttattcacttatgtgctaaatgacattttgttacaacaacaacttgaaaatgacagtttgttcaagtagtattttttgtgatagtgaaggggttattaatgttggtatgtgtcaaacacaagtttttcttaaaatatattacacacaatactccataatcgtgtttaatttaatggagagtatttatcatgggagttttgtgctcatataactttaggaaatgcagggttgaaaaagttaaacattttaaattctagatttctcagaagttttaatacgttaccttctgaatctttaagacagagctgtagtatacagtgactctgaccatggaactcttttccccgtggcctgtacttccatgaatagacatctaagcagataaataaatctctaacagcatctaaaaattataatggaatattttaaagatgctcaataatcttaatgtaaaaacattatttatatagatataattttatcacttatagttactagatctgtattttgtatttatatgttgaacttttggaaattaatttatacataatgaaagaacaaactctccattcttccattcttaactgttagagaaaagtgaaatttatatttcttttgtatttcagaacaaagtagaagagacgatttagaagctttaggtcatatgttcatgtattttctgagaggcagtcttccttggcaaggcttaaaggtaattgtttttgtgtttctttattgaatttcataaaatattaagatattaaggtcctgtcttccaactaaacagttttcatattttaaaattttattttgtaagtaggcatcagggctccctgtgttgcccaggctggtctcaaactcctgggctcaagcattccttctgccttggccttccaaagctctgtgattacaggctaccgtgtgcagtcccagctaaataatttttaaattaccacattctcaagattttttttttctgttttaggctgacacattaaaggagaggtatcagaaaattggagatacaaaacgggctacaccaatagaagtgttatgtgaaaattttccaggtaatgaataatgtgaggttgatacattatatacagaaaactagaaatgctaatttttattgcttaagtttatacatatttttttctatgcttaaaaaaaaaagagctaaaaatatgatttaaaggttgtcagcatttgatgccgaacccacagggacactttgtgtatttgctttgcaaatggtattaatagaagaaaatcctgtctgttaatagtgttgatcattaccagctgaagtaatattttctttagtgatatacttttaatgagttaaaatttttgctaagaaatgccagttacaaagttttggtattcagtgttagtcatttgggtctcaatgtcaagttcaaaggaggtatgtgaagtatgatttggtttagttttcaaattaaacttaaattaagtaaggccagtaaaaccttactgacctcactagtttggggctaattttatattggggagctgtatgcatttatgaaaataattttgctttcaagtagatttatggcaactcaaattaagccaaaaaaaatttacttaagatttctacatcaattaaggaataagaataacttgttagtatattaagataatgactgtgatttatttgtgcagccacattaagtgaaaagagagctaaatttgaagataaaatacggaattcctatctcactttagtattccgtagttctcctgtataatgctggcgttattaatgtaataataatattatcaacataacaaaagtagctctttctcaagcttgtttatattattcattgacagcaaactttaattatatattttcctttcttgctataatatctagaagtagattttttaaaatgtcggttaatagtactagcagtttagtgtaggcagatagggtagttgtcattaaggaagcctatataaaggtgggaaaaatggggttgccaaatcaaattagccaggtatttagctagaaagtggaatagtgggagagtcaccacctaaagaaggtcactgcacaccacttttgttgcctcattgtgctgggtgtgatctttttcctgttggctggggctgcctgtgaatgctaggtgtaacttaccatctcttactgtagtgattttctgtgccctgatggtgaaatgccctgctttactaattgctcaccattttgcccattgttttatatttatatatttgtttgtctgtttgtttgtttttgcatgtattagatacatgtatctaatacattttggaattataatagcatgcagagatttgtatatcgccaaataattgttaaatatatgaccagaaattaagagaagacttacactgtcctcttgtgttatgtttttgagatttgttttagctttcctttgttagcttaattggttagaatactgctcaaagccaaggttaggaatttgaattctctattagttagttggtttatgtcactgattctaaaggaaatccagcaagccaatacagatgctttcatataaatcagttctcaccggtattttaaataaaattttaaatttataaactgaatatgatgctttgtgattaatcatgcattattaaactgcttattcaacttctcatactaccaaatattaaaaataatcttataaaaatgaaaattttagcttttcctaatgaaatgaagcaaaaatagtggttgttaaactaaacctcccatttttcttgtgtctctattcccttccttcttttcctcttttttattttgttgtaattaaactcagaaaaatttaaattgcaatgtaattttgttacttttcaagtgtttttatataatacaatgtgcttttagatacttaattttattactgagtattaaagaaaagtatagtccaaataatttttatattatttctagaagaaatggcaacatatcttcgttatgtaagaaggctagatttttttgaaaaaccagactatgactacttaagaaagctttttactgacttgtttgatcgaaaaggatatatgtttgattatgaatatgactggattggtaaacagttggtgagtattctatataataatatattacttacagtatctgttgcctttttaatagtacaatatcttcaattgaaaagagttgagaacaaatagttgttttaaaggattcattttattgttttttaagggacatttctgcaggtagtgccgtactagtgttctttgagtttttcagaagccctacatctggattctttgccttttagcatgaagagttacttttaacttttcatcctgatttagttcttaatgtcaaatatactcttttttgtgtaatattctcatgattaatttaatacttcaatcccttgatgaaaattaaaatttgtatgagtctcttcaagtcaaaatattggaaataagtaattttattagtttttttattcttttaattttcttaaaagtttattctatgtatacatttgctttggaaatgagaggcataaacatatacatttttatcatgttgatatgaaaatgtagcctaaaagtaatggcagcattaagtgttctgtagatgtaaaaataagtactttataaagaatttgaatattttaaaaacactttaaaaagtaggtatattctttttgctttaccttcttagctttaacaacatattttgataatgatgcctttacttaaagccttagtttatttaacagtcttttgtttttttccttaattcttttaagcagctaaatgattttaaataagaattttaaaatggaatgtattgataccaattgttattgtattgtagcctactccagtgggtgcagttcagcaagatcctgctctgtcatcaaacagagaagcacatcaacacagagataagatgcaacaatccaaaaaccaggtttgctgccctttagatatgaaataccttcctttcatgattgaaacatacacttttttcttcaatagataaaacagactgaaggattgaaaatacatatttttaatagataatctattttctcttaatttcactgtttattagtttaataatagcattaaaatgtttaatcataaatccttaattaatggtacaaattagtgtaaacttttaggaatatgtgatattctgttagaatggaagtatttggataccctattagaatgaattgtaataacacttggactttctaactgtagtttagttcaataaattatttattgaatttctgctattgtaaagctactgttctacacattatagaaattcagaagtaaagaagactgtataacctttaagaatgattttgtcaccagtgtctaaaagcagtgttgtagctaagagttcactcaattctttagaatcaggcatacatggatatggcttgaccctgggcaaataagttaatctgtcaaagcctcagtttcctcatctataaaatggaaataatgcatgttaatttagagcatacagtaagctttgaatcaaaactcttgtgtctgctgttactgttattattattacaataaatacagaaatagctatatttaaaaagagaataagctatattacatgaaacactaataaagtagcatggagatcatatgtggggctctatgaagattttatggaaaaggtagcttttgacatgaacctaaagaatgaatggagtttttaaagggaaatgaagataagggcattttggggagagtgaataatataaaatatgaagcagaagtttaaaaatagagaatttgaggaatagcaagcggttcaaatttgtttggagcaggaggtaggtagagatggattagagagggagtagagagtcagtctgagataaggcatagaagttgatcaagtagcgagttcatgtttcctggccaggtaaaggaatagaaagctgttgaaatttttgggcaatgttttaatttttctctctctctttctcttttttttggtaaaaaagttttatcgaagacatctttgacttaaaaatttcactatcacactgagttaaggagtgtctagaaattttctcttacaatccattttggagaaggatagtatgccgtcctttttgacttttatattgtttatcccatcaaagtttaagtgaagattaaagattaaaacaggatgacaatcaaaagaaagaacaccacttgttaaaaatcatagcaaaataaaatgctacattttagggagtgtttaacaatattatgctatatatatatatatagcatggccagttttaaaagattaatattaaatttttgacttagaaaaattggtactataaagcatctcatacataaattacttcatatataaattaaaattagttgatagctggagtgctgtgaaaagattctgtataaagaaagaaatggctcagaagttgagacttagtttgtgttttataaaccagagttaattccttgaatgtacttggaagaagattaatacggtattctttgaaattctccacttgagctgttaggtattataataagtgaaattcctctattgttgaattaaattataaatctaatgttttagacttttagttttctacatctttcagacatgtcttgctaactagagtataagctcactgagggtaggaaccatgtttcatttgtccagtccttgcactaaatgtagggtgggtgtgtgtgtatatatacacacacacacacacacacacacacatatatataatatttaggcaattctttaggataggcttatatattgaatttgggatgtgaatatacacactttcatcatgatagaaaagttgtatatttaaaaaaaacttcttaaatatctctagaccactaagcagcttaagttctacaagaaacccacagttcacaatcccagaggaagatagattatgtcacgtgacttaaacctttgtaatgcccctagataaatgagttaagttgaggggatcctgaaattgttgggtacatgtaattgtttattttcaggagagggcgtgtagctcttactatattcttagagagttccatgaccccaaaatattgcgcattgccctagatgtttgtctcaattttagcatcatttttattctttgatcttgtctagacttgacttcatctgatttgatttcaacttaagctacaaatctgcttaattctggttatggatttggagggtttaacgaaaagacattatagaactgtcatagttttgatgacatactttatgccacagagtatgtaattttgcattgtacaatttaggaagcttagtgccagaacatgtattcatgtgtctacttgaattttacatctctccccttaaggttgttctggccaacaatatgcttgaggctccccatactccaatatgcttggcactttgtggcaagattttcatgactttgtttgaaaaagaaagaaaagagtactgaaggctttagaatatatttaattttcgtaaggagctaggtagtattattggaagagcattatgctctgagttggaattcctgttgtactccttggtaggtctgtaactgtggggaagtggttaatgtctcactgtcttcatcagtaaaagtggatgataatatctacctcaaaatatggtaatatataaagcagctaattcagaaccaaacatgtaataaagtttaaatagtatattcttctccctactttttattagtgttgtccacattttcctgaaacagaagttgtcccctattaagaaacttctcttaattttactggtagattatgatgtttgttattgccatgcatatttgccaagggatctaaaaacatcaagaattttcagattatttcatagacatgggttccttaatttgaaccagataaaaggagatcaaggaagcagagagattcatatatgtaggattatcacttagaaaaaaaattgttttgtcatattctcatagtattctgtatagtgcttctcccttttcaaagaacttttctgttttctcatattatccttagaatcagaaatgggggactaagcaagagagaaaatatttttagaatctcaggtacagttatttaagggccatcatttgtaccttgctaaaaatagctcctcatcagaaaaccagtgatgacatctactgtgtaaaaatatagtgggtggacttctagtgtgcccaggatttatttggagttctttcttggtcatggcatttttacctttctggttctttattagttcatttataaagctagagggtagagtctgtgatttctaaagtatttttacttctaaaattttatggttctattttatttttattgttgatcattacacaatttggcaacttaattaaaatcactccacattctgtatacaaagataactgcaccatgattcagaatagtaagggtattttaaatttccttttatacgtttgttttatatattatgaggataaaatgtttaacatattgggtttttcttcttccatgcatgccatatgcattaaataaatggcagtcggcagaccacagggcagcttgggactcccagcaggcaaatccccaccatttgagagctcaccttgcagcagacagacatggtggctcggtacaggtattttctgatttttgcatgagtgattattacccagatttatacaactaacccttttttttggaactcatggcatgatttcatatcttaatggaaaatttgttgctgaactactctatccataattctattcctttgttatttaaccagaaaaaccaaaattaacgtggtctagaaagaccatcaggaataccaagatttttcctttgttcatttttgcaactatatgctacaatatttaagtcatatagcagattagaaaaacaaacggtattatgcttgaaataggtattaaacttgactttccaataataagatcagtctttttaatgcttaaattaatagaacatttttgtattttttcccattcattgactttgcctccttcaaacataatcagttaaatatcttttttcatccttagtactcagaatgtactttctgattaattgttcaaacgaacatgaccctaatttttataatacatgttttgtttgtacttatagaaaatatcagatggaaattttaataagaagtgtttattaaatactcccctcaataaattgtatggctttttagataaattcaaagcagtcccttatttatgatttgtttcttttcaccttttttatacacttagagaccgctactatatatattctgccctccgttgccccataaattttaatcatttatgtatattgtagaaatagggaaagattgctgagtctcgtattgtcttttaaaatatcggtttaaggtaatctaaaagccagcttaaagtaagtgagataacaaatgttatcccagtacatttcaatttagaattttttttacattttcatttttttctttacatattttcacttgaataatttgccattttatcaaatttgcatttttcttagtgtatatatttaatcaactgattctgtactctgggtgctattctttcttgatttgagttctaaaaattaaattatgattaaatcttatgagccctcacgtttttctcatcattaaattttagaggtaatttaaattatataatggagtacttttgtagaattttgcagtttatggaattttcagtaatgtgtggtagacttatttgagtagatctataaaagtctagggtgaagaacttagaggcaagagtgtctaaattgtaaaaatttttatgacttcaattcatatagttagaaaagctaattcagcaaatatattctatttgcataacacaaactatattttgtatgtatctgtatatgtttacatgtttttaagtttgtgtgtatgtgtgcaagtgtttttgctcagtgtaacaattaaggcactattagaaaattttcctaccatttctgtaccattaccagatttattttcttagcctcttcttactcttatgtgattccttgaggtggctcgtgggattcctttggactgtcaaagggtgaatgaatttcattattcattcattatttcactacttcacgtttattgtttcacatgttttcacagagatgtttgaacattgctcgtttctcattatttctaagagttttcagcgtactgagactacatctgacttcatcctaatattcaataagtgattaacttaataggtttctagtaatatggaaatacataggtaaaacaaagaatagtattttcattgacttcatgtattttgtaatattaactgacacatgatatgatggactaatatgacagcctaagtaggatcatgcctgaatccttcccactccaaaataaagactgaattcatttataatttatgtcctatacactttcaaaattatttgaaaatttgtaatgtgacccttgtgtaattggactaatgaaattataaattaaaacgtaataagagcaaagaaaagtacctaaaatttgaactgatattataattgaatactatatttgattctgaatgaaggcagaaagggaaacaatatgttctattaatattattctcattgtttgataaagggaggagagaaagagaaaaaaacttttcagtaatacaaaaatatgagaagaatttgccttgggcttatttgtgcaatggtcattaaatcacctgttgaacaaactttcaagcattggctttacaggagatgcaaagactttatatggcaattaaaaaattattcttaataaacatactaagagtatgtcatcaaatagtttttttaggagagacatttccctaattaataagtcactgtctggtattgaaatgtgacgcaggtttaggatatccagaaacagaatcaagttacttaaaatgagcctcggtaagactatggctttcactcctcactatcattgcagtcttttccttggaactgatcattgctgtcagtgaagcactgaaaatcattccaggctgtttagagttgacatgtaagatgaaacctcttgccatttttgacctatagaaagatcctcaggtatttatttcacatgtacttttagtagaagttatcagcagagtctaaatttgaactccctgcctttccagaattattatatagcagaccagacagagttaccaagttgagagttaccaggttgatgatgttgcaattaagagcttaagctctgcagtcagatttgagttcaaactctgtgccaagattatttattagtaaatgaggattttaacaattcctctaccttatggttttgttatgaaaatttaatttaaaaagtatttagcatagatgttgaggcttaggaagtgttagataagtagaatctattgtttttgcaaattaagaaacttgagtagtattttcattttattgatctctgggaagtgaagtattagaggtacagtcaaaagaaagcattgatgaatgggatttttcttattttatctctttagttcagtcatgttaagtcactagctaaaaagatacagctgtacgtttgataaactttttccattcacgagactaagaataatattcagatatctactacctttattttgtatcagcctgtgttctggaaaacccctaggggaatcaagtgtgcccctctcggttccctcttagaatcattggtagtaataaatatggctgagaaactcagacctaccacattcagtttcttggccattcattactcagcaaattgctaagtgttcattatgtgctaggctcttgtaggttttcttgaatgaaaagaagtgtgtaaagacatggtggctgtgtccatgaagaagtcagtcaaggaggctgatgaacaggcagggtgataagtggagatagcacagggtactaggagaattgatacgaaaagcacctaacctggatgagtcaagactttctggggaaagtgacatctaaactgagacgtaaagaatcagtgggagttaatcaactgaagatagaaggggtcaagagaggagtataccaggcagagaagacaatatgaataaggttgtggagagagagacatattgaggaagctgatttagtcaagctggtgtgtgttgagaaatgagactgagaaggtaggctggaggtaaatcatgaaggatctaacgggtcttgttactaaatttggctttattctgaggataatgggtagccataagggggattaggagaccaaatttgactagtgttttctaaagattgcgtttgctggacactagattgaaaggagacaagtctaaatgagggatacagctgtcaaaagtctgtagttgaggaaaaatgttgggtagtggggataaacaagaaatgaaaggctttgaaaagaattagaaggtagagtttagttgggtatggggctgacgggaaaggaaaagttcagttgttacccctttttgacatgtttctacatggcaaatcaagatccccaaaattaggttttaaaatataccactgacaacagatagtagtaatctctaattccattttagctatgcttttcactgtagcacaaatccatcgagctcagtgcaaactgaaaatctgatcctatatagaggcaactgtaagcaaagggaaaaagacaaacattaaggacactgctggaaaactattttacatggttgtactatgtacatgtactatgtatacctcctgattgtttggaaatctcttatagttgtacagtctttggtttgaatctaatgaataatgtgactctgagcacttgggagaaaaaggggcagaattacaaatggtgcagatatgttgtgcaaccaggcattgttgaggaaaacgaaagaataacattcattgttgtaataagcagtctgatcttttagccagtgaagcatcagaacaaataaatacagttggtgataactgaaaaggattatcttgagatgataataaatgtatcttgagatgataataaaacgtgattaaaagtctagaggaatagtagatactattgtctcaattacattaatcgtgaatactgacctttctaaaacatttctaatactagtttcagtctacaaaatatttgaaaatgcagttattaacaaggaacaaaatctagtgactattacaatcacatctttctattcatagttttctggggtactgaaatctgcaaaagagagattgtggagggagtatggttatgtgcctttattacataaataatttatagttcatctagtttaggaaattccttatctagtatcattggggtaaatcagcattatgaatttattttttttttacaataacatttacagtaacatctctgaagactgggatgatcaaggaaaataattatcctaagtgaaagttaattgaaaatccattttggcttatctttgttgaaagttggtgagcatgtcactatctgtgctttagggtcatcttttggaataccaagagtatcaattatacctttagtctttaggatatgtaaataagttggtttcatatagtatatgtatactttagcacaggttcaggaaattatttggaagtcactcttttaactgttaatatatctcattagtgtgctttcttatagatgcctttttaaaaagctgaatacataaataaaatatataatgttttagtatttctaatacattattagatgagaatttggctaattaaaatatttggttaattcatacattgtatcaaggttctacttagtaatcttgcttacaaggtatcaaatagaaattaggaagacaggaggggcgtggtggctcatgcctgtaatcccagcactttgggaggctgaggcgggtgatcacttgaggtcaggagttcgagaccagcctggccaacacggtgaaaccccatctctactaaaaatacaaaaattagccaggcatggtggtgcacacctgtaatcccagctacttggaaggctgaggcaggagaatcgcttgaacccgggaggtggaggttgcaatgagccaagatcatgccactgcacttcagcctgggtgaccgaataagatgccatttcaaaaaaaaaaaaaagaaagaaagaaattaggaagacagtagtataactaatttgtatgaattcattatatttggaaagtacattaattgattttaaaaatcattgacaataaaaatactatatgttatgtctgtactctgaaatctataagaataacatcttttggaattggatttgtcaggcatctgttaagtttacaattatgtctcacacttgcttgtgggctgtttttccaacatccctcttaaattctgacagtaaaactggagtctagttgccttttttttttttttatcttcttaaaataagaaccgtattaagtttcctgtcaaattgggaatgtcagagggaatttttttttaagaacaacaacaatcctgtataatacctgaattattttttgaaatgtcaaacctcagaatatctgtcatttttatgtgctttcaagaaatcagcctgatgtacactagtatttcagagactcatcttctagttcaagttataattctagaaatgtcactttaatagaattattctttagaatttggcttataaaaatatttgtgcatatttgattgttttagccttccaggagtataatgatatattatttacagtagtatatcttcatttcttctttgtaaaacccttttgcaaaaagacacaaattttaagtgaaaataattttaatgccatgatacactctcaagtcaccggtgttaaataggccagtttatgaaagtcaacagcagtatcctatcttaactctgttaccacagtgattctattctgaacttgggatactagcctttactgagaggattggggaatctgggaaaccctggaaaaattacattaaaggaagatgttgcttccttctggtctggttctggtcaaccaggtaaaatggggtttgaaacatttcaataaaataaagtttaccaaagtcaggtataaaaagtcttcctctgtgaactgaagtaaatccgattatataattacagtgtatatatagtcactgttgctagaaaatatgtaatgttgctagaatttagactacctgagtttttcattttcaattatgctgcttaaaataagggaagacatgttagaggagctgcctgtaagttgaggtggcatcccgctagctgtctagggccattgaactaaagggagaataggaaacctgttgaatagtatgttgagaaaagagcagtggaaattgttcagtgaactgtttgattatgtactggatacaggcactctgttcaaggtagtggagaatatgtgagataagaatactactttgtgtctcctttccaatttagtgcagaggcaatgacattttcaaaattaagaataaagaacaaaattatgttcaataattagaaaaaataattatttttaaatgttttcagagagagagagagaaaaataaagagaaaaaatttacagttcaatagaatgacagaaagggggaagcaagtgccccagaaaaggagaggcatgcttagatgtaagaatattcttttctttagattgcctttgaagattatcaaggcagttttgtatgttttcagctgtaggcacaactgcagtgttcatttctaagtacttattccatataggatataggaaactgaatttctacaattcctaagttaaatatgttggttgatttgtagatattaatactttccttggagttggagagggtcctgtttctctacactaaagtgtcagatctagaaggacagggatgtttatcttgcttactttggtattccaaatacctagaacagtgcctaagcatgttgtagactaaagtaagaacttagaaatatgaggtactataaatactacttttaagtctaatagtcagttgtcaactctgtagcccatgacagggttgctaaccttttatttcatttaaagagattaggtagtgggtaggaggggcatcaaagagaattcttagatttttgagcctggaagtctggaagatgggagggctttaactgaaatgggagccttgggaagagaatacatttcagagggagtaggataaatttgcctttagaaatgcagagtttaaggtgccaaacttggcttagcaaactgaggatatgggtgagtggttaggcccagggagtcctttacctagaggtgagagttgaagccatcattatagataaaacatagtgataatgatggccaccatttattgacctcttcccatatgccaggcactgtgctttatatattaacatttatgtattgatctcatctcaccctcatatcaaccttgttaattagatgctactgttcaccatttcatacttgagaacactgaggtttagcaaggtaaggtatctttcccagagtctcatagctggtaagtggtagagctaggctttgagtctagacccatcttactccagaatgatcagctagcgccaagtgatttgatgtacaagaaaatgaggcaccgagcaaagtgtcctgaatacattttctaggaatcattagtaacctttaagataactcttattagagttcttatgtagggttggagaactgattgcaaggagtaaaggaataaacacatggaaaattttataaaaatggaagtggtgagttatatattttttttttccaaaaagtttagtgataagggaaaaggaagaaataataaggtaaatttgcagaaacaagagaatttgggagaatttgggaatttcctcatttttatcttgtttcaggatttcattcatgcatacatgcattcatttatttcaacgtatatttattgagttcctattctctgcgagacatagcaggaaacaatacaaggtctctcttatcctggagcttaattttaatggaggtagggatggatgtcaagaaacacaacaaataaatgagcaagcaaataagaaaaacatgaatactgataaatactgtacaaataatttaaaatagggtgtaacataatttctgtgctgtgtcagcatagaaatttttagctgtgtgatagaaaaggcctgtctcagagatgctgtttgagaatctgaaagatgagaagtcagctaataagtaggaagagaattctaggcagtgacaataggtaatgccaaggcctttaagtgggaagaatctcgacatattggatggaggctagtgagcttcagagaagatggtgtaagctcagagaggtaggcaggcatcacatcatgtgggactttgtcaatttgtgtaaggaatatagattttttattctaagtgaaacgggaagccaacagttggagagttttaagcagagagctatacatgatgtgatttgcatcttaaaaggagcaccctgattgctgtgtggataatacatttgagtgggggacaaagctgaagactagataataggtttttgctcttaatcacataagagatcatagtggcttggactggagtccttgtagtaatagagatggtgagaattgattagatatgggatatgtttggagaaggatttaacaggatctgccatttatggattagatgtgggttttaagttaaagaggaatcacagtgacccctacgtttgaacaactgggtgaatgaatggtgttgtctctatttaaatgggcagtttgaaatggagacttgagcataattgcagattgaagtgaaggatccattagaaggagtaatattgaagtttttcaatattcaaggaaagtaattcatgatatagcaaggtgccagaggacatagacacacaagaggaaactgattgagacatacatgcaggagttagccttaaaaaccagagggaaggagacagaagacacagatttcaataaggaaaggaagtaagttgaaaagcgcatattagatgactttaatctttaataaaatgctagaccaattactgtatttagttatgaacagctacatattgttttgtgttcctcacattaactttctaattgaaatactttaacaattatgtttatccttgtataacctatttaatatgtatgtatatttatgagcatgtgtgtgtacatatacatatataaaaaatttttttttcaaacaggttgtaagttctacaaatggagagttaaacacagatgaccccaccgcaggacgttcaaatgcacccatcacagcccctactgaagtagaagtgatggatgaaaccaagtatgtgtttgttttacttgttttagtaactttttgttcttaaattatgcatgcttgagatttatagttacatacaattatttcaggaaatttttttcagggaataggtgcatgcaaaacaagtggtatgcttaattattttaatcactagaatgagtttaaaatagtgctattccagtaaacattttaataatacaaaatatttaagaactgtgttcaaattcttatttggaattaacaacatatttttagcttttgagttttaggagtgttgatgcatgaaagttattgatgtactatcaatcttttttctgtaagcataagaaattaattttataaaatgcatgttttaatattttgaattagttttttcaaaacataaattataacaacattgcttggaaaaaattaagcatgaaaaacaatgtgataatttcaatgtgagctgtttctgattctctctctctcttttttttccttgtatttttttttttgtgtgtgcgtatagctgccagaaagtgttgaacatgtggtgagtctcaagtgtaggcaggcagaaatagctccattgactgtaatttcaaagatttagcatcattttgtgtcttttgaaaacaaaactctcaacacagtgattataattggtaaaagttattcaaaagtatttgatatcattaagatagctctgaaaagcaagaaataattgtttgaggagctcttttgcctgctgcaacttttttactttaagtgacatagatttggggccactttttaattgcatagatgatacaccaaccctgcttgtgcttgtgcatttgttttataatagtttttatttgctatttaaatagaaagatagatttttgcattaagctttcttttttctctttgcaattgttaaatacatgtagcagatctcatcccccacagtagtatcactaaaacagtatttcatttactaaccaattatcattgcccttgagtacaatattgataaatttcatgataaccttgtagtgagaaagccattttaaaaatcctcatctaaatggttgctaataattgcagatattatggaaagtaacattaatagaaataattttagatttaaattattttctgacatttgcctttaattgtaatactgtgcttaaaatgcttctctcagtttcaggacaaattttgagtcagactgggagtgaataaaggaagttgcttagtttagtaaattttgaaatattttactcatatctaaaggcaccttatataattttcaaaattatgctcatttgttggctgcaaaattaggaaacttttgtggatttttttttgttaaagagcagtgattaagaatccattttaatcacttttgactatagaatttattgacataagattaagactagtgtatgtcaggatataattagctatatacttgtatatttttatgaactacagaaataaatccgtgaaagtatagtcttacttgtgtgtttttaaatcaaatataaaaacaacagcttatgtttgggaattttaggtacaatcctaagacaggaaagtagggtggtggtgtggcagattcgactgcacatgtcctttgcagttagacataggttatagaatcctgtttctgccacttatttgttaccttcaagaaagcttgtttctttttctgtaaaatgaagctaataatacctacttcataggttgagaaaattaaatgtgataaagccctggtattttgtctggcacacggcaggtactcaatagctattatcacccctatttatttcttctcttccaactgctggtgacgtttctcatctctgttcttgggcttgtgcctcttttatctgtgtcctatatttttacttccatacacacactcttcactgaaactggctgttctgtgtttacatcctcctggagacttgcttttaataaaatctattacatttatccatttattcattcagcagttacactgctgaggtttctgacatacctgatgctgtccttgttcttaagtagattacaagccagcaggaagattgcagttgtactagtatatgtcagtatgtgattaatacgataaaaaaggtattttaaaaaatggttagagcttgtaaagataaagattacttcctgacctggatgatcagagaatacttgatggaggtggctctgaagaatggcacagttatttagttgggatgagtgtgggtgtgtgtttgggtccctatctgtagacactggaggatgtgaaagaagaaagtggtgggaaggctattgctataggaagggttctccattgcctgccacatcatgtccagatttcttggcatggcaccaaggcttctcatacctgtcatagtctggcccatctatttttgcagctccgttttccattctgaactttatatagcattggttccttaaatctgcatttgctatgttatcctctgtatgtacttcccacttcttgaaacttactgaatttcttgaaaacaggtattttttcatcctcagattcctagtggctatatgtcctaataaatcattactaaataattaacaatgtggtatacccatacaatggactgccatttgacaatataaagaaatgaaattgaaaacattgtgctaaatgaaaggagccaaacacaaaaggccacatgttatgtgattccatttaaatgaaatgtccagaataggcaaatacatagacatcaaaagattagtgattgcccagggcagggaagaggaggatgggatttctttatggagtgatggaaatgttctaaaattagatagtggtgatagctgctcaattctgaatactaaaagacactgaattatatattttgaaaggataaagtttataacgtgaaaaatatcttaataaaatggttgttttaaaaaaagtatagcaactcataatatcagtgaagccttacttcaggtgggttaggtaggttacagaaatcctcagaactttcctacctctttgctgattaaacattctatttaaacaagattttttctttaggtttattctgacatttctacacgtttgttattgtgttcctcataccctcttaatctgtgactaagaaatttgagcatgattttttttcttttttaagagatggaatcttgctgtgttgccaaggctggccctgaactattgggctcaagtgattttcctgccccagcccccccagtaggtgggactataggtgcacaccatcatacccagctccttttctaaattgcatcttatacttctcttctctgtgccaccatttgacacgtaactagggacctgcttagaattttctttcagaatttctttttcatctttcttcttacctataattagcagagatccttctcaccccaccccatttactagaatgtattctataatgcacattttagcatcctcatgtttcctgagaatagtatctcattggggtaaatacttgatttccaaatgatggaaaatactctattctcccatatggaaaatgatggaaaagctgattagcttcattagtaatgaggttttgtctttcttgtttactgtagctgagaattttaagacaggtaatacaaatgatagcaccttcatcattccttccaggaacttaggaaaacaaaataatttagtttaattatttactttttaagtagtatgaaaccatcctttattctttctctttccttcttccaacatttaccgaacagattatcatgttttgtaatgtgatgattattaaggtatgtcaaagtttgcataccattaagttggttggaaagtatactaacaacttttatacaatggttctcaaccttgatttcacattatagtcacctagggagttttaaagatgtactaatacttaggctgtattttcaaggtttctgattttactagttggtctgtggtggggcctggttatcagtatttttaaaaaacttctaaggtgactctaaggagcagccagggttaaggatcattggtctaatacaaagtattacatgattagcactataggaaagggataatttttactggagttcagaaaatggagtatgtcctcctagttgggaagatcggagaagtcctcatgggtaaggatgcatttacactagttctcaaagatgagaatgatttggcaagggaaatggatagaaggagtcagagagaagaggttgacgcaaggaaagaattgaaccagttggaggagtaactcatgcaggcagagaatatatgaacacgttaatgaaaactgagataggctaatttcccaatctcagagggccttggtagccagtaaccaaatttggacattatctttctcagcacaagaaaggaagccaagaaatgacatgtggttttaagccaagaaacaatatgatcaggttgatccttaggaaaattaatttggcagcagttatgaggcttatgtcacttcctggggttcagcagattgcagaaaatggtttaaaaatataaattaagttttcctatgaaactagatggataatttctattttgggttagtattctctagtaaacaaactattccttaaaaaatgttttaagattatagtattggaccatttgtttagtttctataatactaagtgttcaggactttgatagtctctagaactgtaaagataagtaaagaataatttatttcctcaagagatcagttcagtgaggaagagagaggtataaaaattataatacaaagtgacagagactgtataactcttttgggagagagcaaatggattttaagtggaaagaagagcatgtgcaaagatactgaggtaagaaatcccacgtggtgtgttctgggaatgacaaggagatttttgctttttcttacttttcccttccttccattcatagtataggccacctgggaaggaagcctaatggagaatgagactaagaggagggtggaaataggttgggaacaaaattcttgaagagctctgtgaacttaatgctttagtcaatggagaatcattgatgagatttgagaggaaaagggcatggcatatttatgatgggggcaatttggatggcagattggagagaggagagacttagactgggaagtcctttaaaaggtgcttagcagtggtggaggcaagttgaaaagttcagaactcagccaacatgagaaaatgggaaaattttgaaagtcatttcagacttaagggactagttgcaagtggatagggaggaagaaattggagatgaagatgggcctgcaggcttttggttggagtaattttgtagatgatcttgttctctgatctaaactcttcttgcttagctaaatggttcctcgttttttctttaaatcaagagatccagagatatgaaattacacttcaggtttaaaccttaaggggaaatattctttgtcaaagaattaaagattagatgccataaaatatactttctgtacactcatcaacccaggtcaggagaaactaggttctggagtcctacgtggttagttctaggaggtaccaacagtctctcaaccaaaggatgagcaatgagtcatcttagaagggataaataagaacatcatatccagatagggaaacatgcttcagtttctgggtggatttgagagaaggaagtatatacaaatatatgaagaaaaaggcaatgaacaaaggagaaatggtggtgcggtgtcaatagcacaagcctgtatgtgttttaggactttgatccattttgattgcctgtttgttgcctaattgtatttaaagaaactaaggttgtttctaaagttcatcataagtaggacttaacatatattcccaaagaattttagagtagagatgtagcttcacattttgagaggctgaggtggaaggattgcttgagctcaggagtttgagaccagcctgggcaacatagtgagatgttgtctccactaaaaataatgaaaaaaaaatttaccagctcggcgcctgtagtcccagctactcaggaggctgaagtgggaggaccactattaaataagtactaactttgtgccagtttgttgggctataactgtgagcagtcctttatgaagcttaaattctagtgcaaaggcagataataaataaataaaataatttcaaagtaggagtaagttattacagaaaaataaaacaatagtgtgctcaagtggctacatgggagcagcactgtttcagattaagtgctggggaagaggaagcaattgagatgagacctgatttcttaatctctaagactataaattagctgtttcggtaattacttttatcttaagaaataagccataaggttaaaacatcaatttacttcctaacttctgtaagtatatcgtattttgagaacctctctcttgtctatttggatgcatttgtatcacataaggcaatgctgtcctctggtggtagtaactttaatagcatgccagctttacttttgcaaatctttataaggacgttctttatttagtgggaattatttaaaatagatgtcctttttagattgtgtttgaatttaagggccattagaatttatttgaaaatcttatttagtctcaaataaatgcttggcgtagttcagtaaaacactgttgaaggaaagattacttaagtgtaaagaactcaactctcagaactcaactctcagaactctcagtactggaaatacaaactaagcaaagtaaattgctgatacaagtgtagaaaatttgggactttgtcttgttcatcaaaatgtgtattacattaaattgcccatttcaaagggctaatacaactttagaaaattttgaaagaatctactttggaatttgaaaggatagtgtttaagaatagtgaacattattaaaggaattttatatcaaacaataaatttccattgaaatatggccatattcttaaatttaatattctaagtatttggtctgtcacttctaaatacctatttttatgtcttgctttctgctatttggatatttttctgctcttttctaagtcttaaatttaaaggttcatttggagtaaaggattttatcttttagaaagtaattgagatttgagaaatattaggtagctgacagttaaaaataaatttgacttatttttttaaatccagatcaaatctcttacatgtgtagtcttgttgtactgtggcagctcttctctaggctcttgactgggtaatccatttcagttctttctgctagtcacctccatgagagtaaagttgataaacattcatcattacatatatttctagttgaatctttatcagctggtccacaattttaaattatttacattccacggtctagtcggtgtttactgtttggtttacttaaaaaaatgcagttgtgtaatttggtttgcagtaccctcatagtagtttcataattatggcagaaatcacaataaataatttaaaattatttttgactaaagataatgtgggtagagagattatgtaatttaactggacagtgtagatttctgtttacatttatttcacagaagtatataaaacatacctagtagttattttatattctgtaatcttttgccgggtgggacacttgaagctattttttttttttttttggaacagagtctcactctgtcgcccaggctggagtgcaatggcgcgaccttggctcactgcaacctccgcctcctgggttcaagtgattctcctgcctcagcctcctgagtagctgggattacaggtgcctgtcaccacgcctggctaatttttgtatttttagtagagacagggttttaccatgttggtcaggctggtcttgaactcctgaccttgtgatctgcccaccttggcctcccaaagtgctgggattacacgcatgagccacccctcctggccaaaactattcttctatgaatatagattagtaagaattatagaaacatctttataagggcatattatacacagtctgaattggcagctctcgatgatgaaatcaccatgtatataaatatactttgcttttattacaaaatatgatttataaacatgcccacatacccacagaggacttcagtggaaaccagggatactcaaccatgcttgcctgcgccaaaagtaaattcaaccttaggaaggggttgactgtttaaaggttaaaagaaaaggtgcctaactatatgtagtgtctgtcatgttgtatattttaatagactcttttatgtctggaaggggaaaatgccataccttcatgcctttatttgaaggattgtgaggcatttaagatagatgtgtatttaatttttttcttttttttttttggtgggagcagatcagtgattttttcagttcataccagaccacagcattttcccacagcagccttgatgtgttcatctcctcttttagagacagggtcttgccctgtcacacagactggggttcagtggcacaatcatagatcaaacattcctcctgcctcagcctctcaaggagatggggtaacaggcgggtgccaccatgtccagtgcatgtgtgtgtgtgtgtgtgtgtgcgtatgtatgtataatataatatatgtgtgtacatttatatatgtatgtgtgtatatatatatttagagatatttgtgtatgtgtatatgtagttagagagagagagatatttagagatggggtcttgctgtattgtccaggctggtcttgaattcttaaactcctgagctcaagcaatcctcctgcctcggcctctcaaagtgctgggattacaggcatgagccactgtgcccagccaagattttttttcacctagaaataaaagtcagtattatatttttttgcatatacagttttgacttgtaaaatggaatcacctcaattgtgctactttaaatattaagcatagtttttaccttaactaaactttcaataagcttgaccttctttaacccttaaagaattcaaaattgccagtcttggtattctatataatgtattttctgtctttcacttttttaatatgatggaaaatgttgactagtgtatattggagtgtctttttatttttggagtctaaactgattattggtgagaataaactccccaatgttaggatcattattgccttcctaatggcttcaacagtcacatataaatatcagggagaaagggtgagaatgcatagaatgaaattcttaattactcttagtgaaaaaccttttgaatttaatggctcctttttatgttgcatagaatgtcttgctattcttaaaaggcatgtgaatgaaacataatagtaatagctctgccatattttcactaatacgtatgcttcattggtgtaatcactgtttatcttgcactagcctgttgctttttatgatcatttaagttaaagtgatacagtcaactttgtgatattttagtgcttttaaaataaaaagagtgtttccctcatctgcaggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtgaatggaatggaccaatgaggtggtatcaatgaatatagttccatagaacattttccagaagttcttctgttgtagaaagcagtacagtatcttaagtgtcaaccagttatatacctaatctggttttttataacttctgtaagagcataatcaaacaggaattttcttttctcagtggataatacaacagagaaaacagagttgcccaaatatttaaaagaagttattccttgagaagttcatattttgtgacatctgcattgatttcagtattactgatggtactgttattcataagtcatattaacattctctccgtgaaatcatggtacagtcactgcccagaggtactgaggaaaaagcaatatgggttcggcagatggtggtggtaaaatgaatcttaaggagtgtggtaaatatgtgctccgcttttgttgcatcactatgtgaagtactgtgttgcagaagtggcaaaagcgcttatttttaaaaatgcaaaatatttgtacaatgtaactttatgcttccaaataataatgtatgttagacagcaagaaatgaatactttaaaaagtgatgtatgttggagttataaagaaatacactaaggagaggtagtaaatgtgaaccttgttgcagtgtataaggtggaagcctaaagaaatctcaccgaaacttactgctgaatgattacattctcccttaagcagaaaactttggatgtgccatgcaatggtgtctgtgtaattattttgctctttgattaaaaaaaagacccccagcaataaaaagtgggtcactctatgccctctgtgc

SEQ ID NO: 38627 - DNA, 674391 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccattcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacaggtaaccgggggaggaggtctgggacctatgaggctgctgtccctgcattgccttaggcttttcgcctgtggtggcccttctctgcggcctcgggaggagggaaggctgaagaagggaaccgcgggggtgcattttacaaccgctgagaaccgccggagattgggggtgttcccgcgggtcccctcccccaggccccaggagccggggtcgaccccgtgggatgttaggccccagcgccttcggaagcaaagtcctgggcccccggggaccgaggggccggtgcggagggcgctgcggggctccgcgctgtcggtgcaggcggcgggatcccggctccgcagtctgaagcatgccgctctcggctggcctgggcgcatcctccgctagtgctcttcagagagaggggggaatcccatctccacccccttcctctccttcccttccccccacctgggcggccccacgccagtatctgtgcttgcctggacgagactcaggtgttaatcagatgaaactgctcctcctcgggttgtccctcgcgggccgggcgtcccctcagccacccatggggcacccttcgcctccctcgggggatgggggatcggcttgcgtccggacctcggaaagtgtctgccttctgcctttccgcgcaaaaggccctctgtctgcctcgtcgtttccttagcgaggacgggctgcagcctgctgccggggatccagctttttacttgagagggcaggattcccctactcgggctcctctccccctcctttctgggaacccccaccccggtagagcgtcccgaggctggtgaggagcgcacttttcccgggtcgcgtttccctccctcgcgaaagccgtgtgtgttctgcatgtctgattccgttgcgctgaatttggttaatatccgtcacttcggcgatcggcagttgctgcagggcatgacttccaagatgaacagcaagcggatttgtaggggtttctgctgtggttctgtaattggcaaggtttatgtgtaattgagtggcgagacgggggttaaagaactatatttggaatctgagggcttagtttggagtgaaggaaatccaagactcagtgatgtgatttcggaaaaagaagcagtgtggacgggaatcctagtgtttcccttacttctttttttaattttttctttaactgtcaaattctgacaggtcgagacggtgctcgagaagggactaaattgaataagacttgcttttattattaggtagaaaaaaaatgtctgagactgccggcagatattgagtgcaaagcttaatttagctgctgaattttatgaaaaggtgatatccaaagcctccttttttctcttttaagtaaaggattgcctttccctggtattctttccgtatatcgatggtgattaattgaattttcctaattaaaagacccttggatagagaaactagtctaaaccagttgcagaaaagggaacccccaaatcagaaggtgcgctgttctcttcttttggtcctgaaactgtttgggtatgtgaagattcagttgtatttcagaattcctggagctgacattgccaattttcgaataatctgatggtgggatgtcaaagtgtatatcttttatctaccctcaacttgcactttaaattccagccattctttgacaataatagagtagtgagaaaccaaaatatgtcagttgtctgtggaaataaaaaaggccatagatgtttaaaagttaaaccgtagaaacatttttaaaatgaacattttctacttaagctttccattaaataatagtttcatttaacgaatcaacttacctttgtgaagtgacatagcagataggtgttgtacagactgctttgaaagatgcagcccttatctggtgtccctacagtctaatatggataacattgatacgcaaacaaatgaagaaacattgtatgtaattattgtgcaaaacttttctaaatacattacctatgagtttggggttaactgcaaaagaaattccgtattcagatggattaggagagaatgtgactacctgaagggagaatttaatacatttactaggtcaagaagaaactgtcaattttaaggggagttgaaagtcagcagccactttataaataaatatatagttgatgatgaggcttctgagctaaataaaaatgcaatgtaaaggccttgaaaagctgaagtggaatgggtaggtggcataggtaaaatgttagagagaaggtaacattaacattgacagtggaattaaagacagtcaggggaagccgtctcatgagaatgaggtacagtagtctagggggaaaagtctagggccaggaacaaggatgtagctgaaggaatgaaaaggcagctacagatttggaataagtgataatagaggaaaataggttttgatgataacatgtatatttgaagtcagaagtaactcaggctttttcttgaaagttgttgatacagatattgtctactatgatggagaggaaagaaaactgatttttctcaagtctgtaactagtgggtttcattatcaacagcttaatttctgtggtcttgcctgatataccatatgatttgggggaaagaacttacaaaaatgaagctgtgctgtacaattttgtgtattctagaacttgaggttttgcagttttactatgtagaattattctttactgaactgaagtattgtgatttcatacttaagaaagttgagttgaactgtggtttttgtaaattattatttgtggctcttaaaaggtggagggtctcttttagaaaatctccttggcatgcttcgtaatactaattttaagtattttatctatatctattttacaaagatagtggaaagtgtgatctacccacacacacattttacaatatgttacttagtattttgtgaagtcatattgtcatttctaaagtttttaattgacgttgtgacattttttattacctgttgaaagatatttgttctttgaaacttttcatccattagatgttttcgttatcttcatttcagttgtaaatttggcaaatttagtacatagtctgttgagacttctcattaaataaattaattgtattaggtttatgaaagaataatggtagaaagggaaatatttagcagaagcatttttttgcttcattattttgaattattaagcacttgaaaatgagattatgataattaatgtaacatggatattctaattatacttttttttaaatcaggaaaatgagaacatatatgtatataaaataggctgtatgtggaaacattttatgttgaatattattgtccatctctaacaacaataactttgttcgaaactgtcttatgttgacttgacagaaatgaaagtcacatggtgtttggtgacctaaggtctagtttgaaatatttctgtgtctaattagttgtctacttgtattactatttatagaagagactagaggtaatatggtaatgagtaacatgaagcaaataaacaagtatctgctacttgaaaactagaaacaggatgtggtgcagatgtagaatttttttctaacagctttagtagtgattatacttgaagtcaatcttaccagttacatagcaggctcactatatctggaatatgtcactcttcacatacttttttctattttgaaagaagctgtttatcaaagcagcatactagttttacctgtaaaagctctacagaaacattactaggaaaataatgactacatgtatgtatagaatgtagaatcatatagattattccattggctactgaatatcgtattagttcgctacagctaatgtttgataccaaggtacttagctgaagatgataatccattacctaaattgtcactaataggggcatgaatgagaaaaaggtacaaatttttgggaaagggcatttttaaaaatcatatttttgctgtagtaatatacattttaattgcactaacctgttgatttgaaatcagtaagagatactggaacaaatataagactaggtactagagattagttaaaagactaattgtaaatgagaacatcaaaatattacagtaacaggtagggagtatttcagttattcataaatgaagtcattcaaagtattaaaaaaacaagcttgagccaagcagatgctactgtcataactctgcaattgtttaagcatttacttttttacattcttgaaacctgttctggtatattatgtgtcaatattattttctgaaaagcccatttattgataaggatatatacatattatatctgttttgagaatagatgtcattaagtaggcaaattactattaaatcctactaagtggaactgtatgttctgcctaacttagctgtttttttaatatgtgtttttaatattgatctatatgacttgaaaggaatcctatttcttgaaatagattgttattttgtgaattttttgttgaaagcaatgtattagagaattaaatgtttaggcaaagtaggaaaatgttaaattaatttctaatgaatatacttagtactattatcattggtcaaagacttgaaaaagtattagttgctatacaataagaattttaactatattaaaaacacatgtgacaatttgacttcaaagtgaatatacttaatactatcatcactggccaaggacttgaaaaagtattagttgctatacaataagagttttaaatacattaaaaacacatacaactatttgacttcaagcaggcatatagtggaaagtcaatagtatgtttttagggaggaagtgacgaataagagtctatttttaatcttgctagtgatagattcctggctaagttgaacagggtgtttttaaaaacaatcagtaaaatagataaaatctattactctgtttctgtaaataggattgaagaataatgaagcatatttggaatttgaaaggtattaaaaaaagatcctgaaaaagaaagtagtgaaaccacaaaggatttcttccttcacatctgggcagagaagataaataccaaggaagaagaaaagattgtttaacctacttaaaagtaattgggactgtagtcaatatgaatggcatctaatctcactttcattaaaaagtttttttgagtgacctctcaaaaaggaaatgtttaatgaagtattgctaggtagaagttctatccaggttctttaatgaatttataaactaaattgtttttaataaattaattttaactaagtagagcttcttgaaaattttgtgtttaaacaaccccaacaattttaacagtagctttgtcagtatttatacatttcgaaagagtgtaattaaatttaccatgctttaaaaagaattcttaatttgaaaaataaagcagcaaggaaatgaaatatgatgaaggaattgtcaccataatttggggcattcttctcaaactggagtacatgacattgtgtcaagggatacctataaggcttagaatctaagccacaggaacaaacataataattttttaagtaccaattttacttgatggtattaatttaaataactttaatattaagataagcataagtaaattaggcacaaagtatagaattcatatgaggctttaagatgaaattagaaacttcaaagaaatttcaagtgagcccattatatttcaagtgagctccagatctcgtcattcttctgcgttattgacacttcatggcaaaaaatttaaggagcactgaatcatagaaagaacactgtaagaactatgttctcatactattctggctagtaaagttttgtaaccttcagtatattgtgtaaccctctctcagcttttcttaccactaaaatgaagaaatcactctctaagatcacttcaaggctctcatggcagtatatgtttctatcttttagcattctgaccagcaggaaagagaaatataggatattagacctagttaatttttttctgtctttataatgggaatgattataggggagggtaggttatacataaaaatgcaagagaataagaaatagaataatgatcaaagaaggaaaatatttagattttttatttagaaatttttgtgacattaatctttctgttattagcaatcttacacttaggtttcagacacagctcaggactgactttgtcaataaaatatttcctaggaattattctcttcaatgatgtctttctttgttttccttacaacgtttataaatgttgtctataccctgtaatctatatgtgggaggctgcatggtgtagcttaaaaaggatagaactttggagtcagatagacttggacttcagaccctcatttgccctttattttgggaagtcatttcacctctctgaatttcagttttcttctccgaaatgaagatggcaatatctactttacaaagttttcagaactaatagaggtaacgcatatgaaaatgcctagcattttcagatgagatactcagttatttttggttccttcctctttgtatgttgctttgggagcaacttgccacagtttcgtgtatacatgtcttattcaaagtagattttaaagttcttgagatatatggttatgttctttacttcttttgtgcccttttgtcatagcatctgttaatgaagtaattggatagaaggtgtttaataaaaaaattgggtggtgtaaaatttatatagtaccttaagaaacatttaggtaaaccagaacttggctattattactaaaaggatagtttagggtagatggagtgaagttgattagtttttaaaaggtatgtttttctggtaataggatgatatttataacgatgtgtgtttgagatgttttatagcattaaattttgtatattgttttagttgggtgttgtttgtgtgaggataattttagactaatgaaatttgatatctaaaaactaaaaatttgaaattataggtaaaaaaattctgaaaatgctgttaatgttgattctggtgatcaaaataacactgttaggagtcaaaagttatgcctcttctcccactttcaagataagcacattttaccacagtttccttacctttaaatgggggtaagtgtgtttaccttgatgggttaatgtgagaaatgaaataatgtattcagtattcaacacctactatgtaccaaggccctgtgctaagtgaaggatacaatagtgattaagacagttcaatctttcttgtcttgaagcatatattctagcactactgtgaaaacattattcagtcaagttgaatattgacacattcatgcttcatttatgtttcaaggaataaggtgcttttatattttattttttaagtagataacaagtacaagcaccaaaactgtttttatgtcaagccatttttttgatacacatttttttttttttgagacggactcactctgtcgcccaggctggaatgcagtggtgcgatctcagcttgctgcaacctctgcctcccgggttcaagtgattctcctgcctcagcctcccgagtagctgggattacaggcgcctgccaccatgcctggctaattttttttttttttttgtatttttagtagagacagagttttaccatgttggccaggctggttttggactcctgacctcaagtgatctacctgccttagcctcccaaagtgctgggattacagatgtgagccaccgtgcctggccagcaattatatttctacattctattctgaatatctgttactgtgacatgatagtatgtttccataacgtatatgcttttcaggttttacccacttgcccttcctcttcctgccctgcccttctaatctactatatccttgggaaccacataaacttgctaagaattatttgtgatattacatccagttagatttgaagtgagggtctaaaggcacatattttcacttttgggttcagggcatcagaaaatgagtggatattactataataaatagctttatttctttgtatagtacttcacgatttcaggatcatggctaaatgtgtctgcctgatgctgtaaatgttaataaaaatccactctatgagtgaaagagattaagtgcaatttgaatgctaagtaaaaatgaaatgtttcttttaattatttcttgttcttttaaaaaacacattaatgtgcacttgaaattaataatctttaaagtctaattaatggttaagaactgttggatatcttataaataagaaactgagccaggcacaggggctcacgcctgtaatcccagcactttgggaggctgaggcgggcagatcacgaagtcaggagattgagaccatcctggccaacatggtgaaaccccacctctactaaaaatatgaaaattaggcaggcatggtggtgtgtgcctgtaatcccagctactcgggagtgaggcaggagaatcacttgaacccctgaggcagagattgtagtgagccaagactgtgccactgtactccagcctggccacacagtgagactccatctcaaaaaaaaaaaaaaaaaaaaaaaaaagaagaaactgaatagagtaaaaatactattttcagatgtaaaaagatgaaggaacatttacacggtggtgcccccctcttcactttcacctaagagtctatacagaacattttgattatagtctaaactttaaaaattatgctttcataaaattaacatccacattgtagaagttacgtttggattaaactgcaagtgggcactacccaaagcaatctacagattcaatgcagtcctatcaatgacattctataccaatgacattcttcacagaaatagggaaaaaaaagttaaaatttgtatggaaccataaaggacctggaatagccaaagcaatcctgaacaaaaaggacaaagctggagacatcatactatcagactttaaaatatactacagagtgatagtaaccaaaacagcatggtactggtgtaaaaacagacacatagaccaaaggaacagaatcgagaacccagaaattaatcctcatatctacagccaactgagttttgagaaaggtcccaggaacatttgctgatgaaaggacagtatcttcaagaaatgtttctgggaaaaaggatatccatatgcagaagaatgaaactagagccccacctcttattctgtacaaaaattaactcaaaatgaatcaaagacctacatgtaagacaggaaactatggaactgctagaagaaaacataggggaaatgtttcaggacattggtctgggaaaaaattttataaataagacctcaaaagcacaggcaaaaaaagcaaaaataaacaagtggattatagtaaactaaaaagcttttatacagcaaaggaaataaccaacagaatgaaaggcagcctatagaatgggagaaaatatttgcaaactgttcatctgacgggggattaatatctaggatatacaagaaactcaaacatcttaacagccaaataaataaataaataaataaataaataacccagaaaaaaacaaaacaaaaaaaaccctgcaaaaaatgcaatctgattaaaaaaagatgggatatttctcaaaagaagacatacaaatggccaaaaaatacattaaacaatgttcagcatcattaatcatcaggaaaatgcaaatcaaaaccacagtgaggtattctcttaccccagttaggatcactgttatcaaaaagacaaagaatgacaaatgctgccaaggatgtagagaaaagggacctcttatatactgttaataggaatgtaaacaagtacagccactatggagaacagtatagaggttctttaaaggactacagatagaactaccatatgatccatcaatttcaccactcggcacttacccaaagaaaaggaaatcagtatatggaagagacacgtgtaccatatttactgcagcactgttcacaatagctaagatatagactcaatctaggtgtccaacagcagattaatgggcaaagaaattatggtatatatgcataatggaatactgttcagccataaagaatgaaatcctatcattcatggcaacatggatggaactgaaggacattatattaagtgaaataagccaggaatggaaagttaaacactgcatgtcctcactattatgtggaaactaaaaaaagttggtttcatagaagtaaagtagaacagaggatactagagactgggaagaggcgggggaaggggatacagggagaaatgtgttataggatacaaaattacagctagattggagaaataaattctagtcttctgtagcattgtagggtgactatagttaacagtaatatatagtttcaaatagctagaaggaggatattgaatgttctcaacacaaagaaatgataaatgttcaagatgatggatatattaattatctaatctgatcaccatacattatatgtatggagacatcactatgtatctcataagtatgtataattattgtatgtcaatgtaaaatataaaagaaaattttaaaaattgcaaataagaaagctcctgaattcttatgtcattcttttaattagttaaatttattaaagtatatttatgtgttataaagaatgtaataatacagaaaggtaaaatgcgaaattaagcctcatcacattacttctctagtttctctctagtgttaaccacttaaaaaatctttttgtttattcttttgtatacagtcatatatttgatatatttgaatatgtgtatgtgtatcatacaatacatcagagcttgcaaattgatggaccactggccctaactaaccagtgtttcattagtcccctactgtattttagaaaaagtatttgtttctaacacttaaaaaaagatatttcatataaaatccatattttttttgcttcttaagattcagcaacacacaacatgtttctcacataatagttgtttagagttactgtctgcataagatagaacatgcgttcttcagtttcccacagtttctgtttaatacgtgttggctgcctgaccttgataggcatttgagattgtgattcttgctcatacatagtattttgcactttcttccttcactccctaactctgtagcatattttggacatcttttcatattagtgaaaataatagtggttaactttattgagagcctatgaagtgtaaaatactttctagagcctgttacagagcctattcatttaatcctcgtaataatatgttagtgttgtcaccattttacagctgaagaaattgtagcagagagagattaagtaacttgctcaagttagtgcagtaaatgaacaggctgcaaattgaatctatgtaatctgtccgtagagtgtaagctcttaactactacatgatactcctctttggcatgtcagaattatttcatagagatcttcaaagatgttcatatacatatttcactttaatgggtcttactgcattgtaggttatgctatatttaattagtccctaattgatggacatcgaggtttctgatttttcagagacagatgttgtagataataatattatacatttatcattacaagtttataagttttttataatgtaagattactatctgtagaattttggggtcaagggtatatgaacttaaaaattttaatagataatttactttccaataaggatgtattaattaatattcccaccttcattgggtattagctttttagctttacaagttcttttgaatatacttcttgagttacacaggatccttttattaggattctttattgcaaatgagagttactgagctcaaaattagcttaagtgaagagggaaacttacatagccatagattacagaggaggagctgacttaagggactcaaataatgtgatcgggaagaaatgtaatcatgaactcttactctccatttcagtgctctgttttctgagtatgttgcaggctgactttcttcttatagtcagaattgtgaggttatagaggaggggtagattgagaagttatagtaatagtttcatgtttccccttcccaattagtgagtccagaggaaatattttctttttttttttaaacttttattttagtttcaagggtacatgtgcaggtttgttatataggtaaactcatgtcagaggggttgttttacagattatttcatcacctagctactaagcctggtacccaatagttatttttcctgcttatccctcttcccaccccctaccctcaagcaggccccagtgtctgtcgttcccttctttgtgtccatgagttcttttagcccccacttataagtgagaacatctggtatttggttttctgttcctacattagtttgctgaggataatgacctccagctccatccatgttcccacaaaagacatgatctcattttttttatggctgcatagtattccatgatgtatgtatacaaaccacattttctttatccagtttgccattggtgggcatttaggttgattccatgtctttgctattatgaatagtgctacagtgaacattcatgtgtatgtgtctttatggtagaatgatttctatttctctgggtatatacccagtaatggaattgctgggttaaatggtggtcagaggaaattttttttttctcgtgacatttgtatataaacttccaggatgctcacctggcatgactcacatgtcaattttggagcccgtcattgtaaccaggaggttgaggcttgattggccaggtctgtatcacatatccatccttgggagtggggatactaaataggtaacctcaccagaatcacatagagagagtatcttagtgtgggctgctatagcaaaatacttagactgggtaatttataaataacagaaatttatttcttacagttctggaggccgggaagtcaaagatcaaggcactagcagatctggtctggtgagggcctgttcctcagggacaatgccttcttaactgtggctttctagctatgtccacatatgttggaagggcaagagggctccctcaagcctcttttatgagggcactaatcccatttatgagggtggaccccttgtgacctaatctcctccaaaggttctacttctttaagaccatcacagggtggggtgggatagggggtctggtttcaacattttggagggggacgcacacattcagaccacagcagagggaacaagggaagtctttaaaaggagaggagtttctgtcactaaaaggggaaaagtgtgctgagcaagcagacaactttttttttagagggtccctgaagtcttgatgcctttttgcttcattctttttttccctgagaatgtagttcattatatcagtcactgtttcttctttctcctgcttctgccatgaaaatgctcctctggcagatagtttcaaattggaattggaataagttagggtgtggcaatcaatggcttaaacctaggcccctgtgatgtgaagggtggttaatttgtatatcaggagaactcacaatgattgacctccactttttcatactctatataaaagagtggttctctaaagacattttagaatagtaatacacacataattgaaatattttacccattttttaaagagccctttatgttgctttattttgaatttatgatcacctatgggtcttagtctttttttctacaaatggtgcctcccagtgtttcctaaattttgttctagcaacacttgtccgggagatgttatagtatgtattatatgaaaatgcttttacatgatcaaataaatgtggaaagtgccatataatgcatccctccatttggagattcacagtatatgaaggcatattaaagatgtgagtaataattgtggaacctcttaacctgtatttagtctagtgcttccaaatttatttgaaaattaaacactttttcaagatacacctgagttctgttcaacacctttttaggaaatggtggtctttcccctgcagatgatctcttgaaaatctgtgtatgatttttatatgtattcttttactttttttgctgtaaaaataatggtttttctacaataatctttattgtgaaaattaattattttaccctggatttacctttaaaatatataatttttttttctaatcaccacctctttttttgtttgtccttttttttcctgttaaaatgttgactgaatatattcttatttgattctgaaaatctatgatagcaaagactagaaactgaccagtcttggttctgttaccactatgtggggaaagaacactggatgaaattctattttggattttttcagtgggagtttagtatcattatttgtaaaatggaaagttgagtagatgatctctaaaatccccttcagctctaaaattttattaatcctaaatctgaggaacatgcctcatgtttaccattccatcattgctgaaatctattagtgacggcaaaattattgatctaaagtgttttccttcaaacaggaaaaattactagaaaaagacacagacattcataacaagtgtaaatgaaaataaatgtctgttacttccactgcacaatatgtgcaattttatttcattcaatatcatgtgctacagaggttcaaattgctaaatatatagaccttagaaaaaattatatgaacttaagtgtaatgacagattcccacaatcaagcttagaagaataatagtgattaaggggtatttgaagtattactttttctttttaaatttaaaatgtattgctacactagagatctggaaaacaaaaaattagcactccctccaaaatagttattattttgctattgtaaatttaaaataaagctgttgtaaaataagacataatacctttgatgaacaatattatgttttaggttcacacagatactcagaatagtaggtgggctctggattagaccacctgggtttatacctaagtgaagtttttagagttacttctctaagctttagtttttttcatctgtcaaatggaaaataatactaatatgcctgccttagagggttgttgtggtaagtgagataatgaagtaaacctttaatgagtgtgcccacatactaaatattcatgaaatgtttgttgtgtattataatacatttgaatataattaccttaataaacagggcaacagaagcaacctgtacaacttttgggtatctgacctcaatcttggtgtatccccatgcccttttcccactattttatcttattttagcaacatcattaaggttcaatactgaactggggttctgcttgatctaaattcttgtcttccagcttaagttttgggcagttagagttagaagatgctatttgtagtgtagtaactaacagcaagaatttgagatttttgagatataggtttaaagtaaagtatgtatggaagactgcctctgatagtctctaaggcttgttaagacctgtggagaaaattcacatacatatatgtgggtactatggttatggaatactaagtgttctagttaaaaagttaaagtaccctagttaaaaaggtgtttttaaagtttgaaatattatgcaactggggcagtaatgcagggtggtaaagtgatagtaaaataaaatatttatatagatgattgttgatttgtagtagaggaactttaaattagtagatgaggaccttatatgtttgaggttaaataaacaatgatttggggcataagggaaataaatattatgtataaaagggaaaagatacttttagaactatcagatgctaaaagagaatctatcaaatttagagcattgccaaagataagttttggtagaaaagtttgggaatcattaatttagttttttaaaaaattattattatactttaagttctggggtacctgtgcagaacatgcaggtttgttacataggtatacacgtgccatggtggtttgctgtacccatcaacctgtcatctacattaggtatttctcctaatgctatccctcccgcagccccccacaccccgacaggccccagtgtatgatgttcccctccttgtgtccatgtgttctcattcttcaactcccacttatgagtgagaacatgtggtgtttggttttctgttctcgtgttagtttgctgagaatgatggtttccagcttcatcgatgtccctgcaaaggacctgaactcatcctttttttatggctgcatcatattctaccgtgtatatgtgccaacttctctttatccagtctatcattgatgggcatttgggttggttccaagtctttgctattgtgaacagtgccgcagtaaacatacctgtgcatgtgtctttacagtagaatgatttataatcctttgggtatatactcagtaataggattgctgggtcacgtggtatttctggttctagatccttgaggaatcaccacagtgtcttccctaatgattgaactaatttacactcccaagagtgtaaaagcgtgcctatttctctacatcctctccagcatctgttgtttcctgactttttaatgatcaccattctaactggcgtgagatggtatcacattgtggttttgatttgcatttctgtaatgaccagtgatgatgagctttttttcatatgtgtgttggctgcataaatgtcttcttttgagaagtgtctgttcatatccttcacccactttttggtggggttgtttttttcttgtaaatttgtttaagttctttgtagattctggatattagccctttgtcagatgagtagattgcaaaaactttctcccattctgtaggttgcctgttcactctgatggtagtttcttttgctgtgcagatgctctttagtttaattagatcccatttgtcaattttggcttttgttgccattgcttttggtgttttagacatgaagtctttgcccatgcctatgtcctgaatggtattgcctaggttttcttctagggtttttatggttttaggtcttacatttaagtatttaatctgtcttgagttaatttttgtgtaaggtgtaaggaaggggtccagtttcacttttatgcatatgggtagccagttttacgaacaccatttattaaatcctttccccatttcttgtttttgtcaggtttgtcaaaaataaaatggttgtagatgtgtgatgttatttctgaggcctctgttctgttccatcggtttatatatctgttttggtacctgtaccacgctggtttggttactgtagccttgtagtatagtttgaagtcagttagcatgatgcctccagctttgttctttttgcttaggattgtcttggctatgtgggctctttttggttccatatgaaatttaaagtagtttttttttttttaattctgtaaagaaagtcaatggtagcttgatgaggatagcattgaatctataaattactttgggcagcatggctcaccatactgattctccctatccattagcatggaatgtttttccatttcattgtgtcctctcttatttccttgagcagtggtttgtagttctccttaaagaggtccttcacatccgttgtaagttgtattcctaggtattttattctctttgtatcacttgtgaatgggagttcactcatgatttggttgtttgtctgttaatggtgtataggaatgtttgtgatttttgcacattgattttgtatcctgagagtttgctgaagttgcttatcagcttaaggagattttgggctgagacgatggggttttctaaatatacaatcatgttatctgcaaacagagacaatttgacttcctcttcctatttgaatacactttattgctttctcttgcctgattgccctggccagaactttcaatactatgttgaataggagtgtgagagagtgcatccttgtcttgtgctggttttcaaagggaatgcttctggtttttgcccattcagtatgatgttggctgtgggtttgtcataaatagctcttattattttgagatacattccatcaatacctagtttattagtttttagcatgaaggggtgttgaattttgtcgaaggccttttctgcatctactgagataatcatgtggtttttgtcattgcttcggttttgtggtagattacatttattgatttgtatatgttgaaccagcattgcatcccagggatgaagctgacttgatcatggtggaaaagctttctgatgtgctattggattcggtttgccaatattttatcgaggatttttgcactgatgttcatcagggatattggcctgaaattttctttttttgttgtgtctctgccaggttttggtatcaggatgatactgtcctcataaaatgagttagggaggattccctctttttctattgtttgcagtagttccaaaaggaatggtaccagctcctctttgtacttctggtagaattcagctgtgaatccttctggtcctggactttttttggttagtaggctattactgcctcaatttcagaacttgttactggtctattcaggaattccacttctttctggtttagacttgggaaagtgtatgtgtccaggaatttattagtttcttctagattttctagtttatttgcatagaggcgtttatagtattctctgatggtagtttgtatttctgtgggatcagtggtaatatcccctttatcccctatttgattcttctctcttttcttctttattagtctggctagtgttttatctattttgttgatcttttcaaaaaaaaaaaaacagctcctggattcattaatttttttgaggagattttcatgtctgtatctccttcagttctgcgctgaccttagttatttcgtgtcttctgctagcttttaaaattgtttgctctttcttctctagttcttttaattgtgatgttagggtatcgattttatatctttcctgctttctcttgtgggcctttggtgctataaattttgctctaaacaatgctttagctgtgtcccagagattctggtacgttgtgtctttgttctcattggtttcaaggaacttatttatttctgccttaatttcattatttacccagtagtcattcaggggcaggttgttcagtttccatgtagttgtgtggttttgagtgagtttcttaatcctgagttctaatttgattgcactgtggtctgaagactgtttgttatgatttccattcttttgcatttactgaggagtgttttacttccaattatatggtcaattttagagtaagtgtgatgtggtcctgagaagaatgtatattctgttggtttggggtggagagttctgaagatgtctattaggtctgcttggtccagagctgagttcaagtcctgaataaccttgttaattttctgtctcgttgatctgtctaatattgacagtggggtgttaaagtctcccactattattgtgtgggagtctaagtctctgtaggtctctatgaacttgcattatgaatctgggtgctccagtattgggtgcatatatatttaggatagttagctcttcttttgcattgatccctttaccattatgtaatgtccttctttgtctcttttgatctttgttggcttaaagtctgttttatcagaaactaggattgccacttctgctttttttgctttccatttgctgtgtaaatattccttcatccctttatttttagcctatgtgtgtctttgcatgtgagatgggtctcctgaatacagcacaccaatgggtcttgactctttatccaatgtggcagtctgtgtcttttaattggggcatttagcccatttacctttaaggtaaatattgttatgtgtgaatctgatcctgtcattatgatactagctggttattttgaccgttagttgatgcagcttcttcatagtgacgatggtttttacaatttggtgtgtttttgcagtggctggtactggttgttcctttccatgtttagtacttccttcaggagctcttgtaaggcaggcctcgtggtgacagaatctcagcatttgcgtgtctgtaaaggattttatttctccttcacttgtgaagcttagtttggctggatatgtggtaattctgggtttaaaattcttttctgtaagagtgtagactattggcccccactgtcttctggcttgtatgatttctgccgagagatctgctgttagtctgatggccttcctttgtggataacccgacctttctctctggctgccattaacattttttccttcatttcaacctcagtgaatctgtcgattatgtgtcttggggttgctcttctcaagtagtatctttgtggtgttctctgtatttcctgaatttgaatgttggcctgtcttgctaggttgaggaagttctcctggataatatcctgaagaatgttttccaactttgttccattctccccatcactttcatgtacaccaatcaaacgtaggtttggtctttgttaacatagtcccatatttcttggaggctttgtttgttccttttcatttttttttctaatcttgtcttcatgttttatttcattaagttgatgttcaatctctgatatcatttcttctgcttgatcaattcggctgttgatacttgtgtatgcttcacaaagttcttgtgctgtgtttttctgctccatcaggtcatttatgttcttctctaaactggttattctagttagcaatttgtctaaccttatttcaaggttcttagcttcttgcatttggttagaacatgctccttcagctcggaggagttcattactacccactttctgaagcctacttttgtcaattcattagactcattatccgtccagttttgttcccttgctggcgaggagttgtgatcctttggaggagaagagacgttctggtttttggaattttcagcatttttgtgctggtttctccctatctttgtggatttatctacctttgttctttgattttggtgacattcagaaggggtctgtgagtggacgtcctttttgttaatgttgatgctatccctttctgtttgttagttttccttctaacactcaggcctctctgctgaaggtctgctctagtttgctggaggtccactccagaccctctttgcataggtatcaccagtggaggctgcagaatggtaaagattgctacctgttccttcctctggaagcttcatcccagaggggcacctgccagatgccagccagagctctcctgtatgaggtgtctgtcgacccctgctgggaggcatgggggtcagggacccacttgaggccgtctgtcccttagcagagctcaagcactgtgctgggggatctgctcctgtcttcagagctggcaggcagggacgtttaagtctgctgaagctgtgctcacagccaccccttcccctaggtactctgtcccagggcgatggaggttttatctataagcccctgactggggctcccacctttttttcagagatgccctgcccagagtggaggattctagagaggcagtctggctacagcggcttggctgagctgcagagggttccgacgggttggaacttccctgggctttgtttacaccgtgaggggaaaactgcctactcaagcctcagtaatggtggacgtccctccttgcaccaagctggagtgtccctggtcaacttcagactgctgtgctggcagggagaatttcaagccagtcgatcttagcttgctgggctccttgggggtgggttcccctgagctagaccacttggctccctggcttaagccccctttccgggggagtgaatggctctgtcttgctggtgttccaggtaccactggggtatgaaaaaaaaacaaaacaaaaacctcctgcagctagctcgctgtctgtccaaacgaccactcagttttctgttgaaacccagggccctggtggcacaggcaccagagggaatctcctggtctatgggttgtgaagaccaagggagtgtacggtctactgagcctgagtgcacagttccttacagcacagtccctcagggcttcccttggctacggatgggaattccctgaccctttgtgcttcctgggtgaggcaatgccccaccctgcttctgctcgccctctgtgggctgcaaccactgtctaaccagtcccaatgagatgagccaggtacctcagttggaaacacacaaatcacctgccttctgcgttgatctcgctgggagctgcagatcgaagctgttcctattcggccatcttgccagcaactcagcccactgttttcttgtttgtttgttagattttttttttttttttttttgatacggagtctctctctgttccccagactggagtgcagtggtgctatctcagctcactgcagcctccgcctcccaggttcaagtaattctcttcccaaatagctgggattacaggcacctgccaccatacctggctgagttttgtacttttagtagagaaagggcttcgtcatgttggccaggctggtctttaattcctgacctcaggtgatccacccgccttagccccccaaagtgctgggattacaggcatgagacaccatgcttggccaaatttaggtttatactggacttggattttcaaattttcttttgcaggtgagtttgtgaagtgttaattttaaaaaattgccaggagtctgaggcaggagaatcacttgaacctgggaggcggaggttgcagtgagccaagatcacaccattgcactccagcctgggctacaagagttaaactccctctcaaaacaaacaaacaaaaaaattgtcaattatgcatcacaatgaaacattcatttctgatttttagcacaattcaggagtaggtcatataatacatgacaaactcaaagatgaataatgcagtcttcccaaatagtagaaacttttaagcagctgaatggtaatggatctaattttgttattttattgtttttctgtctatgagtgatatattggtctgaccatagcctgacttgttaacaaacaatacagctcaactcaatatgtagtgtatcatgtactttgcatggtgttaggctaaaactactaagtatttataatgttatgctttaagtatgattagttgattgtaaaatggttcacattttaaggtatttttatattgaaacccttgccaagtactgtatgacagggttttcaaaacttttttagtaaaagactagatagtgaatttttaggctttgtgagctgtatatgatttctctcacaactattcagctctgcccttgtagcatgaaagcagctgtagacagtgtataaatgaatgagcattatagtgtcccaccgaaattttagttataaaaagaaatggcaggccagaattggtctaagggctgtagtttgccaactcctactcaagacgtagcctgttgtaagggaaatataattccaagttacctgcatgtgaatcgaacttttatattagttaacatttgcattacaaaacatcacaaaatttagttacttgaaactacgatttagtatttttcacatttctgtgaactaatttggttctgcttccggtggcatttgttggggttctgatagagctgtgatatctggaggctcaactgggattgttggccagggctttggttctcctacatgtgggtctttctatatggctgattccttagcctcatggtgtgatagttgggttataagaagtattctaagagcaagcattgtgagacagaggaagcagaagatgccaggccaagggataggcctgaaactttcacagcatcacttctgccattattctgttggtcaaatagtcacaggctcagcccagagtctttgtgggaagagactacccaagggtgtaaatgctaggaagcatggttaattgaggatattcaaactatcctcagtatatcatgagattgttttggttgcaagtgacaactcaaattgaactagctttagtaaaagggaacaattattataagaatattggggtgtctgcctcacaaaacccaaacacaagattgggtcctaggaacattggacccagggttgaagattcccgaggactgtttctcatctttgctctaccctgtaagtagtcttcattttctcttatcacaaacttcccttctccactttgggaaaaacagtgtcaacacttccctaattatttacatattaccattttagccattcagaggactgactttatttttgcagtgtttctaaaatgtttgaggaagaatgctgattgtcctagatcagtcatctgtgatcagaggatagagcttaggttctacaaaccatgttggcaggaacaggatcagttaacatcaaagggatgctgagtgtgtagtcgccgaatagtcagtccacttgccttctccctagccatctatttgttaacaagttaataatttgttaattaataaatgtttttttccccattacaggcctaatttacttctttattcagctctctgcctatggctatttcattgttctactggtgtgtaagcaaaagtaagaactgaaattaattcagtatcttgaatatttattgtaatctcttcctgctttgagtagaggatggcagcttttagtatctgctatcttactttgccaccataaacatagaatagtatgtaaagatgatcttactctgttgccaccattgatttccaggtttgacttagctgatctggttggctgaatgggtatatccttcctttggaaagggaccacgtgcatacatgaaagcaagtagctaaaatacagaatgaaataaaagctgtaatagaagtacaagcaacatgccgtgggtgcacagaggaaggaacaattaattttgactgaatggctgtaggagggatggcattttaaggaaggtagtgtttcagtaaggcctggaagaatgaataacttatccttagaaaagaaagggaaggtaatctggctgtcaagtttctcatctgctgaaacggtggtaccagagtgtctaggctaaagtagatgaacttaaatataggtataggacattcaggataaatggcagcatgcagttgtctgattttagccatcttaaattggaattacaggagtgaacacagttttgttacagttacgccttaggtgactatctggtaatttgaaatttgagacttcagtttttaaaattaagcagtttatttcaaatactcagatttttggatataggaagaaatttaaggattatctatactaacacactctagtaggtaaagaaactaagacctagttagatgatttatttgagcttacgtatctaaatgactgagttggggctaaaatacctttctcctggtcttgggtatttttgaagaattatccagtgtatcctttattgtaagaagattttctccaagtatacatccatatgaattgcttgctgtagtagcaatttttaaatttgagatataacatgcatatagtaaaatgtacagatgttaattgtatagcatggtgagttttttatgtgtacaaactcttacaattaacactcagatcaagatgtagaacatctccagcactccagaagcctctccttcatggttttcacaggttaactaatatccacttctcctgtcactcccaagtaattattattctgatttttattatcatagattagtctttcctgttcttgcacttcatgtaaagggaatgacttctttcgtttattatggttatgacattcatccatgatgttggtataccttggttctttttattgctatgtagtgtttcattgaatgaatggatcattatttattcttctgttaatggacatttgaattgtttctaatttttgacttacaaagaaaacctgctatgaatattctcgtgtatttctttttatgaatatattgtttcatttttaagagtataattgttggatggttgtcttccaaagtggctgtaccattttacatccccaccagcaatgtaggagggtttgagtagttctacatttttgtcaatattgtgtattgtcagtctttttaatttcagtcattctggtcagtgtgcactggcttctccttttcatttcccaggcaaataatgatggtgatcaccttttaatattaatttttgacatattttaaagttattctgtctttgtcttatggatttataggaattccttatgtattctgaatatgagacctttgcatggcaaatttcttctcccagtctgaggctagtcatttcactctcttaatagtgtattataataaataaaagttttcaattctaatgaaccttaacttatcaagtttgctttttatggtttagttggtttgttaatgttttgtttaagaaatctttgcctattacaggatcatgaaaatattctccaaagttttctttttgaaattgtattactttcttttttactcaaagctctatgatgcatttcaaattatcttataatgaatgatgtgaggtaaaaaccaggaatttttaaaataaaacataggatattcaattgatttggccccattttttgaaaaaaaaattgcccttaaaccattggattatagaacacttttgatataaatcaggtgagtcttactagagtgtatatgctcttccactggtctatttatgtacaaatactaccctgtcttaattactgtagctctatactaaatcttggtatctggtggtataagttccttcaattttatttcttcttcaacatttttttttgtggtgggtatactctatcctttgtgtttccatatacatttagaatcatatttcagtgaaaacaaaactgttaatattatgattgggattgcattgaggctatagatcaatgtggggagaattggcatcttaacaatatagagtcttctagtccatgaacatggattatctatccatttacttgggtctttaagttctttcagcagtattttttggtttacaatgtagaggtttcgcatatcatttgttagcgttatggctagctattttaatgttttgaaagtgctattgtaaatggtattcgttatttaaatttcattttgaattgtttaatacatagaattacagttgtatttttatcttataagcagcaacccgctaaatttgcttatttttaatatttaatattttatagattttttgtatttcctatgcaaacaaccaaatcatctgagaatagtaactattttacttatttctttccagtctttataattgtttctttgttttcccttattgcaatggccaaggcttctagaacaatgtttaattgaaatagtctcactcctaaacttaggggaaaatgttcaatatttaccaattatgatgttagttgtaagttttataggtaacctttatcagattaaagaagttcttatctattcctagttttcttttcttttttgaaaaaaattttatagagagagggccttgctctgttgcccagactggccttgaactcctggctcaaatgatattcccacctcggcctcccaaagtgctgggattacaggtgtgagccactgcgcccagtctgatagttttctaaatcatgaataggtggtaaactttgtcaaattttttgcttttgttgagataaatcatatggttgtatccttaattctgtgatgtggtgaattacattgattgatttttaaatgttaaaccaactttatactcctaggataaacgttactttgtcataatgtattgtcccttttatgtaccattagattcaatttgttaatattctctttagaatttttacatctattcatgaaagatattggcctgtaatagtcctttattataatatttttgtcagattttgttatcaatgtttgttagccttgtaaaaagaattgggaagtctctctctgttttatttcaaagtgtttgtgatagattgatacgtttcatgtgtacttgaattgggaagtctctctcttttttattctctgaaagcatttgtgattgatagattcatacacttcatgtgtacttgaatgttgattctgcagtctttggtgttaatgttctttgtcagtaaggtcatattggttaatcaagttgttcaaatcttcaaatgactgatttcttttttcctgttctctcagttttgagagtagtgtcttaaaattataaactatgactgtagttttgttgacttttagttctttcagttttcccctcatgtagttggaagctcttactaggtgaattaaaacttggcattgttattttacggttgaaatgacctttttgtcattatgaaatgaccttctttatctctggtaatatttcttgccttcaagtctacttttaccttctattaatatagtcactctttcttttcatcaatacttccatggtatgattttttcttctttttagttcagccaatctatattcttgtatttacagtatatctcttggaaatgtcatatagtcaggtcatgtttgttttatctagtttgacaatctttgtgctttagttgtaataggtattctatttacatttaatgtggttactagtatagttgggcataaatcttttatcttactgtttcttttctatttgtcccatccatactttgggtgtttaaatttctttcctgcctgtattatttgtcaggttttctaaactccattttggctcattagcttttcagttatacattcttctgtggttattttttagttatcttagagattttaataaatcttgattttttttagtgtatcttaatgttttaccacttcccaaacaatgcaaaacttaggacagtttaactttgtttattccctcctgccctttgtgctatttttttcatattttatttcaatatatgatacaaaccacataatttttttgtaaacagttaatattcttttatatttatccacatgtgtaccctttctaatgctcataattcatttttacagttctttgctaccatccaggataattttcctttagcctgaaaaaattcctttaatatttcttgtagtgccagtctctttgaggcagattttctcagcttttgtctgaaatccctttattttgacttcttttttgaaggaaaaacttattggtacagaattctgggctggcatgtgttgctgttttgagacagggtctcgctctgttactgaggctggagtgcagtggtgtgatcatagctcactgcagcctctaactcctaggctcgagcgatcctcctaccttatcctctcaagtagctgggagtacaggtggcaccactgtgctcagctaaattttttgttttaggttttgtagagatggggtctcactatgttgaccaggctggtctcaaactcctggcctcaagctatcttcctgcctcagcctcccaaagtgttgggattacaggtgtgagccaccatgtccagcctgaatcttttattcttatagcacttcagatatgtaattcctttgtttttccttattgttgctcctttaaggagtgtgcgtttttttggctgcatttaagatttttatttttgtctttagttcattaatagtttgtatggtgcctaggcatgggtttctttgcatttatcatgtttggggtttgctgggttaatggttttttttttatcagccttggaaaaatttgtattttatatctttatattttgcttctaccccaatctctctctcctctaaactgtgttaggcgttttgactgtcccacatgtctcatgtggttattctgtcttttctctctgtggttcaattttgtattttttgttgagctattttttaaacttacaatttctctcctcttctgtgccaggttgaataacctatccaataagttttaatagcttattttctcagctctaggaagttttattatttttaaataggtttccttttttgttgattatctccatccttttataaattttattcattttttttccttccctttcattagcctatggataatggctattttaaagccattgtctcctaactccactatcagtgtcatctctagctttgcttttagtcttgattacaggtcattttttcttgttttttttttttcacatatattgtatgtgaaaaacatacaatatatgttttgaaatacaatatatgaaattaataaatttcacatttattatatgctgaaacttgtaataatttatgtagaggctgaaggtgatatcttccaccagagatgattcccctttttagttgttaggccaatttaattagagttttattagggtcagtctgcattgcagttttagtaagatttagtctatctctggtttgtctccattgacatactcagatttttgattgaaagactgtcagatttcttctccacagccctgaaagactgcaggagatctaattctgttctttagaggttttgagattagcccggtaatctcttggtttatttacagtgctttaaattcatgcaaatgtgggaggtctgtcatgtgttttttgcggtttgtcccctgtttctaggaaggctttttttctggtaagcactgtaatactgagggagatttcactctgcccttctagcacgtctcccagcctccttcattacttagaattcagcaaatgttcctttcaaccttgcatttggggctttctagttttcagactactgcatgaaaaagctcagctgctttctactttcttttttttttttttttttttttgagacagagtttcgctcttgttgcccaggctggagtgcaatggcgtgatctcggctcactgcaacctccgcctcccgggttcaagcgattctcctgcctcaggttcctgagtagctgggattacagccatgtgccactatggctggctaattttgtatttttggtagagacgggtgttggtcaggcttcgtgttggtcaggctggtttcgaactcctgacctcaggtgatctgctcacctcggcctcccaaagtgctgggattacaggtgtgagccaccacgcccagcctgctttctactttcaccagtggagtctttctgtctgggccaatctcagttctcagtctctgtccagaattttcaaatgctcccaggaaataaaataggagatggttatctgcacacctaggaagggctcttctctttctagaatttcagttcatctacttcttgttctttcataagcactctggtgtcttaaaaattggattgaaattcatctttttctagttgttgaagcattaaaataactgctgtccttaaagtttgaaacagcaaaatctatttgtttttctgattataaaagtaatacacaatgtattgtgtacttctgctaagttatgctgcataacaaatgacctctatttcagcagctcacaacaacaattgcttatttttgctcttgcttcatgttggctgaaggttggcagtggctctgctcgtgctccacatatcttctaattctgagatccaggctagagaacaacttctatttgggccatgctgttcttgtaacagagggaaaaaagaaaatgatttggcaggaatacacagtggctcttaaaacttctgcttggatgtttgtttatataccattggccaaagcaaaccagtggccaaggccaaagtcagtggagcagggatgttactcttatgggagtgctgtcagttacataggaacaggtgtggatgatgctccttttgaaggaaagtggagtgaataattacaaattgtgatagaatccaccacacatgctaattgaaaataaattaaatagagatgtataatgtttatagtagaattcttccttctgtcttccgtgataatcagtgatgatactttggtgtatgttcaggactgaaaccttcttattgtgctaacttgatggtttctttaaaaataatagtcttgacataaattatgaataagacttgtttttttagccatatactcagaagaacactagagttctccaactggctacgcttagttcttgctttgccaggtagtcccacgcttactataatgttcaatttagagttctaagtataaaatatttttacttatttatttatttttgtgacagagtcttgcactgttgtccaggctggagtgcagtggtgtgatctcggctcactgcagcctccacttcctgggttcaagtgatcctcacgcctcaacctcctgagtagctgggattacaggtgtgagccatggtgcctggctaatttttttttctttttttccttttctgagacggagtctcccactgtcacccagggtggagtgcagtggcacgatcttggctcactgcaacctctgcctcccgggttcaagtgattctcgtgcctcagcctcctgagtagctggaattacaggtgtgagccatcaagcctggctaatttttgtaattttaatagatacagggtttctccatgttggtcaggctggtcttgaattcctggcttcaagcgatccacccaccttggcctcccaaagtcctgggattgcaggtgtgagccgctgcacccagcctgaaatatctttaacacaagtttgggtctgatccatggcatgttagtgtcatcactttttcattctctgagagaaagataagaaaaatggaattctaagattttgtaaaggatatgtgtttttaagggagaaggtactagaaataataaaagtcaagaaccaaaagttcttaggtcaattattttgacctaaatatatttcacaatagaggttcaagtgggttaactagactccctgttagaacaaaaatacctatgaagaaggttaagtttatatagtcatttatttgtataaatatttttctattcagagcaattcttagtggttcagatttttatgaaggagatcgatctgcagagaaatgtgaaagtgattttgtacaaatggtgggatatggcaagattcagtatcatttggaagtttggacactgacaggctctgagcattggacactgagggagagggaggtacacgaggcctggtaaaatagtttaacttttagttttgcattaggttcatccttttggaggttagtatgccgatgaaaaacaaattcacagagcagcttggtgctgtcagtaccatggacagaatgatgtgaatgagacacatctggatttagattctgttccatttgtgtcattcatatgctttgtgatttgggcaacttaattaagtcttgtttatgacacagatgataattaacgtattgatcttagcatcttttaagtgttcctttgttccttgagtcatcactttctcttctgtccaacttaaattttatagtattttgttatctatgatttgcattctcaacttccttgcatataccctcagctttcttgtctcactctcacttaagtccagcttaaatccagccatttttaaactttaagttagtatctgttagtgtctaaattagcagctatatacgtcgagaggaaaatgcagaatcatgctgactagttttacttaaattcatggtcacaaatatcaagtatcaagtgagtccttaatactacctggcattcatattgtattttcctagattgtttattcttctattttcttagatgacttatttaatgttttctctcatcagaccttccaacatctcatcctcaatctctcagctgatgattttggttcctacctcactgagaaaattgaagccatcagaacagaacttgcatagactccttttactctgtctacccatctaccaccatctccatccatataacctatctttctacccattattctttacttttctataaccaatcccttcgtttgtgcattagaatctatttcctaatggcttcttagggacattgctccagcagttctccactctcactcctatgtcataaagttttttcatactgcatcactaccacatgaagacaaacctactgctacctctgtctttaaaccttcttttgtttgacactacttcccttaccagataacagttatttgctttccaattgcagcaaactccttgaaaggattatctgtgctcaatgactctaatttctttcttcctgtttccttttaaatccagtataattaggcttctgccattatcacttttgttagtccattctcgcattgctataaagaaatgcctgcgactaggtaatttataaagaaaagaggtttaattggctcacgattctgcaggccatacaggaagcatagtgactgaggcctcaggaaacttacaatcagggcggaaggcaaaaggaaaaaaggcacattttacatggccagagctggaggaagagagagagagtggggggagatggtacacacttttaaacaaccagatctccttacaactctgtcagtatacagtaccaaggggggttggtgctaaaattaattcatgagaactatacccctgtgatccaatcaccccctaccaggccccacccccagcattggggattacatttcaacatgagatttggatggggacacagatccaaaccatatcatcactgaattgaaactactcttgataaggtcaccaatgatcttcatattgctaaatctcaagttaatttctcaatagtcatcatttctcttgacttagcaacatttgatttagttgatcattccttcttatacatacttttttttcacatgacttctgggatgttatactttaaaaaaatcttctgcactcactttcttgatgatcgtgactgtaaataccaagtatgtgcttacaactcctaaatttatgtacctgtttaagaaactattcctgaattgtacacatatatacacctatgtctgtatctacttgacattactatttgggtgtcttagtgacttaattaatatattccaaatactgattccctgcctaacacttgctcttcctagagtatttgtcagttagtaaatgtctactctttttctagttggggctatccttgagacttctcttgctttctcccacagccaacttatcatcaaaatgacgatcaaaccatgaaaacatatcccagatgtgtcaattccccaccactttcactgccattaccctggttcaaaccaccattatctctcacctggattactatagtaacctcctatcttgtctctcagttacccttttacacatccttttgcagtcttttccaaacagcctgagtgatcccttcaaaaagtaagtgaaatattttactactttgctgaggactctccagtggctcttcatttcactcagtttaaaagccactggcctaaaagggcgtataggatctgaccacctgttagttttttctgtgttacctttctacttttattcttttctttagtctttccacttctattcttttctttagtctctccacttcagccacactgacctcattgctgttcctggtacatgcagatgggctttcaccttaggatttgtgcactgatgattctctctgcctagaatactctttcctcaggagtcacatgaccaaattccctcaaatgtcaccttctcaaacgactgtaattaaaattacagcctcttctccttttcacatacacccttcccctatatactcctaatcctctttgcctgttctgtttctttcctatagcatttattgctgtttaaggtaattcttaatttatgtattgtgttaacatttgtctttctcctcgtttgaataagtttcacttgttagaagggcaggattttcatctattaggtttgtttaccgatatatttcaagtacctagaatagtgccttgcacattgtaagtgcccaatgaatatttgttgaatgaaagaagaatgcaagcctttctttttttctttttttttttttaatttatttattttttattgatcattcttgggtgtttctcacagagggggatttggcagggtcacaggacaatagtggagggaaggtcagcagataaacaagtgaacaaaggtctctggttttcctaggcggaggaccctgtggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatatttcttagtacagaacaaaatgaaaagtctcctgtgtctacctcctactacacaaacacggcaaccatccgatttctcactcttttccccactttctactccacaaaaccgccattgtcatcatggcccgttctcaatgagctgccgggcacacctcccagacggggtggtggccgggcagaggggctcctcacttcccagtaggggcggccgggcagaggcgccccccacctcccggacggagcggctggccgggcggggggctgacccccccacctccctcccggacggggcggctggccgggcagaggggctcctcacttcccagtaggggcggccgggcagaggcgccccccacctcccagacggggcggctggccgggcagggggctgacccccccacctccctcccggacggggcgactggccaggcggggggctgacccccccacctccctcccggatggggcggctggccgggcagaggggctcctcactttccagtaggggtggctgggcagaggcgcccctcacctcccggacggggcggctggccgggcggggagctgacccccccacctccctcccggacggggcggctggccgggcggggggctgacccccccacctccctcccggacggggcggctggccgggcggggggctgacccccccacctccctcccggacagggtggctggccgggcagaggggctcctcacttcccagtaggggcggccgggcagaggcgcccctcacctcccggacggggtggctggccgggcggggggctgacccccccacctccctcccggacggggcagctggccgggcagaggggctcctcacttcccagtaggggcggctgggcggaggctcccctctcctcccggacggggtggctggccaggcggggggctgacccccccacctccctcctggacggggcggctggcctagcggtgggtgacctccacctccttcctggacggggtggctgccgggcggtgacgctcctcacttctcagacggggcggcttcgggggggaggggctcctcacttctcagacggggcggccgggcagagacgctcctcacctcccagacggggttgcggccgggtagaggtgctcctcacatcccagacggggcggcggggcagaggcgctccccacatctcagacgatgggcggccaggcagagacgctcctcacttcctagatgggatggcggccgggaagaggcgctcctcacttcctagatgggatggtggctgggaagaggtgctcctcactttctagatgggatggcggccgggcagagacgctcctcactttccagactgggcagccaggcagaggggctcctcacgtcccagatgatgggcggccaggcagagaggctcctcacttcccagacggggtggcggccgggcagaggctgcaatctcggcactttgggaggccaaggcaggcggctgggaggtggaggttgtagtgagccgagatcacgccactgcactccagcctgggcaacatcgagcactgagtgaaccagactccatctgcaatcccggcacctcgggaggccgaggctggccggatcactcacggttaggagctggagaccagcccgtccaacacagcgaaaccccgtctccaccaaaaaaatacgaaaaccagtcaggcgtggcggcgcgtgcctgcaatcgcaggcactcagcaagctgaggcaggagaatcaggcagggaggttgcagtgagccgagatggcagcagtacagtccagcttcagctcggtatcagagggagaccgtggaaagagagggagagggagaccgtggggagagggagagggggagggggagggggagggagagggccgcgtgtaacctttgtaacttcacttcagcctctgaatgcaagcctttcaagattgaatagatattaaatgtgataatgtacttgtatgggcctcaaacaatgactgacattttgtacatgttcagtaaatttgctctttttctttctctatttcttaattacttgggatatctggaagtgtacagagtgctgtagatttctagatagcttgttttattccagtgttcttggtggagcctttgtggctgaatccagcttttccctcatgcttctttttgccttcttcctctatccaacagaggtggtgggaagaattagaattaaagcaggaggaagggaaaagaaatcttagctttttgtagatgggtgaaaaattggttagacttcagcttttaatgatctttcagtttagtaggtctcatatttttcaccatatgttattttctgattcacagtttctggtatatagttgatgcttaacaaatttttggatgattgttttccatttgttttgtggaatcgatctttccaaacatagcaggtcttttctattgattaaaataagtaaaagagtctgaaaactagaggtttagttcagaatgctgagcaaaatctggtattgtcatatgacgcatgggccaaggggagaaaatatagttacacagtgaatcagaaatagacaagttttggcaaggacaaggtatttgaaaaagtatagccctttaggttttataaagctttttctgttgttgttttattcttataaaactcttttgttatgccagtattataatgggaagctgaggctcggtgtggtgatatatcctgtacaaggtcaaacagtaagtatcagttcgtcttaacagacaaatttcgtgttcattctggtaagacaaggaaacaggacaacaacaacaataacgaaacaatgttctgaggcatttatgctgggttcatgtactggtgtgcataccatacatcatatcctttctctgatcctgataacctttcacagggtgatggttatgatacttaaaaatgagataataaatataaaagtgccataaaacattgtgttgttggtattattattccatcataggatagcaagtaataatacaggcatactttgttttagttcacctcatggatattgcatttttcacaaattgaaggtttgtggcaaccttttatccagcagacttgttggtatcattttttttttaacaacgtgtactcacttcgtgtttctgtgtcatgtttttgtaattctcctagtatttcagcctttttcattatcatatctgttatggtgatctgtgatcagtgatttttgatgttactattgtaattttttttttttttttttttgagatggagtctcgctctgtcgcccagtctggagtgcaatggcacgatctcggctcactgcaacctcttcctcccaggttcaagagattcttctgcctcagcctcccatgtagctgggattacgggcgcccactaccatgcctggctaatttttgtatttttagtagagatggggtttcaccatgttggccaggctggtttcgaactcctgacctcagatgatccacctgcctcagcctcccaaagtgctgggattacaggcgtgagccattgcacccagcctactattgtaattgttttggggagccatgaactgtgtccatataatatggtgaacataatatgtgaattctgactcttccaccgacgagcagtttccccatctctctcgctgtctcctcaggcttccctattccctgagatacaaaatattccctgagtattgaaattaggccagataataatcctacagtggcctctaggtgttcaagatctagagatcctgatttaatgtgagacacatccctcagattaaatcaaaagctagaaatggttaagcttagtgaggaaggaatactaaaaactgagacaggtggaaaggtaggcctcttgtgccaaatagccaagttgtgaatacaaaggaaaaattattttaaaaaatagcagagaacatttattctgagagatttgtatattatacttctgaggatctaagagaaaataacaaattttcatatttcagttaaatttatggaaatacaaatggtagcatctgtattcctaccatttctgactttttacgtgctctcattttattggtttcactttttatactatatctctaaggataatgtatctaaatatatgtattatgtgttaatttatatataaataaaagttatcatatacttccatggtatgattatagagaaaaatttttacattagaatgtgtctaaagtttttttcttaacttttattttagttttggggtacatgtacagattcattatattggtaagttgtgtgtcacagggggttggtgaacagattattttgtcacctggaaaaattattgaaggaaatataaagtgctactccagtgaatacacaaatgataagaaagcaaaacagccatatcgctgatatgaagaaagtttgagtagcctggatagaagatcaaacaagccacaacattttgttaagccaaagcttaatccagagcaaggttctaactcttctcaattctgtgaaggtcaagagtggtatggaaattgcaggagaaacattgggagctggctagaggttgattcgtgaggtataagaaaagaagccatttccattacatgaaaatgcaaagtgaagcagaaagtgttgatgtgatacttgcagcaaattatatagaaaatctagttaagatcattgattaaggtggctacgaaactacagattttcaatatagatgaagcagccttatatattgaaagaagatgccatctagtgtcttcatagctagacaggaaaaaaaagcttcaaaggacatgctgagtctctcattaggggttaatggagctagtgactttaagttgaagccagtgcttatttcctattctgaaatcctgtgccattaaaaatgatgctaagtcattctgcctgtgctgtataaagggaacaacaaagcctgaatgatggcacatttgtttacggcatggtttactaaatattttaagcctattattgatacctactgctcagaaagaaagctttatttcaaagtattactacttattgataatgtacctagtcacccaagagctcagatagagatatacaaggagattaatgttttcatgcctgctaacccaacatccattttgcagcccatggatcaaggagtaatttcagctttcaattcatattaagaaatacattttgaaaggctatatagctaccatagatagtaattcctttgatggatctgagcaaagtaagtgaaaaaccttccggaaggaattcagcattcttgataccattcagaacaatcatgattcatgcgaggaggtcaaaatgtcaacattaacagtaatttggaagaagttgaatccacccatcaagacttcactgatggatgtggtggaaatagcaagagaactagaattagagatggagcctgaagatgtgactgaattgctgcagtctcatgataaaactggaatggatgaagagttgcttcttatggataagtaaagaaagtggtttcttgagatggaatctactcctggtgataatgctatagacattgttgaagtgacaacaaagggttttaattattacatgaacttagttgataaagcagtagcagggtttgagaggattgacagcaattttgaaagaagttcttctgtcagtaaaattctatcaaacagcattgcctgctacagataaatattttgtaaaaagaagagtcaactgatgcagcaacttcattgtggttttattttaagaaattgccacagccaccccaaccttcagcagccaccaccctgatcagtcagcagctatatacattgaggcaagactctccaccagcaaaaagattatgattcactgatggcttggaggatggttagcatttttttagcagtaaggtttttttttgttgttgttgtttttttttgagacggagtctcactctgtcgcccaggctggagtgcagtggcacgatctcggctcactgcaagctccacctcctgggttcacgccattctcttgcctcagcctcccgagtagctgggactacaggtgcccgccaccacgcctggctaattttttgtattttttagtagggatggagtttcaccgtgttagccaggatggtctcgatctcctgaccttgtgatccacccatctcggcctcccaaagtgctgggattacaggcgtgagccaccacgcccggccagcagtaaggtatttttaaattaaggtatgtgcattgtgtttttagatataatgcttttgcactcttaatagaatacagtattgtataaacaaacatttatatgcactggaaaagcagccagttggtctttaaaattcctttaccctgtctttcagtaacactactctttccttgtttatcactgatctttgtagccactcattctctacagaatttttcttcctctgtgtggtcttaaatatctgtgttttttgtagttcatccctggtccttagcccattttactctagatgtcattttgaggtaacctttcctatacttgatactgcctcctatatctaagtcttgagctagaaagtttgttgctcttcggatattcacattgtgttctccattcactttttgacttggttatcctctagacacctgtattagtccattcttgcacggctataaagaagttcttgggactgggtaattgataaagaaaagaggtttaattggctcagtgctccacaggctgtacaggaagcatagctggtgaggcttcaggaaaatttcagtcatggcggaagatgaaggggaagcaggcatgtcttacatggccagagcaggaggaagagaaagaaggaggaggtgctacacagttttaaacaaccagatctcgtgagaactcactaagtatcactagaacagcaagggggaatccatctccatgattcaatcacctcccaccaggccactcttccaacattggggattacaattctgcatgaaatttgggcagggatacaaatcaaaaccgtatcagcaccccttcatgccccaaagagaaaccaacctttatctttgaaaccttgtcactgaagctcccagcctggttaagagggacttctgattctataatctaaaaatcatgaagtcatcttagacacctccctttcatttttccccacatctacttactcattaatgtctggctccctagtatgcctggaaatctgtttactttcctggtttttattctgtataatcactatcatgagcaaaataagaacagtcccatctcatcagaaagttatttcatacctgacactttctacttcactgttcccatctcattttctaactcatcctgcttccagcttctaatttccaatgtaagaccttacaactaaataactgcatttactcactcccctagtgtgatttttaaatcacattttaaacttttatatacgttataagccctactttacagtgttttattttgctttaaacagttatttgatttttaagtgaattatgagaaaggaaacagtttttgtgtttaccaatttatttaccatttctgaagctcttttttcctttctgtaagtctacatatccatttgatagaatttgtctttggtctgaagaacactcttcagcatttcttacaatgtagattgactggcaagcattctctcagcttttgtttagctaaaaatgtctttattccaccctcatttctgaaggatatttattattgatgaatataaaattctaggtcgatagccttcaccccccaagtactttaaagatatcattttactgttttctgacttccagtgagaggctgggaataattcttatttctcccatacatgatgtctccctgcctccctttctttttgtcccttttctggctgctttcaagattttttcttacttttgtttttaatcaattgattaaaactgtattgattctaatgtatctcagtgtggttctctttatatttatcctgtttgggattggctaaacttctttttttttttcttttttcttttcttttcttttttctttttttagacaagagtttcgttgttgtttcccaggctggagtgcagtggcacgatcttggctcactgtaacctccgcctcccaggttcaagcgattccctgcctcagcctctcaagtagctgggattacaggtgcccgctaccatgcccggctaattttttctatttttattagagaaggggttttaccacattggccaggctggtctcgaacttttgacctcaggcaatctgcccgcctcggcctctcaaagtgctaggattataggcatgagctaccgcacctggccctaaacttcttaaaagttggtgtttttcatcatatttgagaactttctagtcactatttttaaaatattctgccccagtctcactcttttctcctctaggatcacagttacatatatttcaaacaatatgaaattgtcccaatggcctctgaagcttcatttatttctcttcagccttttatctctctgtcaggttagagaattttgattgattggtcttcaacttcacttttcctgccaacgtcaatatactgttaatcctctccaataatattttaattttaattattgtactttttttttttgagccagagtctcactctgtcaccaggctggagtgcagtggtgcgatctctgttcactgcaacttctgcctcccgggttcaagcaattctcctgcgtcagcctcctgagtagctgggactacaggcatgggccaccacgcccgcctaatttttgtagttttagtagagacggggtttcaccttgttggccaggatggtctccatctcttgacctcatgatcctcctgcctcggcttcccaaagtgctgggattacaggcatgagccaccacccccagcctcagttattgtactcttaagctctggaattttcatttagttcctctttatggtttccattttgttaatttctcagttaatctaaattattgatttttaacgtgatagtttctttgactctatcttctctttgtttaatttcatcaaaaatcctcttatttcatcttattatgaaatgattctagatacaatttaatataaattaacaatatttggctgcttatctgaaagtttatattttggaattttttttacttttctgaaccttctgtgggtttttatgcttgaaaatagcatggacttatttgtgccaggatgcatatgtgatcaagggcagagatagggatagaaataaaattaaggttaggttctatagaacaacagccagtgagacaagtaggactgtggcttcaataaagtcttaaattgagtataagtggcagtggattacattttgctcttatatttttgtattcgtccattctcacactgctataaaggatactacctgagactcggtaatttataaaggaaagagatttaattgactcacagttgcacatggctagggaggcctcaggaaacttataatcgtggcggaaggcaaaggggtagcaaggaccttcttcacatggtggcaggagagagtggaatgagagcacaggaaaaactatcatttataaaaccatcagatctcataagaattcattcgctatcacaagtacagcatggaggaaccaccctcataatccaatcacttcccaacagtttcctcccttaatacccggggattacaattcaagatgagacttggatacaaagctaaaccatatcagctgtcaattatatagtcagggaatcatagacttttagtacttgtacaaactttagaaatgatcctctaacaagctcattttcatactgataaaatgtgtgtgctaggatttcatacatgctgggttgaatgggtaggtgataggtacctccaatgtggactgttaggccaagaatgttacattatgaagggcattttaaattaggatgtgaagcaaatgcttgaagtagaagccttcatatattctagtacccaaagatactatgacagttgccatgaaggaaccttataaagctctcagccaatatatggcagataatattaatgtatagcttcagaatattggaactaaagtagattcataatttgcaggataaacaggtcaccagtttaaaaacagaaaaaaatccccacaaaaaaaacaaaagaagcgtaagtacttaacgtttattgtgtcacagaaatctgtagcagattctgaacatatggtaggttacatagatggtatattatgcatatggtatatatataacatacatatttacttatggacacatatttgcctaaattgcattaagttctataatattactgagtaataattttcctccttttctgtattgatacagcatctgtaaatgcttatcaataggcaaatgaagtgaatattttgcagatgtctacagtttatcactgtctccctcacatctatcacaatgtgtggcgtatggtaggtgcttaataaatatttgttgaatgagttaatgaatgtgtcctatgattgcccccccgcaacccacgctgccttttgaaagactcattgctttgaaagaatatgtagaaagatggatttcatttttatactgatggtactaccaaatacattatcattgtaaagttcagcgataagacaaaaaaagaaaaaaaatcctgtgaaatagaactgttatcccctaacctttaggtttgtcttagtgtttgggatttctcctgagtcatcttaggagaacactaacttatctgttagtgaacaagtaataactaaagcatttttatgtgatgggtaactaaagttttgagactttaaaaaaacccctactttaatggttttcatttattttggtaatcattttctaccttatattgtttattatttatgtgtttcatgtgcagtctttgcttagcaatggggatgtattctgagaaatacataatttggcgatttcatcattgtttgaacatcatagaatgtacttacacaaacctagatagtatagcctactacacacctaggctatatgttatagcctattgctcttagactacaaacctgtataaatgttactgtactgagtgctgtaggcagttgcaacacagtggtatttgtgtatctgaagattctaaatatagataagatacagtaaaaatatgatgttataatcttatgagaccaccatcatatatgtggtccatcattgaccaatatgtcattatgtggtacatgactgtatatgaatattattcaactagattgcatacttcttaagtataaagaccctcttttacacaattttttgccatatagcatagtattattcatgtagttgatggtcagtacatcataagatttaaaaggtggttgcagaacacaactattatccttgaaactctgttgatctttaagctttgactctaaagagatgtcgttaatggtttttccatccagttctctttctaagggaaacaacttctgtactcttggttcctgccaaagaggtatgcccaaaaaactaagggtatggaaatagaaacaactaggaatatccaaataatcctgctagatatttagttttaggtacacattctgatctataaaatgaaatgaaactatttatattcacatcagtgaattttgagaaatgagtgtaagtgatagagccaaaacttttggtcccataattatttatgcctgcatttaagaactagttttaaaaatatgtttatataattttatattaaatatatatcattgaattaattgaggatttacagaagtactttatattgacttatttcattataattttaaattggtgtttcttcatggcaactgttatagtatctttgggtcctagaatacacaaaggcttctacttcaagcatttgctacacatactaattaaaaaacaaaaacaaaaacaacctgataggctgagtgcagttgctcatgcctctaattcctgaactttgggagccaagacaggaggattgctgagcccaggagtttgagacctgcttggccaagatgacaagaccgtttctatacaaaaataaaactaaaaaataaaattagctgggcgtggtgacgtgtgcatgtagtcccagttactcaggaggctgaggctggaggatttctggagcccaggagtttgaggtggtagtaagctaagatatggccactgtactccagcctgggcaacaaagcatgaccctgtctgaaatagatagatagatagatacataggtaggtagatagatagatagatagatagatagatagatagatagatagatagaatgaatttaatgagcgctaagatataaaagagtattttcccaaattttgttgagaatataataataaaatgatggtttaatggaggggaacttataatttaagtgaaagaccagtcattatgaatttaagtgaacattcagtgagatactttgtacttacaagtagaatgcttatttgaattatctttagaaatcatatctttaagaatttgtcttcagttatattggcagaattctgatgattttaagaaatattcccttttaagggaaaataagttacttttttgcattaaatcataagttagaacatactacataattattaaaggtatatataactttttttctcagagccttcatgttttctcatgaataagaccaaagtgttaagttacaagaaaggtagttgagggctgtcacattatctgtatgttcccctctggattctgcttaaatgtggttaaacaaggctgccatcagaaatcaccttgacttttaaaagtgtgtctgatttcagaattatgcatggaatgaatttcttaaaagttatttattacttattatatgagttattaatacaatctagtagttgtagaattctaaattatgataaccttcttgcccttgattctcatttttgtttgagaatgtttctttgccctggctgcaatttataatatggtgctaattactattcacttgagacaacatttgatgtttttaagtatataattattattttaggagtagtttagtagctcctttgaaaagttacaaaaaccttctcaatgaaaatattttctctttaaaaacctgagaaaatgatttttttcctaaaacaaaactcctaaatcaaagtgggatgggtctccagttgaagagttggtagtctttaccacagtaggctagtaagcgtcagtgtataagatactgtataagcttatagcttcctgaggaactatagcatcatgatagtatatactcccagtcagaatttattttcaggaatgacataaataccttgttataactgatattttgtacaaagaatactgaaatacagtgaggaaaatacatagagaagacaacactgattactgaagatcaaaaatttttttatatgaaattctgtaatctgaacaaatgaagaggcaaggtgtcagaaagtgaaaaataatctgattttactatctgtatcttatataatgatattcatcaaacccctgtatatttttttatgtcataggcctccattcaataagtctttaatgtgctcttagtcttgatatgtaatcctactgttaaaggctttattacatgttttaagtcattcttactttactttttaattgcttatgtcatttaatatagagttcattctgtaaatgtaattaggtaatgctattcttactaagttaatcttgaattaacagcttttcttttttattattttattttattattattatactttaagttttagggtacctgtgcacaatgtgcaggttagttacatatgtatacatgtgccatgctggtgtgctgcacccattaacctgtcatttagcattaggtgtatctcctaatgctatccctcccccctcccccaaccccacaacagtccccagagtgtgttgttccccttcctgtgtccatgtgttctcattgttcaattcccacctatgagtgagaatatgtggtgtttggttttttgtccttgcgatagtttactgagaatgatgatttccaatttcatccatgtccctacaaaggacatgaactcatcattttttatggctgcatagtattccatggtgtatatattgccacattttcttaattcagtctatcattgttggacatttggcttggttccaagtctttgctattgtgaatagtaccgcaataaacatatgtgtgcatgtgtctttatagcagcatgatttatagtcctttgggtatatacccagtaatgggatggctgggtcaaatggtatttctatttctagatccctgaggaatcaccacactgacttccacaatggtggaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggtcagtgatgatgagcattttttcatgtgttttttggctgcataaatgtcttcttttgagaagtgtctgttcatgtcctacacccagtttttgatgtggttgtttgtttttttcttgtaaatttgtttgagttcattgaagattctggatattagccccttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacagttttaggtctaacatgtaagtctttaatccatcttgaattaatttttgtataaggtgtaaggaagggatccagtttcagctttctccatatggctagctagttttcccagcagcatttattaaatagggaatcctttccccattgcttgtttttgtcaggtttgtcaaagatcagatagttgtagatatgcggcgttatttctgagggctccgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttaatggggatggcattgaatctgtaaattaccttgggcagtttggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagccattgtgattgggagttcactcatgatttggctctctgtttgtctgttattggtgtataagaatgcttgtgattttttgcacattgattttgtgtcctgagactttgctgaagttgcttatcagcttaaggagattttgggctgagacaaaggggttttctagatatgcgatcatgtcatctgcaaacagggacaatttgacttcctcttttcctaattgaataccctttatttccttctcctgcctgattgttctggccagaacttccaacactatgttgaataggagtggtgagagagggcatccctatcttgtgccagttttcaaagggaatgcttccagtttttgcccattcggtatgatatcagctgtgggtttgtcatagatagctcttattattttgaaatacatcccatcattacctaatttattgagagtttttagtatgaaaggttgttgaattttgtcaaaggccttttctgcatctattgagataatcatgtggtttttgtctctggttctgtttatatgctggattacatttattgatttgcatatgttgaaccagccttgcatcccagggatgaagcccacttgatcatgatggataagctttttgatgtgctgctggattcggtttgccagtattttattgaggatttttgcatcaatgttcatcaaggatattggtctaaaatctcttttttggttgtgtctctgcccggctttggtatcaggatgatgctggcctcataaaatgaggtagggaggattccctctttttctattgattggaatagtttcagaaggaatggtaccagttcctccttgtacctctggtagaattcggctgaatccatctggtcctggactctttttggttgataagctattgattattgccacaatttcagagcctgttattggtctattctgtattctgtcgaatcctgaggtttcttgaatctgaggtagcatggactaaaattgccattttatttcctaacagttgcctcacagatttcattttacatataaggaaattggtgcccagatgttgaagaaatagggtacccaggtttacacaaatatttagctattggactgtaactagaatatagtttatcttatatctagttttaatctatatatgtgtattatttctagaattaggctgagtaaattgacattaatttaaaaaacaaaagttactatacttttagttttctattgttatacaaaattaccataaatgttgtgccttaagcaataaaaatttgttattatgtagttctgaagatcagaggtccaatacaggtctcagggctaaaatcaaggtgtcaatagggctgcatttctttctgggggctcgcagggagaatccagttccttgccatttccaccttctagaggctgcctgcataccttagctcatggcctcttttcttccttcttcaaagccaacaatgatgggttgagtccttctcacactgccatttgccctattctctttctttgaaaacaattgggaaagggtctctcttttaaggactcgtgatgagattgggccaacacagataatccaagataatctccacatctcaaaatccttagtattaattgtatttgctacatgaagggaagaaaaaatgtccttttttcctccctctactctcctaagttctgtctctggggtcctgtaaattagactgataagagacagattaagtttcagttagatgaataaattctgcggatctatttcagtgtgatgactctagtattgtatacttgaaaattattcagacagtaggtcttaaatgtacttaccacagaaaataagtttgtgaggtgatggatacattaattagcttgatttaatcatttttacaatatatacatatatcaaaacatcacattgtgcattataagtatatccaatttttatttgtcaattgtaccttaacaaaatttggggtgggggaaacagataagagaaaatgaaacaaatttattaacatgtggattgcttatacacaggagagtactcaatgattagtaactcaaagcgtttgttggaatttgggcttacgtatccttttaaccaaagaataattttgtagagggaagacaggacgaaggaaagggactttgagctactaagaacagcaaattgtaggataataaatatacgcgggaaatcaatggaagataagggatagtatggtttgctcagtagattcttctagtgctgtcttttggctgataaggttctggaattgtctttggtgataaagtatcaactaagaatcgaatagtcctgccctttctagtagagaggaggagggcagaggattttgtgtctgtgtgtgtgtgtgtttgtgtgtgtgtgtgcgcaaacttgccttttcttaattgacgttagctcaaaataatccttatgcgaaagtggcgtattttggggtggcatactctgaattccttgatgtgtaagatatattcacaggttctagagattaggacatcgacagctttcgtggggagatattctgcctacaaactatgcatttaaaattcattttctcctttaagggattttattggtataaatatataatctatgaagaacttatgaaataagttttaatgctctagacctctcaaataataacttttaattattagactaataaacgtagtttcttgaatgctagaaatatgattttcaaaaataatatggggtgtaacatctaatgtgactaacttttcacaatgtattaagatgtaatttaagcttcgtatcacatgtgtaggggttgctacatggtgggtttactatatatgtacctgattcttttttgataggtctactggtccaaaggcaagaatgaagagttctttctgtattatttttgaatactagatttcatcttaatgacttcactccttttccttttagctctctaaatttttcttgtggggctggttttatgctcatttgagcattcacatgttcattcagccagagcttaatttaggaccaatcctttctctaaaggaaatgtaagcaatcctaagctagtaactaagctggttgttatagtctcattttacattccaattctaatgtctttctttatttcttatgaccaaacctttttctagtagttcattttcagtatcccgtctgatttactaccatatctttgtgtagaaaaaactgctgctaaaacttaggcctcatggctggttttttatttttattttttttcttggccaacttaatcttgctaattctgattgcttgcatttccattcactggatgcttatcattctcttaagtgatggtaatttctagtctggcttttcttgcttactgacaaaaccttggttctgatattcagagtttaattcatagaccatagcaagtttttgtcttagtgttttgcattactattatggtaagtacacagtaagcgtttgatgaatacttgcatgtttcatttgaaacattcagagggcatgaacgtatatgactctctaatgatttctgaagttcccattcatcttcatacatctggggaattgatagctatctctatgtaaatgtgattccttattaaattatagggagattgggtttaaaaaaataactgtccttatctaccctggtggttcttagatttttggattttatggactagtaaaatgtatttaaaaatttggaggatgtacaaagaagtgtaactttttatatttctaaataagagcataataaaattaaactataatcagctctcaccatgatatcataaaggaacatttgaatatcaaaaaacttggaaagacaaagtcactgaataaaaaaattttataaattcaataaatttagctttatacaaaaactcaatatattatcttttacttttccatgtttacttagaatgactaaaacttgctttaaaaaatgggtcttgggtaatgctaatatagtcatcccttttatttaagtagggcctgagactttcctaaatcctaaaactagccaatgattgaaagcaaggagtaggaggtatttaaagtatagtcttttgcttaggatggtttcctttgaacacaaatccaacattttgatatatgtagcaaataacaatttatcatttctgcatcctttcttttccatttcttacaaaaatatcagtggttccaggtcactgtgaggtaggtatagtaagattttgtgtgtgtgcgtgtgcatgcatatgttcacgtgtttggtggtatgcataaaagtggttgtgtgtgcatgcatatttcagtgtgtcatacacaccctactatcaaataatattatcattaagcctcaattttaggtagccactatgaacctggatcttgggaatatggcctttactagtgttcttgtccttcttcctgttgtgatgctgggactagcatgtatttatgttcctccccaagaagtggagttacctctttgcccatgtttttctctcttagcttcagtgagtttccaccaagctatgatactgatgcacttcctcctaaaaataaaggattttgttgcttagaggacatgggccagatgggtcttggcagcatttctcacctagtttcaatgagatttcaccagtgccctcagatacaggtttgcaggttaaggattttgttttgtaggagagataggatagatggttctgagtggctttcaacactgactactattctcttttagccagcagtgagtagcttactcagaattgtcccctatctgtgtgtgtgtgtgtgtgttttgaggtggggtctcactctgttgcccaggccgcagcagtgtatggctggatcacagtttatggcagctttgacctcccaggctcaagtgattctctcatctcagcctcccgagtagccaggactacagacatgcaccaccacacccagctaattttataattttttggaagagacagggtctcgctttgttgcccaagctggtcttgaactcttgggctcaagtgatcctcctgccttggccccttaaagtactggaattataggtgtgagccaccgtgcctggcctttatatataatttgattacaaatttactgaccacatgtggttgttaggactaaaataatcaatgtaaaaggattatataaagtgataatgattattactgtcctaatcacagttattatggttccaatatttaaaaatcaagaaagcagtagcaaaggatattatgtaatatatgtgtgaactaacagatattaacttactttttgcaattttatctttgtcatttcaccacacttaacatgaataatctgatatttaaaataggtaagtatgtactggagacagagtttcagatttgaaaaattattttaagactttcaggaaaaagaaacaatataagagcaaaaccaaaagtaaaaagaaaattcttttttttttttgctttctatctattcattttaagatcttctgtttctttcttatactatcagtttatcaatcctaaatattcttcttaccttcatcaagagtgatgataattttagcacttactgaactcatcatttcatgtcatttttcaaaaagtctacttccatctccctactattaccttttatattactaggaatttagttaattcatcttattgccttggagaaccttaaacttaaagcatctttgatgtttgagtatctatagcctacttaaaaaaaacctaaaggaagaaatgccaccattttgctgtactctattcaggtgtttaacagccctaattgaatagatgtttcctttaatcaaataggcttactagaaacataaattctaggctctgagattttttgttttttttaattttgcagctgacatgagaggacagctgtgctgttttatgaaggaataaaataccgaggaattgtattgacagggtctgtaacacaaaggcagttggtaaatactttcttattgtctacattttttgtagtctgagttgtatgctttccctacaccatgttgacttactgtaagtgttttaaccccactagacttgaggctccttgagggacagaattttatcttcttcatctgttctttaattatacctagcactgggaggtaattacttaatttttgtttgttggtttgttttctgaactggaggaattgttttgcattttagtggcttaagagtgtttatttacacctaaatattttgcagaatagagcagagaacatcacagtttggggcaaatcactaggtttctcttggcaacacaaggctgttgacatttattaaggagcttgggacttatcagagagttagcttctttagagttctttggaactttggagtatagatttggctgtagatgctgactggaaattaaggtgaaaatgtaatacagtaaccaaaagacgtggcaggttaggttgtctttaaaacagtgtggttggcactatgttttaaaatggagctagcactgctcaggtaggcagggcgtatcaggaaattcatcaagagaaggaattaccatcttgcagcagaattctgtcatttaacatatttttggggcatggatggcatccagtccccagataaaggatgaataagaaaacagaagcaggtaccggagccaaatccatccctagaattttgagcatatagagttggagaaagtggagactccagagcaacagtagagcctagaggcattatcagtcttaggtctttttagcagcgtaggggactttggatggtggcgtagttttggcagcagtggctctaatgctaggccctacaagtagataaggctatttaatactgaattactttcatctgaagtcttccaggggcctgatcattctgtccagatgtggaacaagaaaatgatagatctaggattgttatgattctctttaaaattccctagggatttgtttggatctgggattgtaaagccatagagtacattgtgggttctcagtaaatcctttgagtgaatgaataaatgaaagcagccacttggatctcttatggccagtaatgcaacctggtttatttgtgaattatttccttagggaatgataatctcataacttcagcactcagatataaagtctacaggttaaattaccagtctgggttataggttttattggtattacttttgttgcttttgtttactgatatatgctccactcagtaactaattgtttaatacattttgttgtagaatattatgtttagtgtttaactttattttgtacctttgttaactaggtgtttttttgagtatattgtgggtatacttatgtaccaagtgctgcaagatctataaaaaaatataagatgtattccctgccattaacgagctcaagttagtgtagctaactcaaagaaaggtaggtaactatgccagtcagtaaatgaagagtacgatgagtgatagttaagaagaaaatgtttataagtgcacattcaaaactggatgatgtcagcctagtattttgaaaacattctcaaatattcaatttttaatgcactgttaaaaaataggaagtacttttatttcacattttaattagatgagaataactaatttatttttcattagtggtgttattagagcattaattttccaaaagaaaatttgtagaatgttaatgaagctacagtaggaaataaataaatgttctgtaaataatcattcaccatatttgatatttgattggtttagaacattaatacaaatgttcagaatattgttttgtgtttttggtaaaagcacattagtgttcttggttaggcctgcgtgccttgtttcctgttatggcattttaggccagattattagatctattttgatttaatggtaacagtgccatctactgagtcatcaacatgatataccgtctatatttccagaggaaaaaagaggagaaaatatatggttattcacttatttttgttttttattttatttttaaatttgattgctgctttattcagtctcagaagaaattttaatgaaaaagtatgagtaagcaggtgccttgattctaaaaatttccttggttggaaatagcaattgaactttaaatacattctctttctagtacattaaacagattgaattctatcaaaagcctacttgaactacttatagtatatctcactttatgcatcataatcccatgttttcctactttttatattctctattcctcaaacatatcttttctgcttcctagggcaaagcatttcaaatagattaaataataaataatatattgaatttttatattttcaactcagtgggataattaattatgaaaattattttgacagtccatcatttcttaagttcataagcatgtttataaatgtatgattagattttcccctgaaaagatgttttatagaaaagatatatttccaacaatgaggaatcttgagtaaaatgtattgtgttgtatactgtaactaaatataaatcatattcagcacatgaaatagtatatatttttatatttgtggttcttaattcattactactgagagattacctgtttaaatacttctgtttatagttacagaccttcactgatgaaagaactattctcccttaagaagttaccaaatctgtttttcatgcaaccttaaatcttttagtgttctagggactggattatatacaactgaaagggaaaactgtcactatcattgtgaagctgaattaaaatatagttaatattattttttgtagctcagcaactttttccatttgttaacagatacccttcctctttaacacacacaccattgtgctttctaaaaaaattaggccgaggcggtggctcatgcctgtaatcccagaactttgggaggcggaggcaggcagatcacttgaggtcaggagttcgagaccagcctggccaacatggtgaaaccccatctctactaaaaatataaaaatcagctgagcatggtggggggcccctgtaatcccagctactcaggaggctgaggcaagagaatcgcttgaacctgggaggcggaggttgcagtgagccaagatcatgccattgcacaccagcctaggtgacagagcaagactatctcaaaaaaaaaaaaattaaatttttgtttgacaaaattgtgtatatttatggtatacaacatgttttgttacatatatatatatagtggaatgtctaaatggagctaattaatgtatgcattacctcacatatttatttgttgtgaaaacagttaaatctgttagcaatttgaagtgtacaatatattgttattaactatagtcaccatgatatataatagatctcttgggcttattcttccttttagcagaaattttgtatctgatgaccaacacctcctcaatctcatcctccatccctagcccctgagaaccactattctattctctgcttctctgagtttcacttttttagatttcccatgagtgaaataatattctatttgtttttttgtgcttgttttatttcatttaacaacatggatgaatcttgaggatattatgttgtgaaggacaagatatatatattttttttaaggttgaatagtcttccaatgtatatgtatataccacattttctttatccattcacccattgatggacaattaggttgattccatatcttggctattgtgaataatgctgaaataaaacatgggagtgcagatatctatttgacatactgatttcatgtactttttttttttttttttttttgagatggagtttcgcttcgctctttttgcccaggcttgagtgcagtggtgcaatctctgctcactgcaatctctgcctcccgggttcaagcagttctgctgcttcagcctcccaggtagctgggattaccggtgcctaccaccacgcccagctaattttttgtatttttgggagggacagggtttcactatgttggccaggctggtcttgaactcctgatctcaggcgatccacctgcctcggcctcccaaagtgccgagattacaggcatgatcaccatgcctggcccaatttcatatacttttgatatatacccagaagtgggattattgactcaaagaattgttctatttttaattttttgaggaacccccttactgttttccattgtggctgtactaattcacattcccaccaacagtgtgaaaggatttcattttcttctcatcctcatttacacttattttccatctttttgataatagccattctaacaggtgtgaggtgatatcttattgtggttataatttgtatttccctgatgattagtgatgtggagcattttttcatatacctgttggccatttttatgtccttttttgagaaatgtctttttcaggtctttagcctgttttttaacctggttattttcttgctctttagtagtttgagttccttatatattctggatattaagctcatatcaaacgtatggggtgtattagtccgttttcacactgctataaagaaatacccaagactaggtaatttataaaggaaagaggtttaattgtctcacagttccacatggctagggaggcctcaggaaacttaacaatcatggcagaaggtaaaggggaagcaaagaccttcttcacgtggcaggagagcgaagagagggtgaagtgggaagagccccttagaaaaccatcaggccttatgagaactcactcactatcatgagaacagcatggggaaaactgccctcgtgatccagtcacctcctatcagatccctccattgacacatggggaattacaattcgaaatgagatttgggtggggacacagagccaaaccattatcatatggtttgcaataattttctctcattctgtaggctgtctcttcactctgttgatcatgtaccttgctgggcaaaagacttttagtttgctagaatcccatttgtctatttttgcttttgtttcctgtgcttttggggtcatattcaaaataccattccctactttgggaggctgagtcaggcgaatcacttgaggtcaggagtttgagaccagcctggccaacatggtgaaaccgcgtctctactaaaaatataaaaattagccaggcgtggtggcaggcacctctaatttcagctacttgggaggctgaggcaggagaatcgcttgaacctgggagtcggagcttacagtgagccgagatcgtgccactgcattctagtctgggcaacagagcaagactccgtctcaaaaatgaaaacaaaaaacaaacaaaataccattccctggaccaatgccaggaagcttttcccctaggatttctgccagtggtttcacagtttcaggttgtatatttgagtccttaagccattttgagttgatttgtatatgacgtgagataaaagtccagatttattctactgcatgtggattttcagttttcccaatatcatttgttgaagggactgttctttctccattgtgcattcttgacatctttgtcaaaaatcggttgacttatttctggtctctcttctattctatttgtctatgtgcctgtttttgtgccagtaccatgctgttttgattactgtaggcttgttggagattttcaaatcaggcaatatgatgcatctagctttgtgctttttgctcaagattgttttcctatttaaggtctttggtcgttccatgtgaattttaggatttttctaaatctgtgaaaaatgccattggaattttgacagtggttacgttgaatctgtagatcactttggatagtatggacattttaccagaatttttacaattcatgattactgggtatctctcaatttttctgtgtcttaaatttttttgtgtgcgtgtttcgtacttttcagtgtgcagatttttcaattccttggttaaatttattcctctgtgtgtgtgtgtgtgtgtgtgtgtatacgtctgtttttgtagctatggtaaatggtattgttttttgatttttttcagatattttgttgttagtgtatagaaatgctactgatatttgtacgtggttttggatcttaaaactttactgaatctttggttagttttaacttttttttttgtagagtttagggttttctatacataagatgctgtcagcaaccaaagacaatataacttcttcctttccaattttgatgttttcatttccttttttgcctaatttctctaacaaagacttccattaactacgttgaatagaagtcgtgagagtgggtatgcttgtctagttcctgatcagagaagaaaagctttcaactttctactgttgtgtatgatgttagctgcacacttttcatatatggtctttattgtgttgtggtgcatccttttataacgcattgttttattttccctttgccttcttctttgacacactggttattgaataacctgttgcttaatttccacatagttgtggtttcctaccacatttcatatcattgtggttggaaataataaatgataccatttggatcttcttaaatgtattgaaacttattttgtgggctaacatattacctattatggaatgtttggtgtgcacttgaaaagaatgtggattctgctgcttttggaaggaatattctgtgtatatctgtgaggtccaatttggtccatagtgctgtttgattctgttgtttcattattgattttctcactggatgttctctttattgctgaagctgggatatagatattttctactgttattgttttgctgtctatttctccatcagtcctggtagtatttgtttacatatttaggtggtctgatgttgggtgcatataaacttacaattgttatattttcttgatgaactgaccactttctaattatataataaccttttttttttttttttttctgagacggagtctcgctctgttgcccaggctggagcacagtggtgcgatcttggctcattgcaacctctgcctcttgggttcaagtgattctcctgcctcagccttctgagtagctgggactacaggcaggcgcctgccaccacgcacggctaatttttgtatttttggtagagacggggtttcaccatgttggccaggatggtctcgatatcttgaccttgtgatccacctgcattaccctcccaaagtgctgggattacaggcgtgagccaccatgcccagcctatataatgacttttttttttaatctcttgtgacttaaagtctactttattatgaatacagctactcctgccctcttttggtttccatttccctggggtaccttttgctatcctttcacattcaaccaatttgtgtccttatagacgaaatgaatctcttgtaggcagcatgtagttgagtcttgtttttaattttttttttaaatatccattcagccgctctgtcttttgattcaggaatcagtccatttacaatcaaggtatgtattgataggtaaagatatgctactactaactttgcattttctggtagtttgtagattctttgtttcttatattctggctggctttctttttgatttatttttctgtagtagtatgctttggctcctttctctttattctcttgtatctactacagggtttttctttgtggttactgtgaagcctgtataaaacatcttgtcactctaacagattatttttagctgataattgatttaactttaaccatttactaaaactatatgctaacttctcctttcccccacattttctgttattcatgtcacaatttacatcttttatatattgtgtatccattaacagattattgtatctatggttattttactgcttttcttataactttcatactgtagttaaaagtgatttatgtaccgccattatagtattagagtgttctctatttgagtatattcttagcttacagtgagttttatattttcatatgtttacatgttgctagttagcatcctttactttcaactagatttctctttagcatttcttgtaaggtaggtgtggtggataattttaggtgtcttattgactgcataaggaacatatagggaattggtaaagcattgttttggggcatatccatgaggatgttctagagaagatttgtttgtgtgtctgagtggactaagtgggcaaggtctgctgtcagtgtgggtaggcatcatcctatcgaccatgggctggtagagaacaaaaataagggaaagacaaattggtctctgtctctgtcccagatctgggatatactctcctgttcttgaacattagtactccaggctctctggcctttgtacttcaagagttacacccctcccctgtcctatgttttcaggctgttggacttaggagtcagccatgttaccagcatagagtctgtagcttgcagatgacctgttgtaggatttttcagcctccataattacatgagccaattgccttaataaatctcctctcatatgtctatatttatatctatctatatatacatcctattgattctgtctctgtagagaaccttgactaatacagtgagtctggtaattacgaactctcaaagcttctgtttgtctgagaagatctttatctctcctttattcctgaaggacagcttgctgagtatagtgttcttggttgacagattttttttccctctcactttcagcatttttcagtattctcacatgctctcctagcctgcgaggtttctgctgagaaatccactgatcatcttataatgtttccccttgtatgtggtaggcattttttctcttgcagcataaaaacatttatttttgtctttgccatttgagaatttaattttaatgtatcccaattattttgaattgtcagatggtttgtaaatataaatttctttagagtcatttagtagtacattattttgccagtttttacagactggctttgacagaagaagctctttaccagtcagcctgtccagtgtttctgagtgggcttgctactagaattcttgggaaggctggcttagtgcccatgtcagcagtttgtcaggcctggtgcctgagctcataggagcctgccgggtgcccagacacaaccaggttatgtctgctggagcaggcctggatcctgggtgcctgggggctgtcttggcatcagagtctaatcaagtgggcctgctaactggatttgtaggggcatggaacctgtgtctatggggggctggcctgtcactgggatctactggggtaggcctggtgtctgggtgtctgggatctactggagtggtcctagaggctgcatccgtgggatgggtctagagtctgaatccatgggaactggctggacactggggcaggcctggaactttaatctgcaggagtgggcctgggtttttgatctgtgggagacagactgaagcatgggtccacaggcgtggtcttgggagcctgggcctgttggagtgggcccagcactgggatctactaggcaggcctagatgttgggtctgctggaccctgcctggtgctagggttatcctggagcctggggcttcaggggccagtttggagcctgcagctgtggatgctggcctggtgccttgggttgtatgggccaggttggagtctcattctgtgggcatgggcctggatcctgcatctgtgctggctagcttggaggctggggccacaggagctggcctggtactggtcttgtggtactttttaaaggaagtgtaattcttttataacacaaatgtttggctcttttagctctttaaaaataaacctggatttttttttttcaagagggaaagagtatggcataatggaaggagaaagggactcagagtcagcccaatattaatcatgtctgagccacttattagtggaaagatcttcatcaatttactaatcctctctgtacttttttttttaaatcttggaaatgtgtataataatgccaataatatctctaataacaggggcttcaggattgcaatctgcttagaagagtaggaggctaacatacttatcttaaaaatttatggcaagcatattttctatgcacaatctaagtttatttgggggatttggtggggtaggaaattttggtggaagtaataggaagaaaataccttcacgtcaatcccttagtgctgccagcagaataatgtatttatgtaatcaagactattatgattaagagtagtatatttttagtgagtgctggctatcttctgtatttaattactgaaagagatgaactgtttcaaaatcctctttttctttctagaatgaattccaaccatttaaataattcataatttgaaataacattattcaatttgttcccctattctgatatttaagggtcatgaattgccatgttttccttttcttaaatcaatgtctgtgtcatttacttttactttccttttgataagcagttggacattgatgttataactgaaaaaaatagtctatagcagcgcatctgtaattttcatttcagtttaattgcctaggaatcttgttgactgacgattctgatttagtaggtctaaaggtgggacctgagattctgcatttctaactaactcccagatgctgctcttactagtctatagaccacacttaaaagtggcatgggacttgaaatagtgtaggttatcacaaaattttaaaggtggaaggaactgtacaaagttggtaattcttgggcatacagtgatttcagggtgaggacactaaaacttagagaatccaagggtcttgggataaggtcatgatagctaacagaaccataagaaattcaactcattctatagtttttgtgtgctttctaccacacaccagtgcttcttaagtttcagttatttacatatattatgtaagttcctagataaatctatacagtgaagctgaaatccctggaatgtgctatgttacaattattccttcttcaagtaactgaagacattattaaattatggcaagatttgtcaaccaaagtctcagtgatatctgtacacctacattaaaggaaaatgaatacatatgcaatctgctgtcagaattttaggaatcctgatctttactgttctgataagtctcttctaaaggtgttttagagactgatttttcaatttgattactaaataaagcaaaggaaagaactaaaggaattttgcatgaggagaggacgaatgagatttcactatggacagaattgtgactaaattttaccatatggcctacaatgtctctcccagtcaaggttatatataatgcctctgtactcttctatttcccagtatcatatctggaaccaagacacttggacaggaatcctattttagacagaggactgaaagtagtaaatgtaaatatttttaagacattgcatttgataaggaataaaggaagagtgaatctctgactcatttctcctcaaattattattttgttgtgatttatgaaaattaacaatctgaacaagagaaggaagttatgattaattttggaagattgtaaattgcataccagttttccaatgttagccatttttaatcaactcagtttttaaacaaaaatttataaatatggctgaaccgaagatatctatagagagcttcaacataagatttgatcaagcagaagaaaggatcagtaagctcacagactggttattagaaattacccagtcagaagaacaaaatgaaaaaagaatttaagagtgagaaagtctgtgagaattatggggcagtgaagcaaaccaatctttgcattataggagttccagaaggaacacagagagagaaaggagtagtgaatgtatttaaagaaataatgacagaaaacattcataaactagggacagatataaatgtccacacataggaagctcaaaggtctccagttatgttcagctgaaacaatgctacaataagacttagtaaaactctcagaagcgttaagacaaagagaggatcctgaaagcagcaagagaaaagaagcaaatctcatacgagagaactccattatggctatcattagatttttcaacagaaaccctgcaggtcagggatagagtgaaaaaaaaaaaaaaaaaaagcaaacaaaaatttcttgctcaaagaaagaaaaaaaaaaacaccaggaaccataaagttgtccctcagaaatgaaggagagataaggactttcccagacaaataagaactgaggaagttcactagacttgccttataagaaatgcaaaagggaattctttaagctgaaagaaaaggatggtaattggtaatatgaaaacatataaatgtaaaaaattcactggtgaaagtaagtatgtagtcagattcagaatgctgtatgtaaagctacaatggtggtgtgtaaatcaattatatctttagtaagaaggttaaatataaagtagttaaaataggtatatttacaataattaagtgatatacaatatataaaatgtaaattttgacatcagtaacaatatgttggtgggtaataaaattgtagaattcttgtgtgttattgaagttatcagcttaaaaatagcctgttacaaccgtaatatgttttatgtaagcctcatggtaaccacaaaagaaagagctacagtagatacataggagataagtaagaaatcaaagcataccacaacagagaatcattaaattacaaaggaagacaggtagagtggaagaaaggaacaaaaaatctgcaaagctaccagaaaacaatgaacaaaatggcagttgtatgtctttatctatcaaacaagtagtttaaatgtcaatggattaaattctcccatcaaaagatacagagcagctgaatggattaaaaaaaaaaaagtccaaactatatgctgttaataagagactcatttcatctttaaggacacaaatagactgaaagtgaagaaatgggaaaagatagtctatgaaaatggaaacgaaaagagagcagaggttgttatacttagatgaaatagacattaaataaaaaattgtgagaagaggcacagaagattattatataatgataaaagtgttggttaatcaagaagatacagcaattgtaaacagatatgcacccaatatcagaacacctaaatacataaagcaaatattaatagatctgaagggagagacaagactgcaagacaataatagtataggacttcaatatttcacattcatcaataaacacatcatcgacttagaaaatcaatatggaatttgatttataatttgatatgtggacttcaatcacacagtaaagcaactgtacctaacaaacgtatatcagaatagttcatccaacaacattggaacacacatccttcttaagcatatgctaaacattctccagggtataccacgttagtctagaaaacaaatcgtaacacatttaagaggatttaagtgatatcaagtatcttttttaaccacagtggtatgaaattataaatcattaataggaagaatttcaaaaaattgcaaatatatggaaattaaacaacatgcttctcaataatcagtgggtcaaagaagaaatttaaaggacaataaaacaataccttgacactaatgaaagtggacactcaacatatcaatttgtataggatgcagcaaatcataagagagaagtttatagcaacagatgcctacacataaaagaagaaaaatctcaatctagtgttacacttcaaggaactagaaaaataacacactaagcccatagttagttgaatgaatgaaatattaaaaatcagagcagaaataaatgaagtagaaattataaaagcaatagaagagatcaacaaagctaagagttgtttttttaaaagataaaattgacaaacctttagctagactgaaaaaatagtgaagagttaaagaaaatcagaaatgaaagaggagacattacatcttatatcactggaatatgaaggatcataagagacaactatgagcaatcatatgccaacaaattagataacctaaattcctggaaacatacatcttatcaagactgaatcatgaagaagttgaaaatctgtataaactactaattaaggaagttgaatcagcagtcatagactgcccaaaaaacaacccaggacctgatgcctttactggtgaattctaccaaatatttaaagaataaacaccagtgtttctcaagctctctcaaaaaattgaaaattgatgagagaaaacttcaaactcattttaagaggccatcattaccatgataccgaagtcaaagacactacaagaaaaaaaaatgcaggccaatattgttgatgaagatagatgcagaaattctcaatgaaatactagcaaaccaatacatgaaaaacatcatacaccatgatcaagcaggatttattcctgggatgcatttatgtctgtggttcaacatttacaagttgataaatgtcatacattaatagaataaattacaaaaaccatgtgattatctcaataaatgcagaaaaagcattagagaaactttaacattttttatgataaaaacccgcagcaagttaggtatagagggaatgtacctgaacacaataaaggtcatatatgataggcccaaaattaacgtcatactcaacagtaggaaggtgaagatgtaaaaaaaaaaaaaagatgtaaattactacatgaaatcataaaatattattgggtgatggaataacagtgtagagttactttatgcaatcaaaccaaagttatcagcttaaaatagtctaactgtaagatgtttcatgtaaacctcttgatcactataacgaaaaactatgctagatacacttaagataaaaagtgggaatcagagcatagcactagagaaaatcctctaaccataaaggaagacagcaagaaaggaagaaagaattacaaaacaaccggaaaacaatgaacaatatagcaatagtaaatccttacctataaataattaccttgaatattaatagattaaattcttcaaagaaaagatagtgactgaatcaatcagaaaataagacccaagtatgttctgcctataagagaatcactctcacctttaagggcacatacagattgaatgtgacaggatagaagtagataatccatgctgatggaaaccaaaagaaagcaggagtagctatacttatatcagatgaaatagaatttaaataaaaattataaaaagagacacagaaaaggtcatataatgtaaaggggtcaatttatgaagaagatataacaattgtaaatatatctgcacccaacatcagagtacctaaatatataaagtaaatgttaataaatctgaagaatgagatagactgcaatatagtgtagtagactttagtatgcctctttaaataatgaacagatcatccagacaaaaaatgatatagaacttgaactacatcttagaccaaatgtaacagacgtatatagagcatttcagccttctatccaacagtagcagaatccacatttttctcgagcattttggaaacttccccaggatagatcgtaagtcagaccagaaaataaatctcaacaaatttaagaagattgaaattatgccaaatatcatctccagtcacaatggtatgaaaatagaattcataacagaaggaatattgcaacatttataaatttgcacaaacttacttggccctaaacaaccaagagtaaaactgaaatgggaaattaaagggaaattaaaaatatcttgagacaaatgaaaatactacataacaaaaattatgggatgcaacaaaagcattttattttattttattttattttactttaagttttagggtacatgtgcacaatgtgcaggtttgtgacatatgtatacatgtgccatgttggtgtgctgcacccattaactcatcatttagcattaggtatatctcctaatgctatccctcccctctccccccaccccacaacagtccccagtgtgtgatgttccccttcctgtgtctatgtgttctcattgttcaattcccacctatgagtgagaacatgcagtgtttggttttttgtccttgcgatagtttgctgagaatgatggtttccagcttcatccatgtccctacaaaggacatgaactcatcattttttatggcagcatggtattccatggtgtatatgtgccacattttcttaatccagtctatcattgttggatatttgggttggttccaagtctttgctattgtgaatagtgccgcaataaacatacatgtgcatgtgtctttatagcagcatgatttataatcctttgggtatatacccagtaacgggatggctgggtcaaatggtatttctagttctaaatccctgaggaatcgccacactgacttccacaatggtggaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattctttgcccactttttgatgtggttgtttgtttttttcttgtaaatttgtttgagttcattgaagattctggatattaaccctttgtcagataagcaggttgcaaaaattttctcccaatctgtaggttgcctgttcactctgatggtagtttcttttgctgtgcagaagctctttagtttaattagatcccatttgtcaattttggcttttgttgccattgcttttggtgttttagacatgaagtccttgcccatgtctgtgtcctgaatggtaatgcctaggtttttttctagggtttttacggttttaggtctaacatgtaagtctttaatccatcttgaattaatttttgtataaggtgtaaggaagggatccagtttcagctttctccatatggctagccagttttcccagcagcatttattaaatagggaatcctttccccattgcttgtttttgtcaggtttgtcaaagatcagatagttgtagatatgcggcattatttctgagggctgtgttctgttccagtggtctatatctctgttttggtaccagtaccatgctgttttggttactgtgtccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatactgattcttcctacccatgagcatggaatgttcttccatttgtttgtaacctcttttatttcattgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgattttttgcacattgagtttgtatcctgagactttgctgaagttgcttatcagcttaaggagattttgggctgagacgatggggttttctagttatacaatcttgtcatctgcaaacagggacaatttgacttcctcttttcctaattgaataccctttatttccttctcctgcctgattgttctggccagaacttccaacactatgttgaataggagtggtgagagagggcatccctgtcttgtgccagttttcaaagggaatgcttccagtttctgtccattcagtataatattggctgtgggtttgtcatagatagctcttattattttgagatatgtcccatcaatatctaatttattgagagtttttagcatgaagggttgttgaattttgtggaaggccttttctgcatctattgagatgatcatgtggttttcgtctttggttttgtttatatgctggattacatttattgattttcgtatgttgagccagccttgcatccccgggatgaagcccacttgatcatggtggataagctttttgatgtgctgctggattcggtttgccagtattttattgaggatttttgcatcaatgttcatcaaggatattggtctgaaattctcttttttggttgtgtctctgcccggctttggtatcaggatgatgctggcctcttaaaatgaggtagggaggattccctctttttctattgattggaatagtttcagaaggaatggtaccagttcctccttgtacctctggtggaatttggctgtgaatccatctggtcctggactttttttggttggtaagctattaattattgcctcagtttcagagcctgttattggtctattcagagattcaacttcttcttgatttagtcttgggagggtgtatgtgtccaggaatttatccatttcttctagattttctagtttatttgtgtagaggtgtttatagtattctctgatggtagtttgtatttctgtgggatcggtgatgatatcccctttgttattttttgtcacgtctatttgattcttctctcttttcttctttattagtcttgctagcggtctatcaattttgttgatcttttcaaaaaaccagctcctggattcattgattttttgaagcgttttttgtgtctctatttccttcagttctgctctgatcttatttatttcttgcattctgctagcgtttgaatgtgtttgctcttgcttctctaggtcttttaattgtgatgttagggtgtcaattttagatctttcctgctttctcttgtgggcatttagtgctataaatttccctctacacactgctttaaatgtgtcccagagattctggtatgttttgtctttgttctcgttggtttcaaagaacatctttatttctgcctccatttcgttatgtacccagtagtcattcaggagcaggttgttcagtttccatgtagttgagcagttttgagtgaggttcttaatcctgagttctagtttgattgcactgtggtctgagagacagtttgttataatttctgttcttttacatttgctgaggagtgctttacttccaactatgtggtcaattttggaataggtgtggtgtggtgctgagaagaatatatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggattctaagtctctttgtaggtcactaagaacttgctttatgaatctgggtgctcctgtattgggtgcatatatatttagggtagttagctcttcttgttgaattgatccctttaccattatgtaatggccttctttgtctcttttgctctttgttggtttaaagtctgttttatcagagactaggattgcaaccccttcctttttttgttttccattggtttggtagatcttcctccatccctttattttgagcctatgtgtgtctgcatgtgagatggatttcctgaatacagcacactgatgggtcttgactctgtatccagtttaccagtctgtgtcttttaattggagcatttagcccatttacatttaaggttagtattgttatgtgtgaatttgatcctgtcattatgatgttagctggttattttgctcgttagttgatgcagtttcttcctagccttgatggtctttacagtttggcatgtgtttgcagtgggtggtaccagttgttcctttccatatttagtgcttccttcaggagctcttgtagggcaggcttggtggtgacaacatatctcagcatttgcttatctgtaaaggattttatttctccttcacttatgaagcttagtttggctggatatgaaattctgggttgaaaattcttttctttaagaatattgaatattggcccccactctcttctggcttgtagagtttctgcaacgaaagcatttctaagagaagtttatagcaataaacacacagatcaaaaataagaaagatcccactaaaacagtctaatgctgaacctcaaaggactagaaaaaacaacaatataaatccctagtttatagtagcaaagaaaaaaacaaaggtcagaacagaaataagtgaaatagagactgtaaaacaataggaaagatgaacaaaacagaattgattttttcagaagataaacagttgacaaacttttaactaagaaaaatgacagaagactgaaatatataaaataaaaaatgaaagagtaggcaatacaggagataccacagaaatacagatgacaagagactactgtgaacagttatacacaaacaaattacataacctaaaacacatggatgagatcctggaaatgtacaactaccaagaatgaatcatgaagaaatagaaaagctttacataataacaagtaaggagattaagtcaataataaaaaatagctcttatgtgaaaaagttcaggacttgatggtttcacatctgaactttacaaacatttaaagaagaagtaataccaatgcttctgaaattcttccaaaaaattgaggagtagataaatctttcaaactattttaagaggcctgtatgaccctgataccatagacaaacaagtatattataagaaaaaattaccagccaatattcctgataaacagatgcagatattctcaataaaatactagcaaattaaattcagtaacacattataaggatctgttgtcatgatcaagttggatttatttctgggatgcaagtttggttcaacttatgcaaatcagtggaggtcatacactacattaacaaaaagaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcattcgagctctgctaagggatggactgcctcctcaagtgggtccctgaccctcatgcctcctgactgggagacacctcccagcaagggttgacagacacctcatacaggagagctccgggtggcatctgccaggtgcccctctgggacgaagcttccagaggaaggaacaggtagcaatctttgctgttctgcagcctccgctggtgatacctaggcaaacagggtctggagtggacctccagcaaactagagcagaccttcagcagaggggcctgactgttagaaggaaaactaatgaacagaaaggaatagcatcaacatcaacaaaaaggatgtccaccaagagaccccatcctaaggtcaccaacatcaaagaacaaagatagagaaatccacgaagttgaggaggaaccagcacaaaagactgaaaattccaaaaaccagaatgcctcttctcctccaaagtatcacaactccttgccagcaagggaacaaaactggaatgagaattagtttgatgaattgacaaaattaggcttcagaaggtgggtaataacaaacttctctgagctaaaagagctgttctaacccaatgcaagaagctaagaaccttgaaaaaaagttagatgaattgctaactagagtaaccagtttagagaagaacataagtgaccttatggagctgaaaaacagcacaacaactttgtgaagcatacacaagtatcaataggcgaatcgatcaagcggaagaaatgatatcagagattgaagatcaacttaatgaaataaagtgtgaagacaagattagagaaaaaagaatgaaaaggaaacaagcctccaagaaatatgggactatgtgaaaagaccaaacctatgtttgattggtgtacctgaaagtgacagggagaatggaaccacactggaaatcactcttcaggatattatccaggagaactttcccaacctagcaagacaggccaacattcaaattcagggaatacagagaacaccacaaagatactactagagaagagcaaccccaagacacataatcgtcagattcatcaaggttgaaatgaaggagaaaatgttaagggcagccagagagaaaggtcaggttacccacaaagggaaggccatcagactaacagtggatctctcagtagaaatcctacaagccagaagagagtgggggccaatattcaaccttctgaaaaaaaagaagtttcaacccagaattgcatatccagccaaattaagcttcataagcaaaggagaaataaaatcctttacagacaagcaaatgctgagagattttgtcaccaccaggccttcctcacaagagctcctgatggaagcactaaatatgggaagaaaaaaccggtaccagccactgcaaaaacataccaaattgtaaagtctttcgacactatgaagaaaccgcatcagctaatgggcaaaataaccagctagcatcataatgacaggatcaaattcacacataatatttatataaccttaaatgtaaacaggctaaatgccccaattaaaatacacagactggtaaattggataaagagtcaggacccattgatgtgctgtatttaggagactgatctcaatcctagtctctgaaaaaacagactttaaaccaacaaagataaaaaaaaaagacaaagaagggctttttacatttttacaaagaagggctttaccattacataatggtaaagggatcaatgcaacaagagctaactatcctaaatacatatgcacccaatacaggagcacccagattcataaagcaagttcttagagacctacaaagagacttagactcccacacaataatagtgggagactttaacaccccactgtcaatattagacagctcaatgagacagaaaattaataaggatattcaggatttgaactcagctctggaccaagcggacctaatagacatctacagaactctccacccgaaaccaacagaatatacattcttctcagcaccacatttcacttattctaaaattgaccacatagtggaagtaaaacactcttcagcaaatgcaaaagaatggaaatcataatagtctctcagaccacagtacaatcaaattagaactcaggactaagaaactcactcaaaaccgcgtaactacgtggaaactgagcaacctgctcctgaatgactactgggtaaataacaaaattaaggcagaaatcagtaagttctttgattcctatgaaaacagacacaacatagaggaatctctgggacacagctaaagcagtgtttagagggaaatttatagcactaaatgcccacaggagaaagcgggcaagatctaacatcgacaccctaacatcacaataaaagaactagagaagcaagagcaaacaaattcgaaagctagcagaagacaagaaataactaagatgagagctagagacacaaaaatcccttcaaaaaatcaatgaatcaggagttgcttttttgaaaagattaacaaaatagatcgaaagccagactaataaagaagaaaagagagaagaattaaacagacattataaaaatgataaaggggatatcaccactgatcccacagaaatacaaactaccatcagagaatgatataaacatctctactcaaataaactgcaaaatctagaagaaatggataaattcctggacgcatacaccctcccaagactaaacctggaagaagttgaatccctgaatagaccaataacaagttctgaaattgaggcagtaattaatagcctaccaaccaaaaaatacccaggaccagacagattcacagccaaattctaccagaagtacaaagaggagctggtaccattccttctgaaactgttccaaacaagagaaagagaaggaatcctccctaactcattttttgagaccagtatcatcctgataccaaaacttggcagagacacaacaaaaaaagaaaatttcaggccaatatccctgatatgaacatcaatgcaaaaatcctcaataaaatactggcaaaccgaatccagcagcacatcaaaaatcttatccaccataatcaagtcggctttatctctgggatgcaaggctggtttaacctatgcaaatcaataaacacaatccattatgtaaaccgaagcaacgatgaaaaccacatgattatctcaatagatgcagaaaaggcctccgataaaattcaagagccttcatgctaaaaactctcaataaacttggtattgatgaaacatatctcaaaataataagtgctatttatgacaaacccgcagccaatataatactgaatgggcaaaagctggaagcattccctttgaaaactggcacaaggcaaggatgccctctctcaccactcctattcaacatagtattggaagttctggccagggcaatcaggcaagagaaagaaataaagggtattcaaataggaatagaagacgtcagattgtctctctttgcagataacatgactgtatattttgaaaaccccatcgtctcagcccaaaatctccttaagctgataagcaacttcagcaaactctcaggatacaaaatcaatgtgcaaaaatcacaagaatttctatacatcaataatagagaaacagagagtgaaatcttgagtgaactcccattcacaattgctacaaagagaataaaacactaagaatacaacttacaagggatgtgaaggacctcttcaagtacaactacaaaccactgctcaaggaaataagagaggacacaaagaaatggaaaaacattccaagctcatggataagaagaatcaatatcgtgaaaatgaccatactgcccaaagtaatttatagattaagtgctatcccaatcaagctaccattaactttcttcacagaattagaaaaaactactttaaatttcatatggaaccagaaaagaggctatatagccaagacaatcctaagcaaaaagaacaaagctggaggcatcatgctacctgaattcaaactgtactacaaaggctacagtaactaaaacagcatgttactggtaccaaaacagatatataggctaatggaacagaatggagtccttagacatatcaccacacatctacagccatcttatctttggcaaacttgacaaaagcaatggggaaacgattccctatttaataaatggtgttgggaaaactggctagccatatgcataaaagtgaaactagactccttccttacacctcatacaaaaattaactcaagatggattaaatacttaaatgtaagacctaaaaccataaaaactctagaagaaaacctaggcaataccattcaggacataggcatgggcaaggacttcatgtctaaaacaccaaaagcaatggcagcaaaagccaaaattgataaatgggatctaattaaagtaaagagcttctgcacagcaaaagaaactatcatcacagtgaacaggcagactacagaatgggagaaaatttttgcaatccatccatctgacaaagggccaatatccagaatctagaagaaacttaaacaaatatacaagaaaaaaaaaaaaaccccgtcaagaagtgggcgaaggatagaacagatatttcccagaagaagacatttgtgtggccaaaaaacatatgaaaaaagctcatcatctttcgtcactagagaaatgcaaatcaaaaccacaatgtgataccatctcatgccagttaaaatggctatcattaaaatgtcaggaaactacagatgctggagtggatgtggaacaataggaccacttttacactgttggtcagagtgtgaattagttcaaccattgtggaagacactggtgattcctcaaggatctagaaccagaaataccacttgacccagcagtcccattactgggtatatacccaaaggattataaatcattctactataaggacacatgcacacatacgtttattgcagcaatattcacaatagcaaagacttagaaccaacccaagtgtccatcagtgaaagactggataaatcaaatttggcacatgtacatcatggaatactatggagccataaaaacgatgagttcatgtcctttgcagggacgtggatgaagctggaaactatcattctcagataactaacacagaaagagaaaaccaaacactgcatgttctcactcataaatgggagtcaaacaatgagagcacatggacacagggcgtggaatatcacacactggggcctgtctgggggttgtgggctagggaaaggatagcattaggagaaatacctaatgtagatgacaggttgatgggtgcagcaaaccaccatagcatgtgtatgtatacctatgtaacaaacctgcacgttttgcacatgtatcccagaacttaaagtatttaaaaaaaaaaaaaaacaaacaactgtccgatactgggcaatttatcaataaaagaggtttagttgactcacagttctgcatgcttgtggagccctcaggaaacttacaattatggcagaaggggaagcaggcatgtcttacatggcatcaggcaagagagcatgtaatggaagcaaagggggaagagccccttataaaaccataagatcttatgagaactcactatcatgagaacagcataggggaatccatgcccaagatccagtcacctcccaccaggtctctttctcaacacccagggattacagggattacaatttgagatgagatttgggtggggacacaaagccaaatcatatcaaagatttacctctaaacataataaagacaatataccacaagcccatagtgagtattatgctcagcactgaaaagttgaaggcctttttcctaagatgaggaacaagacatgggtactcaccctcacttttgttcaacacagtactgaaagtactaaccagaacagttaggcaagtcaaagaaataaaaaggattcaaattggaaaggaagaagtaaaattgtctttccttatagataacataaccttatatatagaaaagcttaaagactccaccaaaaacctgttaaaattgattaataaattccataaagttgtagattacaaaatcaacatacaatttttagtagcatttctatacagtaacatcaaattgcctcaaaaggaaattgagaacacaatcctatttacagtagtttcaaaaataaattaggtataaatttacccaaagaggtaaaaactctgtaagcagaaaactataaaccatttatgaaagaaatttagggagataaaataaaaggaaagatatcccatgttcatgaattgaaaggatgaacattgttaaagtgtctctacttcccaaagttatctacagattccatgcaacccccgtcaaaaactccaatgacatattccccagaaatagaaaaaaaaaatcctaaaatttgtatgacatcacaaacacttcaaaatagctagagcaatgttgagtaaaaaggataaaactggaggcctcatagtgcgtgctttgaaaatctactacaaagctgtgttaatcaaaacagcatggtgctggcataaaagcagacacacagacttacaggatagaatggaaaagccagaaaaaaatccacacatttatcgccaattgattgttgataaaaacgccaagatcacacaatgggggaagggcagtctcatcaataaatggtcgtagggaaactgggtgttcacttgcagaagaataatattagactcccatctcacatcatatatatataaatcatctcaaaatggattaaatgcttaaatgtaagacctaaaactgtgaaagtagtaaataaatcataggagaaaagctctctgtcattggtatgatcacacgtactttggatataacccccaaagcacagacgacaaaagtacaaatagacaaataggatgacatcaaactaaaaagcttctgcacagcaaaggaaacagaatgaagagaaaacctgtggaaaaggagaaagtatgtgagaccatatgtctgataaggaattaatatccagaatatatgaggaacttgaaagtaagaaaacaatctgatataaaaacatgcaaaggacctatataaacatttttgaaaataagacatataattggccaacaggtttatgaaaaagtgatgaacattactgatcatcaggaaaatgcaaattataactctaatgagatactgtcttatagctgttagagtggctactttaaaaaagaccgaaggtaagtattagcaaggttatggagaaaagagaacccttgaagactgttggttgggttgtaaattagtattacagccataattgtaaacagtatggaggtatctcaaaaataagaagtagaactatcatgtcatccaacaattttactatttagtgtatgtccaaaggaaatcatatcagtatctcaaagagatgcctgtatttctgtcacggcatccttggagtgttacttttctagctgggaacctctgtggctggtattgcctttgtctgaattttgcttgggcctgcttggcttgttctgcctactctgcctggcaggatacactctgctcgcactaacagcctgccaagggtgagccaggtacggagtggtgaggggtgtgtgagttagcgtgtgatctggccactgcacacagccaggcacactagttgtggtgtggtggacagctccaggtgccggcaccctgcaaggctgtggctcaatgaggcttactgcaagcagcttccatggctgccactggggtaggcagtggtgcctggaagcttggagacttcaggaactgcagagccccattgagggtgtcacagctctggcttggggagctcttaagtctgggctccctgaagtgctacagctcttctctccttcttgtcacctgcaacgtggcaagcaaggggcgtgtttcagccctgtttgtgttactgctctttcagtcgtgccgttccgcaggtcctgagttcttgtcctgtgtccaggaagaatgagttatgtggacaagtggagggtgaacaaggtgaagagatcctttattgagtgacagaacagcttaaaggagacccacagtgggtagctcctctctgcaggcagggcatcctgacaagtgttcagctctcagcagagaggagacccatagtgggtagcttctctccacaggcaggttgtcccatcatctgctcagctctcagcagagaggagaccctcagtgggtggctcttttctgctggcagattgtcctgtcatctgcttgagtttggctgagtccagggtttctatgggcttcagaggggaggaagtgcatgctgattggtccatggaaagccatgggcaggcccagaaaaagcaccagaagttctccctccagtccatggcactggcagtccagtccccaaacctcaggctgtctctgacctgaagatgaggtttcaccaggtacctgcccctttccatctaggcctgtctgcctcctgctgccattaacctgccatccacggtgcccatggtgcccaggctgtttgtgctgaatgttgcctgcaggcctgcatcaagccactcttagccccctgtcagcctttctcccatcctctttggtacccaaagtctggagggggccaaggcatgagggggctggtgtgtcatagctgccctgaatgtgtgcacacctggctgattcatgacagtgcccaggcttggccacaactttgcttcaaaattggagcgggtgtttgtagtgggtgcttggagtggggagaggctaggcagcaggagcagtcacttacaagcttgtgggtcagcagggcttcctgggtccccaagagtgtagagatgcccgggtttgcagccacagcttgacggctacaactgcgcccggggggcggggctcccacctgtttaacttggaatgggctgggagcttccacctgttcttggttcctgctggctccgtggagtgcacagccccagctgtgcctcccccactgcatctggtgtcattgatgatgccagggattgattgacaccattccagacaggctgccgctgccttcagtccctgctctgaagaggtacatctgctgccattaggatagggacaatgactgctcttaactgcttcatgctgacagggggcattgtttatggggaaaatggcagttatgtcttcttagaggccctatctaagggtccctagtaaaagtaaaagggagccatcagccaagtttccatttgcatgaccatttggagtttgatggcccgaaggcgagaagagacaaaccgggttattggaagacatggatcaaaacaaaacaaaggggtaaggacagctcaaaaaccctgaggctactcacatgctcaaaattagaatattgatccagattttttatattacgcatcccttttgtctcttctgagccgtagtcagaaatcactggttggttcacaagagcaagctgggttagtctaaaatgcagaccaaaacttaaaaacaaagtccggagggggctgaggcagcatggagctggcgtatcagcactgccccaagcgtgcacatacccagctatgtcatgacagtgcccaggcttggccacaacgttgctccaaaattagagtgggtgccaggagtggggagaggccaggcagcaggagcagactcttgcgagactgcaggagtgtcttcctaggcccttgagagtgcagaaatgcctgggtctgcagctgtggctgggtggctgcagctgcacccaggagggtagggctcctgccccttcaacttggaagtgggcagggcttccacctgttcctggctcttgcagctttgtggagtccacaagctccagccttacctcccacactgcagctggcatcatggcagtggccactccagatgccccactactaccatcacttccatgttcattgtggcgttatttccaatagccaagatgtggaatcaatctaagtgtccattaatgggtgaatggatgaagaaaacatgttatatatacacagtgaaatatcattcacccttaacaaaagaaggaaatcctgtcattctcaacatcatggatcaacctgtaggacattatgttaagtgaaataagtcaggcacagaaagacatactcatgatcttacttattataagtgtagtgtaaaaatgttgacctcatagaaacagtgaaatgttgattatcagaggctagggtgtgggaggaattagggagatgttggttaaaagacagaaaaatttatttaaagtggaggaataaattcaaagacttgtaaatcatggtgactgcagttaataacaatatgttgtatatttgaaaattgctaagacagtagattttaagtgttcgtaccagaagaaatgataagtatgtaaggtaatgtatatgttaaatagcttgatttagccattctacaggtatcaaagcatcatgttttatattataaatatatataatcagttaaaaaaaagtactgagactctgagaaaggcattagttaatttgcccatagttttatatttagtgaatccagtggtcttacttcagatgtgtattcttagccaaaagatgcacttgctttcacctccacttctgtccctaaaaactgaaaagcaaaataaagaggtggaaagaggctgggtgcggtggctcatgcctgcaatcccagcactttgggaggccaacatgggcagatcacgaggtcaggagttcaagaccagcctgaccaacatggtgaaaccccatctctactaaaaatacaaaaattagctgggcgtggtggcgcatgcgtgtaatcccagctactcaggtggctgaggcaggagaatcgcttgaccacggaggttgcagtgagctgagatcagcgccactgcactccagcctgggctacagagtgagactctgtctcaaaaaaaaaaaaaaaaaggaaagaaattcagtagccatttcattcagccttgcagttgatgcagtctttagctaaacactgggatagtttgggagggaaggccgtagtttgggagggaaggccgttagtacaatttttttatacgttgtgcataagaagcttttgagtcatggatctttgataattactttcagtagtaacgtatcctcggtaattttttttactttcagtaataacatatcctagacaaattttatgcatttttttccatacttgaaagaaactttttattaaaaaatagtattaataacggagcataatctggtaggagtgttcattactactgttttattgtttttaagttttttccatgggtagagtaggaaacacgcatttttggagagaaaaacatgaatcccaaatttatcctcattccaatttaagataaagattttgagggattttatttaccactttggtcttaccctttttgtatatctttttcttttattatccttttacctctgttctctgattttacatttttttttgcattttttttttttttttgctagatgcaggcctaggtattttattttacttttcgttatacagtcttctcgattattttaactaagcaggtttttttggatggtgggaggagaaggagaaaacattaagttgtctgcttcttatttattttacatattgcttataattctcttgtgaattattttagggtttttattggttgtttttgtttttgccttcctgatataaaaattatattgcttgcaaataaagattactttccttctttttcttccatttttggcctctaatgttttctttacttgtgttgtttaagatattaaataatagaagagatagtggacatccttgtcttattccttattttaatgagaaagtacctaacatttccaatttagtaagttgctggctaattgggaagtacagacacatgtgtatatctatatatctgtatatctatatctatatctatatgtattcaggctaaaaaatacctcttaatttctatgtaaacgttaaaatttttattttggtaattatgtatgatgttgaattatgtcacttgaatttttagcagttatgaaaatgaacatataatcttctgttaatataatggattttattaatgcatttttaatattagaaacctttgaatttctggcatgtacccctctttcaaatgttttttagtgttttggattcttttgcatattatctcatttaaagtttttgcatcattattcttcagtgtgtttgatttgtacagttttctgtgcagttttgtgaagttttggggccaatgttatatatctgttatataaaaataatttggaaattttcttcctttttaaaacctagtccttatttttattttattcaggcactgttttaacagatgatcaagtacctaccatgtgctattaacaataaaattgtaatggtagttaatagttccttagctcttaactatatatttgtcagtattctaagtacagttgattctcactgcttgaagtagatttgttctgtgacgtagcagtgaataataaattagctcttactggaattacaatgttaggttcctgtaagcctctggtcacaacatttttgttcacctatcaatacgtaacttttaaaaaatgtgtatttctgtttaaagacaacttatttaaaatatgtattgttgattcattaatattgaactcatgtcccacagcagtatgactcatgcctgaaggaagcttttgtaacacacatattttctccttaaggcatatcacaggcgtcttgtgcttaggaacactagatagcacttgggcattctaaatagccaaatcatcaacaaaaagcacaaaaatgagaacattgttgcacttaatagactgtgaaaagaataatcctttatagtatgagagcagaaacaaagcagagcatttgttcagtttcagctgataggatgcaaatcaggtgactcaaaattctcctcctcctgcacatttccacaaattattgccaaagtgctacgaatattgatgttgggatacaaataaattttattgagtagacaaattcataaatgcggaatctgtggatgaggattgatcgtatttctttgtatttaatatgtgttcatttattggtcatagcaatcctatgaggtaggtattataacacatactatacaataaagaggttaagttccttgtacagtgttgaacaatcaatgagtgtttgaggacaccaccaaagtagtataactgataccaagacatgttgtttacccttaggagctatttctatctaaaagcgttaaaggtgttttgctcaaataactaaatttaaggtagtttgaaataagtagcataagtgtagtgctaccaagatgtagtggatattcagagggaagattattttggagaccacggaaaggctttaggtgatggtttctaaatggaggcttttagaatcaataagatttcatcaagttggcttatgaggatgtaggagatgaactatttcagaaggtactcattttttacatcaaatacgttcaatgattctagtcttttgggaataggaaagtgatggtgaaggggcaacctctttagttttcagttttcgggattcatatactcactctatgaccattttttccagtactatttaaaaatttattctgcctttgtaatactgggaactaaagcatagcaccattaattggaagtcttaaagatgaacaaggcaatgttttaatgtaaatgtatgattttcttattatggaagaagaaaaaccaataatagattgacatttgtgcaataggactgcaaatagtgggtgttttgtgggagaaaaaattgtttcccaattttttgggaaaaattcaagtaaatattaaaaattgctgaaatacaaagattttcccccatatacaatacttttgtaatatactcatcatgtttttcaatgcatctcattagccatacctcttaactgcattgtaaaaaccaaaaaattaagagggaatattttaaaccaaatattctaacttcaataggcatcatagtgattatcatttcagatttggtgtccttgtaactgggctgatttatcataggtggtggatgtgtaaacttacctgtgtatgatcttgttgagggcaagaattgtggcttttcattttttgcgtttctgataaccagcaaagttcctatcacatagaaagccctcaggaaatgttactgcctacctaaatgaatactccaaaaccctttatgactaataatttctatgtaaatattgtagattgtgttgatcagtgttcttccattctatgtattaatgttttattttcagtgcaacactgtgagagtgatcaaagtgcaaaaatcctgtccttatatttagctttataatcagaaaacaccatactaatccataattttttttcacaccattggcctgcttttctttttattgttagttttgtttttattgtcagagaatgttaggtaatttcccagcataactttctcaagaatatatttcctcattactgcagtgaataactcagtgatgtgaaattagaagataacctattctgtttcagcaccagtgctttgacacatataacttgaaatgtgaatacgaattttgttttttcatgttaaaggattcaatttttcatcagttacttagatcttcataaaatctgaagttaggaaggaactttactaattattaagtcctattccattttaatgcctgcaatagtaaatgtttatttatgataaaactctgattaggtagtagggaaaattcaaggtcaaaagtacaaatttctaccaaactaaagaaagaatatgttaatatgacttgcaagcttggattcatatatattaaggaggggggtggaagatgacagttttaagaatcacatagtgttcaacaaaaagccaataaaaagtcctctctgtgccaagagttattgaacattttgaaataagagttataaattaattcatatatttcaatattatcaacatttgctcttggtcaagttcccctcctctcccaagaagagattgttttttgatccagtgttcaattttggttctctccgttaaacatatcaagcttacaagactaagataggtgtcactgagaatgtattttattaaaaacaattgaaaaaattgtattcttaaacatgggatcatatttggagtcttggtgtctatgaaatcctcctggtacaaaatttatatatggataaaaactaaaacagtaggattttgaaatcttttaacttttagattacaaaaagaatatgggaaatacagaaacacacaagaagcaagttttaaaatccctgtaatccctctatccagaaatagtaatattttgatgtatacattttcagggtttttttgtgtgtgtgtggtgtatgcacacacatctatactattttacaaactttgaatcataccgtacgaacacttttgttccttgcttttttcaactttgtgaacattttcctatgccaccaaaaatttagttcaaagtcatttaaaatggttatataattttccactgaatgcctgtatcataagtgatcttcagcagtaggacattagatatatagatatatccagttttcaattatgaactgttatgctaagtatttttatgtagctttttatacacaattcctatttttgtatggtgaagggaatgggattttaattcttatattgaatgtaccttgcaactatacttctgttttatcttagatattatcaaatgatatatttaaatatttatcttggtaaataaatacttgataagttaggtcacttttgtcacaaacaaaatttttaattttttattctatttctacataggtcagttgtagttgtaatgaaggaatcataattcctcaaatctaaaaattagaaagatggaaactgatatttcttcacatttaatagtttgattatacatcttatgattaatgttagtattatctgagacaaatatttcactgtcctttatgtaaagttctttatgtacattgtccactatgacaaaatatgtctcttaatttaggtcttggggaatgaacacttgtttttaatattagcctatcagagtaagcactttaattggattagctcatttaattctcataacattgcatgaactataggtagcattttatcctattttatacatgaggaattctgactcatagagtcctcatgtgtcatagagtcctttgtagagctgcaaagtataggcagtaatataggtggtagtatcatgattgatttgtaggaactctgttactggcacctgcatttgtaaacatctacagcaggaatgtatgccatttaatgcttttgttttttttcttctactctaattgaagattattttccaaagttattctcttaacaaaaattgaaaaatatactatatagaatatgtatatagatatttgtatgcatatgtatgtgtacgcattcgggtatgaatagaaatccacaaacctaactgaatagttgctttgcagacacttggttatgaaacactatccactgaccgaaatattttttctggctataattttggagtataattaaaatataaacttgtaagttcctctttttaaaaagatactttagaaaaacagattttactcttttcattagaaaaatattccaatatgtaacagtatatatactcagaaatgcatatgtctgatttaaaatgatttattctttagttttaagcctatgtatatattttaaaaataatttcttattttaggttcgggggtacatgtacagatttgttacatgggtatattgcatgatgctgaggtttgggatatagatgatcctgtcacccaggtactgagcataatatctgataggtagtttttcagcccatttccccctccctcccccctccctcctttagacaactctaaatgtctattgttctcatctttctgtccatatgtattccgttatttaggtcacgcttacaagtgagaacatacagtatttggttttctgttcctgtgttaattaggataatggcctccagccacatccatgttgctgcaaaggacacatttcagtctttttatggctgcgtagtattccatggtgtatatgtgccacatttgctttatcgactctaccatcgatgggcacctaggttgattccatatctttgcgatcgtgaatagtgatgcagtgaacatatcggtgcatatgtctttttttaggataatttatttgcctttgggtatatacccagtaatgggatggctgggtcaaacagtagtcctgttgtaagtttttgagacatctctcaactgctttccacagtggctgaactaacttgcattcccaccaagagtgtatatgtgttcccttttctccccaggcttgtcagcatttattattttttgactttttaataatcaccattctgactggtgtaagatggtatattgttgtagttttgatttgcatttctctgatgattagtgatgatgaacatttttcatttatttcttggccacttacaatgtcttcttttgataagtgtctatatcctttgccgattttttttttttttttttttgagacggagtctcactctgtcgcccagactggagtgcagtggcaggatctcagcttactgcaatctctgccccccaggttaacaccattttcctgcctcagcctcccgagtagctgggagtataggtgcctgccaccaagcccggctaattttttctattttgtttagtagagacggggtttcactgtgttagccaggatggtctcgatctcctgacctcttgatctgcccgcctcggcctcccaaagtgctgggattacaggtgtgagccaccgcacctggccccattttttaaaggagttatttgttttttgcttgttgatttaagtttcttatagattctggatattagacctttgtcagatgcatagtttgtgaatattttctcccattctctaggctgtttactgttgataatttatttttctgtgcagagctatttagtttaattaggtcccacttgtcaattttcatttttgttgcaattgcttttggggacttagtcataaattctttgccaaacctgatgtcaagaagtgcatttcctaggttttcttgtaggatttttgtagtttgaggtcttatctttacatctttaatccatcttgggttaatttttgtatgcggtgaaaggtagagactagcttcattcttctgcatgtggctagacagttatcccagcaccatttattgaacagggagtcctttcctcattgcttccttttgttgactttgttgaaaatcagatggttatgggtgtatggctttatttctgggttctttgttctgttccattggtctatgtgtctgtttttgtaccagtcccgtgctattttggttactatagccttatagtatagtttgaagtcaggtagtgttctttttgcttagtattgccttggcgatttgggatctgcttttgttccatgtgaatattagaataggcttttctaattttgcaaaaaatgatgttggtagtttgatagaaatagcattgaatttataaattgctttgaccagtatggccattttaacaatattgattcttccaattcatgggcatggaatatatttccatttatttgtcttgtctctcatttatttcagcagtgttttgtagttcttgtagagatctttcacctctttggttagatgtatgcataggtttttgctattggaaattggtgtgtgttcttgatttggctctcaggtagaatgtttttggtgtatagaagtgctattgatttttgtacattgattttgtatccttatttatcagttccaggagccttttggcagcatctttaatgttttctaggtatggaatcatatcatcactgaagagaggtaatatgacttcctttcctatttgaatgtattttatttctttcttttgtctgattattctgactagcactttcagtactatgttgaataggagtgttgagagtgggcagccttgtctcattctagttctcaaggagaatgactccggcttttgcccattcagtatgatgttggctgtgggtttttcattgtgagaatgaataataagaatgaataaggtttttcattcttattattgtgaggtatgttccttcgaagccttgtttgttgagggtttttatcataaagagatgttggattttgtagaaagctttttcttgtctattgagatgatcatatgctttttgtttttgattctgtttatgtggtgaatcacatttattgatgtgcatatgttgaaccaaccctgcatccaagaatacagcctactcgatcatggtgaattaactttttaatgtgctgctggattcatttcgctagtttttttttgtatttttgtgtttttttttgtttttttagggttttgtgtttgtgttcatttgggatattggcctgaagttttcttttttgttgtgtctttgccagattttggtatcaggataattctggccttgtagaatgagttagggagcagggggagtccctcctcctcaatttttttgaatattttcagtaggattggtgccagttcttatttgtatgcctggtagaattcagtgtgaatccttctagtccatggctttttttttgttggtaggtttttaattactgactcaaatttggaacttgttattggtcttttcaggttttcactttcttcctggttcaatctttggaggttgtgtgttcccataaatttatttcctctagatttcttatttgtgttcatagagatgttcataatagtctctgaggatgttttgtatttctgtgggatcagttgtaatgtcatctttgtcatttctgtttgtgcttatttggatcttccctttttctcctttgttaatctaatgagaagtctgtcaatcttttttattcttccgataaacctactcttctttccattgatcttttgtatggatttttgtgtcttaatttaattcagttctgatcttaattatttcttttcttttattagctttgtggttttttttttttttctagttcctctaggtacaaagttagattgttaatttgagatctttctaatttttgatgaatgcatttggcaccgtaaactttcctcttaacatgctgtagttccatcccaaagattttgttaatatgtggttctgtttttgtgaatttcgaatagttttttggtttctgccttcatttcattatttccccaaaacttattcaagagcaaattccttccttttcatgtatatgtgtagctttgagagatcttcttggtgttggtttttgtttttattgcactgtgatgtgagaacgtgcttaatatgattttgatttttttgaatttattgagacttgctttatgaccaaaacatttggttgatcttagaatatgtttcttatgcagatgagagaaatgtatattatgtgattttgggtggactattctatagatgtctattaggtcccattggtggactgtcaagattaagtctggaatttctttgttagttttcttcctcagtgatctgtctaatcctgtcactggggagttgacatctcccagtattattatgtggctattgaggtctttttctaggtcaaaaaggacttgttttatgaatctggatgctccaatgttgggtgtgtatagacttaaggtagttaagtcttcttgttgaatggaaccctttgccactatgtaatacccttgtttgcccttcttaattgttttcagtttaaagtctgccttatctgatattagaattgcaactcctgctctttattgttttccatttgtatggcagttctttttccctttaattttgaggctttcggtattgttacatgtgagatgcatcttcttgaagacagcagacagttggatcttgtctttttgtccagcttgccatcctatgccttttaagtgggtctttattccattcacattctgggttggcattgatatgtgaagttttgatacagaaattgtgtttttagctggttgttttgtagagttgtttgcatagctgctttatagtgtctatgggctatatgcttaattgtgtttttgtggtatcagatactgttcttttactttcatgtttagcactcccttatggactttttataaggctggtctagtggttacaaattcttagcatttgaagcttactttggtgggatatgaaattcttcattggaatttattctttttaaggctactgaaaattggtttccgatctcttctggcttgtaagtttctgctgagtagcccgctactatcctgatggggtttcctttataagtgacctgactcatctctctagctgcctttaagattttttctttaacatcggccttggtgaatctgatgtctgtgtgtcttggggatggtcatcttgtataaaactcacaagagttttctgtatttcttgaatttgcatgttgatatctctagtgagattggggtatttttcataaactgtatcttcaaatatgttttcaaagttgttttctctctcaggaatgccaatgaatcctaggtttggtctctatataatcccatatttttcagaaatttttttcatttttaaaatattcttttttccttatttttgtctaagttgaattgaaagaactaaactggtcttcaagctctgagcttcttttctcagcttagtctattctgctgtaaatgcttctgattgtactatgaagttcttgtagtgaatttttcaattttagaagttcagttcggttctttttaaaaatggctattttgtctttcagctcttggatagttctactggattcctttgattccttgaattggtttcacctttctcgtaaagccattgaacttccttgttatctagattctgaattgtctgtcatttcagtcatttcaatctggttaagatctattgctggggagcttctgcactcttttggaaagaagaggacagtgactttttgaattgttagagttcttttgctgattctttttcatctgagtgggctggtgttcctttaactgtggtataagttgagtatactcaattggcttcttttctaagtgttttcagagggccaagactctgtacaggatttttatttgtgagtagattctttccctgggtttcacagatgatgtatattggcagaatatttttggtgttgtaatttggtctgtcaaccagtagatggtgcttaagtataatggccgatagataggctttggctctgacttgtcgctcttttgtatttcagcaagtttagagcaccgctgtcttccctaggagccattcagtggcaggaactagccctcacattcggaaaccccacacaggtttcccagtttcctctctcttcaccctcagtgtctatgttgcctttgaactcttggtgtttcctctctgaagatttgttcaaagtatgtttgtttacttgatattttggtctctcttggtggcataggcacttcctggctgtgtctagtcagccatcttgtcttctgtgccctctcaaatccttcttcaagccagtatttttgttattgccattgaaatagacaataattgtcctaatgttaaggaaaaatttattcagtgatacttgttaaagtacattaaggaagactttatttagggtcattgcgatagatgtaaggaccactgacatgggattttacagtgagggagagagactcacaatacaacatgggcaagtgggaatttatagccaatgagaagggatggagagttagtagatagaaaattactaaaaggaaatatcagacttaaaaggtgattctggctaaactcacctagaaggatttttttctgaagacaggccaagataatcagacatctcctggggatggtggggaatgaagaatgcaattagatatccagggtgatcagttatcaatgtttttgctgtactgacttagcagagttttttgctaaaactgaattttacaagaaagtgcacagatgggcctaggagaaggcttggtcaagcaaataatcttcatcagttataaagcccttcacataataaaagcggctttaataattgtgaatttaaccttgcatagaaatttttcaaataagaaactaatatacttcaagaatatgcaggggattttttactagtaatttagttacatgtttccctctttttgttcgttagaagttacatgagggcagttatgacttctgttcactaaggttaattccattgaatacatacaaagcattattttcaaggccaaggccattggtagtggtggtaggggctggaacaaagaaatttattagataagatacccttaacactgatatacgtccattttgttttaagagcatttctgtagagacaaaaaagcatagaaaatatactcattgctatttggagtactttgtggtaaatctggaatccttgcttttgcttttatagtagttccataacaaggttatttttaaaacatcatccaaaactgaaatttcaacattaattggattggcacttctagttgtaaatcagcacttccagtcataaatcttgaggaaattggtatcagacctcatgatattctgttttcagtaggttagttttctcagcattattttgtgctaaggagaagaatctctgtgttttaaaccttttcaaagctatgtaacttgatatttgctcttttaaaatcttagccatcaaataccagctctactgcctgtgtccgtggctttccattctccctatcattgccctgttagggcatcattatcagttagagagacttgtattgcttccatactattcttcactgctagatgaaagtttctaaagtttagctcttatcctgtcattacaaacttgaatatgtagaataattccccattgactaatgtgttttctgtggcctaacatttctatcctttttgtgtgatttcatcccccatctacttttttagttttatattccatcgttcttttttcttcgcctaatacttaaactgttctctaaatagcccaacaccaatatgtgtatttatcattttctttacattgttttatttctctgaaatggcctttcttcagttttgcatgcctaaactctaccaaatgagcccaattgtaatgacttttccatgaaggccttcaaaccaagttatcacttgtttttctttgcttttattattttttttaacttttaaaaatgttttcttctaacttctttttaatttttttgtatttatttatttattgccctcaaacattctcctatccagttattgttcttttataaagctcatctctccttccctcccacatagttgctctgcatactttctactcctcttatttaattttttgttttggaaaatttagggactatacaaaataaacacaatgaagtttatagtatgatgtatcaccatgtacccatcactcagaaacaagttatcgttatgacattcttgtttcgtttttgcattcctccacttctcaccatccactcagtcattggtaattctttaagataaaatttacataattcaaattcacaaatctgagctggacaattacgacaattaagtaaacacatgaaacccaatccccctttcaaagtatagatagaatgtttctttctctccagaaactttctattgcctctttccagtcagtcttcccaccctcataggacggctttaacttttcttcaccttttgttttacctttcttgttctttccatgtaaatggaattacactctgtgtaagtcttcttttgctcaacatgtttctgagatttatctcttattattgcttggaacaatagtccattccattttattacttagtactattccattctgtgactgttttataatttgtatatccatttggtttatggactttttgattattttcagtttttagctattatgagtaaagctgctgtgaatatatacatgtaagcctttttgtggatattactgattcttgttattcactctagttatgttctgtaaagtcaccgtggacactgaattattgaatactgaaccattgcttctaggggaaatatagggttaggttcttgtgatcctctggtcacaacatttttgtgaactgatcaacatataattttgttttatgtgtgtttctgtttaaaggcaccttatttactatatattgttgtttcattaacattgaattcacagccaacagcactagaactgatgtctgaataaactttatctaaaatgtattttctccttaaggcacaccacagccttcttgcactcaggaatactacacagcacttcagtattcttcatggcaccattctacacaacaaaatcaccaacaaaatgcatcacaacttgaaaaacatggcaaaaaatagatcatgaaaaggacgcttgtttacagtatgattgccaaaacaagagagagtattggtatgttccacatcagctgagaatgtacctgtctgctgactcaaatttttgctgctccgtacacatctacaaattattgtgaaagagcttcaagtattgattttggggttactaacaaattttagttaggaggtgaattcacaaatgtgcaatctgtgaataatgaagattgtatatgttcttatttttcttggatagatattagtattcacaaatgtgcaatctgtgaataatgaagattgtatatgttcttatttttcttggataaatattagtataattgatgggttaaatagcatccatactttataagatactgccaagcctttttctaattgtagttgcaccattttaaattcttattattaatgcataagcattccagttgtttcatatattcatcaacatttgatattatcagtctttcattttactcattgtagcactcatttgatttttccttgctgtagttatgtgtttatgtcttatctctcccggctggaaattttttggcggcagtatataatttgtatttgtatttgccaaactaatattttggagagatactatacctttgttgttatgtgcacaaacgttggagctagaatgcctgtggtcaaagctcaactctcccacttacaaattttgaggccgtagataatgaaaataacataacagtaaaataactttttataactatattaatttgggtctctcaacaaacaattattattagtagtttggaaatcaagcctttttgaggttagatagcttgtcccagatcaaacgagtaagaggtaccagaacaagatttcaaattcaggtctaacttactccaaagccagtgctcttaactactgcacaatacagtattgccgcctaaatcccactttaaaacctaccatatgtcattaaattaatgctcatcatcctctattaagatgtaaatgatattgaattaatttaaaacttattcacttattgtaatagattatatactttttgcttttctacatgcaaaatgatgttatttgatattaatagtaattatattctttcactccaaaactttagcttttttttttttttgcctattgtgatgtctagcaccaccagttcaaatttgaatagaaatgataatagtgcatattttttgtctcgtttccaatttaaaagggaaagtttttaatatttcatgattaaacttcaagatgttttatgtattcttttttatgatttttttctttatttcttgtaaaaaaatgggatacatatgcagaacctgcagatttgttacataggtatacatgtgccatggtggtttgctgcacatattgacccatcctctaagttccttcccctaaccgctcatcacccaacaggtcctggtgtttgttattctcctctctgggtccatgtgttctcactgttcaactcccacttatgagtgagaacgtgcagtgtttggtttctgttcctgtgttagtttgctgataattatggcttccagcttcattcatgtccctgcaaaagacatgatctcattcttttttatggctgcatagtgttccatggtgtatacgtatcacattttctttatccagtctatcattggcatttgggttggttccgtgtctttgctattgtaaatagtgctgcaataaacatacctgtgcatgtgtctttatagtagaatgatttataatcctttgggtatatacccagtgatgggattgctgggtcaaatggtatttctggttctagatccttgagaaatggccatactgccttccacaatggttgaactgatttacattcccaccagcagagtaaaagcgttcctatttctccacagcctcgccagcatctattgtttcttgactttttaataattgccgttctgactggcatgagatggtatctcattgtggttttgatttgcatttctctgatggtcagtggtgttgagcttttttttttttttttgtatgtttgttggccatgtaaatgtcttcttttgagaagtgtctgttcatatcttttgcctactttttgatggggttatttttttcttgtaaatttgtttaagttccttgtagattctggatattagacctttgtccaatgtgtagattgcaaaaattttctcccattctgtaggttgcctattcattctgatgatagtttcttttgctgtgcagaagctctttagtttaattagatcccatttgtcaattttgatttttgttgcagttgcttttggcattttcatcatgaagtctttgcccatgcctgtgtcctgaatgatattgcctaggttttcttgtaggttttttttttatggttttgggttttacatttaagtctttaatccatcttgagttaatttttgtgtaaggtgtaaggaagggtccagtttcagttttctgcatatggctagcctttttcccaggaccatttattgaatagggaatcctttccccattgcttgtttttgtcaggtttgttgaagatcagatggttgtagatgtgtggtgttatttctgagatctctgttctgttccatatatgcctgttttggtaccagtaccatgctgttttgattactgtagtatagcttgaactcaagtagtatgatgcctccagctttgttctttttgctcaggattgtcttggctatatgggttcttctttgattccatatgaaatttaaagattttctaattctatgaagaatgtcaatgatagtttgatgggaataacattgaatctataaattacttcgggcagtctgtcctttcgggttttcagcattttttcattgattctttctcatctttgtgagtttgtccagtttgatctttgaggctgctgacccatggatgggtcagctgttgttgttgctttctgtttctttgtgttttgttgttgttgttgttgttgttgtttcagttgtcaggtccctcttctgtagggccactgcaatttgctgggggttcacttcaggccctatacatgtggtttgctcccgtgcctggagatgtcactcaaggaggctgcagaacagcaaagatgggtgcctgctccttcttctgggatctctgaccttgaggggcaccagcctatgccagtaggattgctcctgtatagggtgtctgacaacccctgttggagggtctcacccagttaggggcatggggaacaggaccccttttttttttagacggagtctcgctatgttgtcaccaggctggagtgcagtggtgccatcttggctcactgcaacctctgcctcccaggttcaagcaattcttctgccgcagtctcccaagtagctgggattacaagcgtgtgccaccacgcccagctaatttttgtatttttagtagagacagggtttcaccatgttggccagaatggtcttgatctcctgacctcgtgatctgcctgcctcggcctcccaaagtgctgggattacaggcgtgagccaccatctgcgcccggctgaacaggacccatttaacgaagcactttgactgtccattggtggaggggttatgctttacttgggggaagcacgttgtctgggcttcccggattcctcagaaccaccaggaggaaaggctaagtttgctggtctgcagagactgctgccacccttttctctaggggctcaggcccctaccccaaggagctgaaatggcttagacagcagacagctgtagctgtggtgctggttgcccctcctgtagggagctcagtaggcttcagcagattccagctgaaaggctattgagaatctgcagagctctggggttgggacgctagggcccagtggcatgggttcgcaagttggatcttctgatccatgggttgcgcagttctgtggaaaaaccacggtttccccagctgggtggaatgctcactcactgcctcccttggctatggggagggtgttcccctgcccctgtggctctcaggtgggctgccataccacactgttcttccttcctcttcatggaccacacaagctttctggtcagttctgatgagataacctggataccttaattgctggtgagggattcacagtcttattatgattcttttcaatgggagcctccgaacatggctgtttctactctgccatctagatagtcttaatcagattaaggaatttccctttttcctaggtcgctgagagttttttttcataaatggatattgaattttattatttttttaattattgaaattatagtttattttcttctttgaaagagaaatacatgtgtagtgaattacattgattgcattcttgaaatattaaaccttccatgtattcatttcaatcacttagctgagatatattttgtaataactggctttaatgtgctaattttgtgcttgggactttcacataagtgattatgaaagagattatcttctaattttgtttttggcttgtgttgatatcaaggttattttgggagggctaacatttttctgttttctggaagagtttctaaaagcttggttttatttcttcagtatatataactggtggtatttttattcttttcaatcttacatttttttcttgtgttattgtagtggctaggatctctagtacaatattgaatagaagtggtttgagtgaatatccttggttagttgagaattattaggatgatagccttcagtactgtaatgtcataagcattttaagtgctaggtgttatttattggctacttttattcataaaagttccacatgttgtccaggctggtctcgaactcctgacctcaggtgatccacctgtgtctacctcccaaagtgctaggattactggtgtgagctactgcgcccggccgagtttattttttaatcatacatttgtgttgaatttttaaatcaaatttatctattgaaaaggttatatagttttatccatcagtctgtgtagagatggtaaaatgttaatccaatattgcatttgagggatagtatcctttctgtatattgctgtattcattttctgtttttaaaaggatttttgcatctctactcatggaaaatactggtcagggtctatacttctgttttcatttaatgtccttggtcatttggtttcaggattagctcacttcataaagtaagttgagaatttaaatagttgacagagtttaccagtcatattatctgtggctagaatcctgggttggagtgtgttatttatgtttctgttggtggtgggagggtagacatgacatgcaataaacggcacattttaaatttatggttttatgtattattcattgtgaaattgtaactacatggaagatggtgaacctatccatcacactctacaagtttcccctcaatttttttgtgattctgggtaatctttcccttttgttctcccttatctccatctatcaccaaactgtattttctttttcccataatgatcagtttgcattttctagagctttatgtaaatagatagttacaagagaaagtcatttttttctggcttccttcactcagcgtaagtatttggaggtttttcatataaagtttattcttttttgttgttcattcatattccattatatgaatatattcacttgatcatagacatttggttgtttctagcttttggctattacaaataaaatgtacatgtgtaagtctttgtatagacatttacttttttattcatttcagtaaatacctgtgaatgaaatggctagatcattgggtagctgtatgtttaactttttaagaaactgctaaattgtttcccaaagtggttgttctcattaacagtgtaggaaggttcagttttttcagatccttacccacatttgttatgtttggtcttttaaattttaaccactgtaaaaggtatctagttgtatcttattataattttaatttgcattttcctgttgactagtaatgttgaagatattctcaggtttttttttttttaccatatgtatatcttttttttggtgaactgtctattcaaacgttttatccttttatgaaattgagttttttccttattgttgagatttgagagttctttatatattcagaatgcaagtaagacatatgcttgtaaatatttacacacagtctttgacatcttttcattctcatagcagtgtctttcacatctatcttgagacttattcctaagcatttttatattttacatgttattttaattggcattttaaaatgtttcatttaattttattttccatttgttcattggtagtatgtagaaatacaattgatttttgtatattgacctggtattctgcaactatgctaaacatacttatagttctagcagcttttgtgtagttttggggagcaaatagggtcctgatagagagatggctttatggaagaagtacaaggacccttacgggccaggttaggagatgtaaggagattcctcaggatttgatcgccagtgtttttgtctaagtgttggatatatggagtgggtgtggagggaattaccccactgccctacctgttaatgaatgtttagaggttaggcagagggttcaggcaagctgcctaaatggttctcggttgttgttcacacttacccatgtgatagaaaaagtgaaggttatcctgacagtgtggtaataagtcctgtgcctctactcaaaaggcagtattgctatggctgcataaaggatccctgaggctgaagtaacatatgtcagcaatgaggatacaggcctttaggtaaactaatgtattagtccattttcaaactgctgataaagacatacctgagactgggcaatttacaaaagaaagagatttaatggacttacagtttgatatggctggagaggcctcacaatgatggcagaaggcaaggaggagcaagtcacatggatcatggcaggcaaagagtgaacctgtgtagaaaaactcccatttttaaaaccatcagacctcatgagaactcattcattatcatgagaacagcacgggaaataccttcctccccaataattctgtcacctcccaccaggttcttcccatgacacgtgggaattgtaggagttacaattcaagatgagatttggcagaggggacacagccaaaccatatcagtctatctctgaccgctctcaaatctcatatcctcacatttcaaaaccagtcatgccttcccaacagtcccccaaagttttaactcatttcagctttaactcaaaagtccacagtccaaagtctcacctgagacaaggcaagtcccttctgcctataagcctgtaaaatcagaagcaacttagttacttcctagatacaatggaggtacaggcattgggtaaatacaaccattccaaatgggagaaattggccaaaacaaaggggctacaggccccatgccagtcccaaatccagcagggctatcaaatctttttttttgagagagagagtctaactctgtcgcccaggctggagtgcactggcgtgatcttggctcactgcaagctctgcctcccgggttcacgccattctcctgcctcagcctcctgagcagctgggactacaagcatccaccaccaagcccagccaatttttttttttttttttgtatttttagtagagatggggtttcactgtgttagccagggtggtctcgatttcctgacctcatgatccgcctgcctcggcctcccaaagtgctgggattacaggcatgagccactgcacccagccaatttttttttttcgtatttgtagtagagatgggatttcaccatgttagccaggatggtctctatctcctgacctcgtgatccacctgcctcggcctcccaaagtgctgggattacagatgtgagccacagtgcctggccagggctgtcaaatcttttttttttttttgagacagagtctccctctgtcgcccaggctagagtgcaatggcacgatctcagctcactgccagctccaccccctgggttcacaccattctcctgcctcagtctcctgagtagctgggactacaggcacccgccaccatgcccagctaattttttgtattttagtagagacggggtttcaccatgttagccaggatggtctcgatctcctgaccttgtgatccaccgcctcggcctcccaaaatgctgggattacaggcgtgagccaccgcacccagccggctgtgaaatcttaaagctccaaaatgatctcctttgactccatatctcatgtccgggtcatgctgatgcaagaggtgggttctcatggtctgggcagctccacccctgtgtctctgcaggatacagcctccatcccagctgctttcattggctagtagtgactgtctgtggcttttccaggcacacagtgctgtcggtggatctgccattatggggtctggaggatggtggccctttctcacagttccactaggttggagccccagtaggaactccatgtgggtgattcaaccccacatttcttttctgcactgccctagcagaggttcttcatgagcgccccacccctgcagcaaacttctgcctggacatccaggtatttacgtacatcctgtgaaatccaggtggaggctcccaaacctcagttcttgacttctatgcacttgcaggctcaacaccacatgaaagctgccaaggcctggggcttgaaccctctgaacgcatggcctgagcttatactggcccctttcagtcatggctggagcagctgggatgcagggcaccacctttctggactgcacacaccatggggacccttggcccggcccacaaaaccatgttttcctcctaggcctttgagcctgtgatgggaggggctgccatgaagacctgtgacatgtcctggagacattttccccattgtctaggggattaacattcagctcctcattacttttgcaaatttctgcatccggcttgaatttctcctcagaaaatgggattttcttttctttcgcattgtcaggctacaagttttccaaacttttatgctctgtttcccttttaaaactgaatgcctttaacagcacccaagtcatgtcttgaatgctttactgcttagaaatttcttccatcagataccctaaatcatctctctcaagttcaaagttccacagatctctggggcaggggcaaaaagctgccagtctctttgccaaaacatagcaagagtcacctttgctccagtttccaacaagttcctcatctccttgtgagaccacctcagcctgtacctttttgttcatatcactatcagcatttttgtcaaagccattcaacaaatctctaggaagttccaaactttcccagattttcctgtcttcttctgagccctccaaactgtcccaatctctgcctgttatccagttccaaactcgcttccacattttcatgtatgttttcagcagcaccccattctactggtaccaatttactgtattaatccattttcatgctgctgataaagacatacctgagactgggcaatttataaaagaaagaggtttaatggacttacagttcttcatgactggggaggcctcacaatcatggcagaaggcaaagaggagcttgtatggcagtggacaaagtcacctcttatatggcagtggacaaagagagaacttgtgcagggaaactcccatttttaaaacaatcagatttcatgagactcattcactataatgaggacagcacacgaaagacccacccccataattcaatcacctccgaccaggttcctcccaagacatgtgggaattgtaggagttacaattgaggatgagatttgggtggggacacagccaaaccatatcagccagcaaccttggaagttagtttgcttgatcatgtgactggctgctcaaagctgaaagcaaatacaaagcctactaaaaatacaaaaattggctgggtgtggtgatgtgcacctgtagtcccagttacttgggatgctgaggcacgagaatcacttgaacccaggagatggaggttgcaataagctgagattgtgccactgtgctccagcctgtgtgttggagtgagactctgtttcaaaaaaaaaaaaaaaaaaaaagcaaagtcatgcttattggtgtatgtgccactttctcagtttgtgtcctctcatcctgccatcccccctttaccctgacatcagctgcctcaaggagaaaactaagtgccctggagaaattttaaagaagaggagggacctgaactttcatggctttattggatacgggttaccagatcaccatccttggtcccatgtgggaagggaaagctgaacccagggcttgccaaaagggctgaagatgaaggggaagagctaccgtaatatttcacctccttgagcgaggttgctttccaaatatcagaagctacatgagggaggaaacaactgcagggtttggacaccaaccctggagcgagcagccaaaggagagaaaaagtctacacagtgctcctcatgtccttatcgtccttttccactcccagtactctctgctccccagattttcagcctggagatattacaggcattttgtggccattgtaagctgtcacataccaacactctgtagattgtcaaatttatgaatgtaccatttcataatttctggaaacatgttttctcttagtacagttcattaatatggcataagacatgtttactggcagactcaaatatctttatttcctctgtaataagaagaactaaattactatagcccttgacatgtgcctgtgagacaccttggtccgtgttttagtataggatctgtatctgaattcaactgctagatttgaggaaagtttaccaagggatatgatgttaaattgaccttgtgggtaaagcccttgggctgatttcatgtacaaagtttactctattaaataaacggttgggtctggttctctgatagcttaagtgaaaagctaatggtgtccactgggtggcagccaccctccagctccaaggacagtctaaaagattaactggtaagggctgatccagcacaatgggctgaattaaaagccattttcttggaccaggggttgagagacttcagtctgtgtgccaaatttggctacaatctgtttttctattgctcttagcttgggaggatttttacattttttaaagcattgggggaaaaagaatacacacttgagactgtatggggcttgcaaagccaaaactatttactatctgctcttttcagaaaacaagttttctaactcctaccttagacagtattcctaaggattaagttatgatatctttttcctgagtgttgggctcttgccagttacttcacttgggtagtaatagtagattacagagacacccctccatggagacataagctatgaactgccatttggaagggctgggtcactcatgttgatgcctagagtaagtgcctgtttttacaattagtctgaatggaatcaagctgctggtcaagcctgcacttgttagtgcctttcaatctggaaacttgtctttttttttcttcttcttctttttgaggcagggtcttgccctgtcaccaggttgcagtgccgtggtacgagatggtcactatagccttgacctcccagtctcaagcaatcctctctccttagcctcccatgtaactggaactacaaacacgcaccaccacacctaattttataatttttttgtagagacagggtctcactatgttgccaagggtctcgaactcctgggctcaagtgatcctcctgccttggtctcccagagtgctaggattacactcatgggccaccatgcccggccattgtctttcatttttggaaaattttcatatattatttacttgatcagcccctcccttcttttttcttgttttgtttttctggaatttctgtttggatgttagagtttctcaatttcccccccaattttcttaacttttctttcctattgtctgccttttgtcctacttcttggtagtttcttttccctacctttgttttcaaaccttctaatacagtttatgtttcatttacatttttaaattccaagaattcttcctccaatgcctgtttgtaataataccctgttcttatgtcaagtacacaatttgtcagtctccatctaataaaatcacagtgtggttttttaaagactattctgtttcttgcattgtttattcccaaatcctttttgtttgttactgcgtttagtttaatctgtgctatttatgatgcaagctttcttcacatatcttgtgattcttatatgcagatttatatttaatagggaggcaataaatatgagttggcttttctatgtaataggacaggccttataacccagtggacttcattgtagggttattaggtaggtatccagaggtactcataaatgtcactatcatagggcattttctcttgggctgtttagttccttctgagaaaaacttttaacttcctacctgaatggtgtaaacttgtctggcagtgttattttagccatgtgatggagaagtctgggattctcaccatttagtatgttaactttcaattaatacccctgtttttcataaggtgcttctcctctaccatctattatgcttagataattatagagaaccagaatctgtttagcaagggctgaaatttatgttctatcttatagataggaaaagtaaatggagcctaaaatgcagatataagtgcataaaagttattctgttaattcttttctctatattaaatatgatgtttctccaaattttgatgttttatttgaagccataataaactttgttctaaggcattcacattcatttaagtaattggatttattttatgaaacattctcattctgatcaaaattttcaccgaaggatgaagatttaacagaagtgctaatagtaatatatttgagttgaactttaggtaacatgttagaaagaagataacttaatattttgaggatattttccatttaaataaaaacagcaagaaccaatgtattaaattgaatgctgtggttctagttattgttttttggatgtatttaataatttctaatgtctttttggcttaacactggacctcacagttaggtaatgaggatggaagtagtatatttgcctttctatgaatgccataccataagatttttcaggatatttttgtagttaagaagatagcatatgagtagaatgatagataattcaatttgaggtacttgtaactgaattggattcatgtctactggagatgagattctcatggaaaatcaacagctgataatgtaaatgaagaactttgtgatcctacaaattataaaacagtgcagttatcatttaggttttaggttttgactgccagagatttgctttatagagatttgctttattgagatttgctttattgggaatgcctatatttcagtgttagaattattataattgactatagatcttttatataaaatattctcatttgggggaatagaggatagatagcaatatatgactcttaccttaaaattggtataaatctaatgaatacccatataattactattgaacttaagaaataaaacattacagataaaatggaagtcatctgtgaatctcttacctataccattcacctttatcattctcttcccagtagtaacccttattctgaatttgttgttttatattccctgcttgtttcacaattttactctttttctcacatccagaataaatgtagtcttgttttacgtatcttaaactatatttgaatagtatcaaactggaacatgcttccccccgcccccaacattgtttctcagatacattcgttgatggatctagttctttatttcaactgttgaagagtatttcattgcatgaatgtatcataatttattattaattcctctattgcttgtttcataatttttactcttgtgaacagtgcttcaaagaatcatgaataggtgaaaatttccttgaggtatgtatctaggtatagaatggccagcatatagtatataaacttttaaacattttactaatttttttgaatcgttctttaaagtagtcccatcagtttactgtttcatgagaaatgtatgaggtttcacaaagacttgatattgttagacttaaagtactgataatctgatgtacgtagattatattacagtgaattattttgcgttttttggtattaggatatttttaaaatgaagagcaaattatttgttctctctttgtctgctttcactaataatggtgtgcttctaattacctagtctgttttcccattagttcatagttttattaaagaaatctctcttctacctactgttagatacaccaccccattatataaagttcatttggttaggtttattttgtgctaagcaactaaatagaaaatggaatgtttttattgtctttttgtgccctaaaaagagtcagtcagctcttggtaggggaaagaattaagcctgttgtctaggtgataacagtagaataatgcagtgagggagtgaaaaatcagggatctaagttgcagaaaattcagttactaacagcaattaattgaataaagaaaatgcaaagttatgaaaaacaccagtactttgattatattatccttgtagaatacagtcattcattgcttaatgatggggatgtgttctgagaaatgcattgttaggcaattttgtcatttacaaacatcatgaaatatgcttacacaaacctaggtggtatagcctactacccacctaggctgtatggcataggctattgctgtcaggctacaaactatacaggatgttactgtactgaatgaatattgtaggcagttataacacaatggcaaatatttatatatctaaacatagaaaaatgctgtaaatatgtggtataaaagataaaaagtgatataaggcacttaccatgaatggagcttgcaggactggaggttgcttcgggtaggtgagtgagtgaatggtgaaggcctaggactttaccatacaccactgtagagtttttaaacaatgtatacttaactacactaattatattaaaagatatttttctttcttcaataataaatttactttagcttactttaatttttttagtttataaacttcttgactcttttgtaataatgcttagcttaaaacataaacatattgtacaaaaatgttttatttctggcaggcatgtggctcacagctgcaatcccagtgctttgggagggtgaagcaggaagattgcttaatcccaggagtttaaaaccagcatggggaagataattacaccttatctatacaaaaaaataatttaaaaaatgagccaggtgtgttggtgtacccctatagtcccagccactctggaggctaaggaggaaagattgcttgagcacaggagtttcaggttgcagtgaactctgatctcaccactgcactccatccagcctgggagacagagtaagaccccatctcaaaaaaaaatacatatatatatatataaatatatatttatatacatatataaatatgtatataaatatatatttatatacatatataaatatgtatataaatatatatatacatatataaatatgtatataaatatatatttatatacatatataaatatgtatataaatataaaacacacgtgtgtgtttcttatcttcagtctgtaagtttcttttctattttatccttttactttgtaaacttctttgttaaaaattaagacacaaacattcattagtctaggcctacacagggtcaggatcatcagtatcactgtcttccacctccttatcttgtctcactaaataacacctgtggagctgtcatcttctatgttaacaacacctttttctgaaatactgcctgaaggaactgcctgaggctgttttagtgtcaacttttttttaataagtaggggtacaccctaaaataatgatgtaaagcatagtatagtaaatgcaaaaaccagtaacataatcatttattatcattatcaagtgttatgtagtgtacataattgtgctatagtttttttatatgattgccactgcagtaggtttgtttatcccagcatcaccacagtcatgtaggaatgccttttactgctactttatgatggctatgacatcactatttgataggaatttttcagctccattataatgttatggactcaccatcatatatgcagtttattattgactgaaatatcattatgcagtgcatgacttcaattatactctatttaatctcccttctaggtcctgatttttaaggtaatttgaaatcattttttctgcctttctctgttactatctgaattgcttcctaagaagattaaataagagtaaggactttttcctggatgttaaccgtaacattagcatgttattttaattaaattggtttattaaatataatgacatagttaaatattgatgggggaagggagtagtctgtattacatccagaggagggatggttctactggaacttactggacagctagatgacaatatgaagatctaaggaatggggaagagaagaaagggataagataagagatgctgaaaggtattcttaatagacttaagtattttacttgggttatgctcttttctataattttcactggctcattagaagtagaaaagtttataagtagagaatttaatagaagaaaggcaggtaatgttgttgagatgtgtggggtcagatctatcctgaaataaaaagaatctgatcacatttccttagtgatttaaaatagaaaaacagggtgatagaaataaatgtcagaagcagaaattggaagaaataaagaatggcaagtttaatgttggcaattggtcatcagaatcctattgttgttgttgttattttttttttaagatggagtcgcccaggctgtggtgcagtggcgcgatctcagctcactggaagctccacctccctggttcatgccattctcctgcatcagtctcctgagtagctgggactacaggtgcccatcaccacacctggctaattttttgtattttttagtggaaacggagtttcactgtgttagccaggatggtctcgatctcctgacctcgtgatccgcctgcctcggcctcccaaagtgctgagattacaggcgtgagccactgcgcccagccatcagaatcctattttaacttatatttgtagattttcttgtcatgccagttaattacatagtctgtttctggtatttcctatgttgacttgatcatagctgtcactaacaaatacttttatcttcgacctatttaatgtgttttttttttcttacattttatggagtgtttacatgatcccctcttacttaactttagtggactgtcaggattattgtcccatgcccattttgcctgtagtttttctttaattgcagtcgttctttttttttgtttttgtttttgtttgttttttttgagacggagtcttgctctgtcgcccaggctggagtgcagtggtgctgtcggctcactgtaacctccacctcttgggttcaagcgagtcttcgtcctcagcctcctgagtagctgggataacaggcactcaccaccatgcctggctaatttttgtattttcaatagagacgaggtttcaccatgttggtcgggctggtcttgaactcctgacctcatgatccacccacctcggcctcccaaagtgctgggattacaggcatgagccactgcgcccggccggcacagtcgtcctttttaacagtgtttattttagctcaaaacaaatgtatttattattcttgagtttcctttattattgctgaataacttcaagtaatttttgttttttcctcactaggtctttctttgcaaatattacttttagataagtttgtatgagtcttaaaaagctctttctatgtataattaaaacaagatagcacctttattttgactatgtaaataattgtatctcatagattcaaagctagcttgtgtttgcagaagacagtattgccatagtgaagtaattttaaagtaaaatttgacaacaactagactaggtctgtaggaggattttttattgtattaaggctcatactgtgctaagtataatattttttattttttgatgaattatattagaaactaatttttatttgtagttctactttatatattttctatattagagaaatttcccactaaagaatcttcattaacatttttctgcaagtgatttccgaatgtttctaaccctaaacagtttcctatcattgcttctaaacatttttttctttttaaatcttgctattgcttcgaattcaggttgtttgaactctttattatccttctcttctgctaccttgttcccaatccaactaccctacctaatttcctattcgtatcattggtattattatttttctggtcaataaaataaatgtttgttgaaatttacattttaatcctgctagctctgagatctttgggaaataatgtcttcaagtttcattatcttgtctataaagaggggagagcaatgtttcatgacatgagattggcaaaatgattagattaaatgagatagtgtaagtgatgcacttggtacagtgcctgtctcttagcaaatgatagttcccctgtaggtatatgggatcaaaagctcatagttgtttttgacacctttcttctctaaaccctctgtattgcattttccatcaaattttgataatcccagctttataatgttcacatatatttgattttattgtattctcttagctgaaatattgatccaggcgcagatttgctgtacattaatgtaaaggttgacttccttacagatttgtctccatactttcctttcttacaatacattcttttttttttttttttttttttgggatggagttttgccctgtcacccaggcagagtgcagtggtgtgctctcggctcactgcaacctcctcctcccaggttcaagtgattcttctgcctcagcctcctgagtagctgggactgcaggtctgcgccaccacaccctgctaatttttgtatttttagtagagacggggtttcaccttgttggccaggctggtctccaacttctgacctcgtgatccgcctgcctgggcctaccaaagtgctggaattacaggtgtgagccaccgcacccggccccttataatacattctgcgtattccagtcagatgactttttctaacattccacgtttgttatgccatgtatctgctaagaaagaacaacaacaaaaaaggaattgttccttattgtcttacttcacttagtggaaccatccattccatccagtttggtctgcttactcaaagactattaccattcttctttctgtgcccttgctcaggccaggccttcttcacaacgtcattcgaagtgtacaatgtttcttgcacttatttccaatttaattgtgtactgccttgtgtagttcttatattactgtcttctgtcaatattaaatttaatcatatactgtcacatcatagttttgttttattttctactgtaatttaactttctgattaggccattttcttttctaaggtataaattctcctatacttcttatcttctttgaattcattctgttattctatgtatgtacttcaatttcttataagaaaaacagcacaatttgagtttgaaatttacttttaaaattataattaatgaacatagtactttattaaggaatcaacaaaaagtgttttattcaactggcaggcaaacttttctatttccataaattagttttaccaaacttcaaccttatataaatggaattttgcattttactgtatactctttctgtttggcttcattttagttttttgagatttatctatattgtgctgtataaaataagtactgcattcttttttattgctgaatagtattccagtgtatgaggattttacaattttatacattctcagtttaagggacagctagatttttaatgattttttgctgttattaatagggttgcagtgaatatgcctgtacatatatttttgggtacgtatgttttcatttcttttgaataaatacttaagtgtgacttgctggattgtatggtaagttaaacgtctttgtccagactgtcacaaaggtggtgctgtactcttcccattgtatcccatcagattgcttattattttgggtttctctcattactaatgatgtttaaagatttaaatgtatgacttgagactgtcaaactactaaaagaaaacattgcaggatgctttaagacattggtttgggaaaagatttagtttctgggttttctttctgttttttttttttttaataatatctatctctgtttaatttctcattcaggtcatgaattgttttcctggttttaaaattatttatatgtgttcttttgtatcttgtagagtttccttaggatcattattataaactcattttcaggcatttgacatattttcttttctttggggtctgttactggagaattattgtgttgttttggaggtgtcatgtttccctgccttttcatatttcttgttcccttacattgatatttgcacatctggtgtaactgtcacttctaattttatggagtagcttctgtaaggaaagactttttcctgtagatgtagctgtaatgtttgttgggtagaatgttttcgcattggttctcggtgattgcaatggtgtagtttttgtatgatacttcacctgtaatcaacaactgcagtgtctgtgattcccttaatggcttagcctgcagttgtttgtggagattgtggtgagactttggtggggaaggggtcatcagccagactgatcctcaggcctctaggtgtcacgtgggggcaccaacagtggtggttgtgtgtcctgggtgagccaatcttaaggtcctaggtggggagccagtggtagcagtgtcaggcccttcctgattggccctcgcatccctgggccgggctacacagattctggtagtggcactggtgggttggtcttcaggtgcccaggcatcagtgtgtgttggtgactggccagtctggctggtccccaggctcctgggtgaggcgcacaggaaccagctataagattgctttttttaaaattaaatattaagagcctttcttaagctgtgtggtgtggctttcttcactcctgctgctgatttaccaccattgtttattagattgggacaagatcactaactactattagacatgtaccccatttttactgtatattgctgtataacaatggtggcttaaaatagcaaaagtttattatctctttcagttatgtaggtggactggatgtaggttgatagatttgtttccatctctgatgtggtgtctgctggatagctggggcatctaaaatagccttactcacatggttagcagttggtgcttgttgccagctagaactcagctggagctgttgacaatgttcacatgttctcttgaacatggactttgtatgattgtttgggctgtctcactgcatgggacctagattctaaacagaagtgttataggtgaccaattggtagctgcagttttcttaagacaaatccttagatgttacactgccacattccattggtcaaaagaggtcatagagccaattcagatttaacagataggggaaagtcatgctgaaaaagaacacgtgggatgagataatgttgtggcccttttaagaaatataatttacttaatttgaaatttcctgtgaaattttgaaacttactttgaaactttgaaagattattagcaattttccaaatagtttaacttcattattaagtgtattcaaacttcacagaagccagtatacaaagggaaatcccagatttaagtgatgagtttatataccattgtttaactggtcctctgagtgatcctgcatgattgataatccacactactgtctctctagacagaagacagactcagtaaggaaatgttttaagtgggtgtaattctgatatctgccattacaaaaacaacgacgaaaaagcaaatatttcttcttatttcttatcagcaaaagaaaggaatgaggtgtactggaattcctagcactgtgatactcaaaatgtcagtttttaaggcttttgtgttttagggaaacactcaaagaaaaaatttatgtgagttttcaggctgtttacttacattcttaagaaaaagtgattttaggccgggcacggtggctcacacctgtaatcccagcactttgggaggctgaggcaggcagatcataaggtcaggagatcgagaccatcctggctaacacggtgaaactccgtctctactaaagaaaaaaaaagaaaaagaaaaagtgattttagatcttttcaaagatttgtttaatgtgtatttgttcatattttaatttttaaatgtaatttctcactggtaaattttccttaaaatataaattgctccctggatatttgttcattattttgcaaagtacaaaactccattagagtttcatttaataaatattaagtacaatattgggaccccttattggcttatataaatcatataaacaggtgactgtttataggattcctttattttagctgccagtaagaagcctgccatgatttttttatgtctttggattccccatcttacctgccagctctagtatctattattggtagccataaaaaatactgacaatatagaccagtttgaattttcttaaatttatcacataggtataccatatcacctaaaaaagttaatgtgattacaaagatagctaatttatactcagtcagcagattcctttatttggctgtgtctccaagataaattaaaaataaaataataaaaataaaaaactatagttgagttataatattttactgactgaaatttaacttcagccaagctttaaaaaaattacacagtttatatcagtacatctttattttatgttctatacatgactccatgataagtgttcaatgtggatttcagaggatcccaaatgacacacacacatacacaatattgtattaaaaagtcagattggtaaggaccctgtagaaatcaggatgcttgcaacatggatttcagcaaagtttctgaaaagataattaacaagcaggctggtttatagaatatataataaggctctaaaaacacaattgggttttaacatggcaagttgatgtagcccaaacagtaaataatctggataatctattatcttgatttttaactgttttgattcagatatttctttgtaatgaaatttttggcaaattaaaatttcacaacgctactcttagaacaggatataggaatctcctcagttaacacccggactcctttgtcagatctaactgtagttgtaagtatttgccttgcttactttgatgctgcagtccttggtatgtatgatttccaaagaattgaagagtaagtttaataatcttgtcactttatttagcttggctcttcaattcattggttattgatattaagattttggtctttagaatatagggtgtgatttgacttatagttaataggttatacatggccatacttaaatctctaatgatatgcctttgcacttaggataaaatacaaaatctttgcagttatgtaacccggatttttaaatttcaagttagttatctttacaaatttttatatctttccaccttataataaacatgaaacattaatagattcagggaatgaaatccttttcttaagaagataagattaaaattttatgtcatcagaaaatataattttagggtactaaccagtaagatatagataaggaatgagacaacctatagataagctttacctgctttattaagtctaatgcatactagagacttttttattctttgagtttcaggaagttaaatttgttcctctgtctcataagatagtattatagtttgtgagaaagttctaatttaacaaacacttaaaaggactaccatgtttaaggcattttcttaagttccagaaatatagtctagctgaaaaatcaaaatcatgtgtattatatattatgaatatgtataatacagtgtaatgggtagaataatgggagcatgtttaaatacagtggggaaactggtaagtatgaggttaattttgtttgttgctctctgacaaaaatcttagaaagtcagtggcctttaaccctcagtacaacaccaaggtccattggattctgttttacttttgagtttctgtttttgagcaattctgagaatttataaggattgatattttatgacttttattattttctagggctcttccaaagagcaaagagaaaaagtgtttatttctgtacatatatatatatttaaattttatatttaccacctggatctattgggcctttttataaatctgtgatatatttttgtatcatagtgttcttgtatttcctccatcttgaaacattttgctgttctattattattagaattatttcatcattacttatcagctagctttcttcaactgcccttaaatagggggctgaggtgggtgaatcacttgagatcgggagttcgagaccagcctggccaacatagtggaaccctatctctactaaaaatacaaaaattagctgggcatggtggcacatgcctgtaatcttagctactcaggaggctgaggcagaagaattgcttgaaccagggaggcagatgttgcagtgagctgagatggcaccattgcaatccagcctgggggataagagggaaacactatctcaaaacaacaagaacaacaacgacaacaacaacaacaaacaaacaatgaaataaaaggaaaatgggagaatgatgaagtcatctagaagagtagtgcagtagttgaataaatggtcactattgctttatcctttagttttatcaagttgtccaaaatattgcatgatctttcatgaatatataaataaaagaagatcagagaccccatctttgtagtctccttttccagttgagaattcagaatttttaatttttttttcaaactttttttttgcttgggggtaaattttccctttaattcttcttttccataatgaaaaagttatgaaaattgagaagagactttaatatttactagtcaaatcagatatcagggctctaatgttaatggcaaaattggtcttagaagcagatcctcatactgagtcatcagatgacacattccaagatgcatttcttcagacaactatcaatgtgtgaataatgcatttctcaaaacaaaaagcagataacgtattcacattcagttagtgaagaacaggaaggaccttatcacacagtattttgcagcaagaacctggaccatctcattttgctaaaaggataggtaacatattctttaatcttttatgatttcgtgctcagattcattatatatggttcctaagtggacaaatactgaaggtaaatatatatatatatatgcataggtgactagaaggaaacagataatgtagaaatgaaaaaattattaattggtaattataagtggtgttataagtgtaaaaatgaaacttttgcaattatcgaacaaagaagatggccattttctcttcatcaaaactataagctaaaggtttaaaaaaaattcatcaggtgtgctgtattttgatgatgtcagttcaagaagaacaagaataatgataagttagatccaattagagatgtatttgacatctggaatcaatatgtacaagatggatgtgtctctggttcatacatgacaattgatgaagcgttagttgcatttagaagacattgaatacatatacattcaaaaccaaaactttctgatgaaatttcactgctcctttatttttacttctgcaatataaaatgacttgaacataaaaataaaattacatagtccatctgacccagctggtgaatggtgatgattatttttttttttggcatttgaaaagttaagctagaccttgaagcttattttaaagtttggcaaataaaaggcagaggcaagagaatagctagaaatatgtatgtgtgtacccccacatacacatatatatgtgtatatatgtaacatataaactatagatgatattttataaaatttatatatctaaattgatttataagtttatacatctacaaattttaacagatatatacatatgaaattttgtctgaaattaaagcttgccattgggagattttatatgtaaatgtaagtagtgcttatcgtatttctgtttagaaagtaactgggtattcattggagattaggttagagaagatattaaatgtagggatttaatgaaggatcacagatgacatagactggagttaaggcatttataataaagaagctgaaacacctaggtgcaatggatcatattcttttgttcattcctgaattgatttgtgtgtgagataattttttgtggcctaagaaatggttttgggctgagcatggtggctcatgcctgtaatcccagcactttgggaggctgagacacgcggatcacttgaggtcgtgagttcaagaccagcctggccaacatggtgaaactccattcctactaaaaatacaaaaaattggctgggcgtggtggcacgtgcctgtaatcccagctgttcaggaggctgaggcaggagcatcacttgaaccttggaggcaaaggttgcagtgagccaagactgcaccattgcactccagcccaggcagcagaatgagactctgcctcaacaaaacaacaacaaaaaaatgaaatggttttggaagacatttacaatagtttatttcctaggtcacattaaaaatgaacatgaaatgatattaattacttaacagtttttttatcctttggggttttttaactataccactctcttattgttatactatgaaatgtccaaagtgctactagtacttttgtttgaggcaaatattattcagagactaagtttgaccttgaacatcaccttggatttaatacaggctttcaagtaaatatttgattttaggaaaacctatgtgttgaggctttccttccaagtagaatggagtagctggtagcaaattagtacttctgcttagagcaatgagaaaatcaagataaaatatacatgtaaccattctgtatcagagttgaccttggggatgtatttcaagtctcagttgtatctgtagtaaagcttattcttcctctgttttgtcctaattatattggtaatcacattcaatataaattgactaattattaaaattgaatcactaagcttgtcaggctgtataaaacaagtaaaccccaattatatgctgcattcaagagccacatcttaaattaaatgggaggatgaagctaaaaggatgaatagatacactgtcctaacactgaaaggcaaactggtgtagctactatatccaataaggtagactataagataaagactaaatataggtggtccataacgtatgatggttcaacttacaattgtttgacgtaacggtggtgcaaaaatgatacacattcagtagaagctatgctttgaattttgatctttctctaggctagtgatatgtaatagaatactctattgcagtgttgggcagtagcagcaagctgcagtttccactcagccaagcagtcatgagggtaaataaccaacactctatagtatatgaaatgtatttttgacttaacaatatttttcacttacagtgggtttctcaggatatagcctcattataaagttaggagaatttgtataaaagatggatgttttataataataaaagggtaattgtatcaggaagttttcactatcctaaatctgcatgcacatagtgagatagtatatataaagcaaaaattgatagaagcaaaagaactggacaaatccccaaatatactgggagaatttatgatgctgtcagtagtaccaaccatcaatagctgatagaacaagtagatgacaaaaaaaaaaaaagagagaggtagagcacatttttacagcaagagtaataagtgacttaatttacaactatataacatttcactggaaaatatgagagtacacattcttttgaagttcagatggaagattaatcaaaattggccaaataggggatatagatcaataggtataaagatttagtgcaattaaaatgtcaaataggttttgggttttttaaagtaaaaaaatgactatctcttctgaaatttgtttagaaattcaaaggatcaaggataatcaaggcaatcttaaggagtaacaaaataagtgtaagagagagtaccaattgtcatcattttctgtaacacaatactagagttattaaaaacagtggtattgatgcaagaataggctggtgcaagaataggctagtgtaacaggagagagtatccagtgtggtaggcagaataatggccttcaaagatatccagccctaattcgtggtacctgtgaatatgtcacattataaggcaaaaggaactttgcaaatacagttaaggttacagacaattaagatagtaaaatgatcctgggttttctgagtgggcccagtctaatcacatgaacccttaagagcagagaagtttttccagctgaaagcagaatagagatgcagcagaagggggagtcattgattccaagcatgagaaagattctgtgcactattattgatgagatttaagggcctatgtaaaagactggagagaggcctctggttgctaaacatagcctctagcttaagtcagcaaggaaatagggacatcaatcctgtaaccaaaggaactgaaggaactggactgtgtgaagtagaatctttactgagccttaagagtacgagctcagcaggcagacattttgatttttgttttttttttttttgaaactgggagtagaaaaattagctgagctaacctggatttctgacttgtaaattgtgaatagtaaaattgtgttgttttgagctgcaaagtttgttctaatttgttacagaagtaaaagaaaactattacttccaggaacaggtctgcatatatgcttctacctgatttatgactgatttttttaagtataatggagaaaagaattttatttcaattcaatatccttatagaaaatatgcttattgacatacataaaaatccattttaggtacatcatagatccaactatgaaagatttaaaaaataaagcttttagatggaaacatggcagaatatcttcgtgatcttgggttagggaaagatttcttaataataggaaaaattgatacattggatcacattaaaaataagaactttagaaatctaaaaactgaaaggtaaatcatagaatgaaagaagatacttgtaatacatatatccaacaaaggactcatattccataacccaattttaaaaatgaataaaagacttgaaaaggcacttcacaaatagtatatgttcaatatgaacatgaaaagatactcaacataaaaaatcattagggaaatgcaagctaaaaccacagcaaaatatttctacacacccaccagagtggctaagtaaaaaagatgccttttccaagtgtttgtaaggaagttgtatagttggatatctgatacacaaattggtactaccactttgggaaactgggagtgtttactaaacctgaacatatatgttatctattacccaggaattttagttgtaggtatatatctaaaaggaaagtttgcttaagtttaccaaaggacatgtgcaggaatgttgatactatttgtaatgacctaaattggaaacaatccaaatgtctacttatagtagaatggataactaaatcatggtacattcatagcatggtatactgtacaatgagaatgaacagcatacaattaaatttaaacatagatgaatctcataaacttaatgttctgcagaggcatcagatacaaaaggaatgcctatggtatgattcatttttataaagttcagaaacagacaaaattaatatatagtgttagaagtcagtatttccttctgttgtgggtagagcaatgactgggagaaagtatgaggggagttttttttttttttaatcaaagatttagacactgctttcaagctctatatgtgtttgaggaattggtgttttcactctttttattctttttcttatgtagataataactatagttaattcactgttttacttcgatcagtttaataatactgattatgttcacgtttatttgagtcttgtacctgtaccaaccaggtagataggagaagtatatgcataatcaaagacagccaactgagccagctgagatttatttacaagtgatagcttaattatttgggggctttacattagttctttcaattaatcagttttttgctttcttgtctattcattggagtttacttctaaagctacctgtcctttgttgacatttggatttctctgtttaattatttagatttgggattagttctgtaaaattcacagaacgccttgggttacacttgagtttgggaacaagtaattacaagttatattaagattgtaaatgatctgtatactgcagacatcattcttctcaaatttctctttaagtatgtctaaattataacataaaccagtggtttagtatgcttttttagatactgatgatgctttgtgagactaattttattctctacccacatcagtatcttttctgattgccttgatgaaattagataaacctttatctatgccacccactaccaaagatgtttcacttttccttctatccttttaagggtatttatcacaatgtcaaagcaggaaaaatagtaataaacatagttatagaaataataacagcaaatggttataacatgtcaatcagtatttaaagcactttattgacttatttaacatatgaaacaactgagagaggtgtgattgttagcttaattttaaacatgagaaagaaagtctcagaccacaggttaactaacttgctgaaggtcacacatctattaaatgtatgtgtcagaattaaatccagattacctagtctttgtccttaaccactgtgccagtaaaagacagataaggagattttcaaagttaaaattcagtcactaactaaacaaatctgggattataagtttttcaaagttttgaataagctaatgattatatttaaatagtaataatttttaggtaaatttttttataattgcatatttaaaatactaatttaaattttgtagtaaggcatgtaaatgttgtttgccatactgtttcatgtttggaagtctgtttatgtttatcctttctttcccaatatataggaaaaggtaattcatgggccatcctaaaggagtgtgttaggttgttctgtagctttttgtagtagtatatttgtatgtaatgaagtgcatttttaaattgcacttgtaatttttaattgcttcttagaaattcctgaatatttaggaacttcataaaaatattctggaagcaagcattacctggataacatggtacttaaaaacctttcattatcaaggaaataaaaaatagaaaagaatgttggtatgaattataagaatggaaataatctaacagatatttatctaattacatttatccagatgagtttttctgatttgcttataatacatcacaacaacatctcagcctgtctccaggttggtacatctttatttaaaaatttgggccaggtgctgtggctcacgtgtgtaatcccagcgctttgggaggctgaggcagatgtattacctgaggtaaggagttcaagaccagcctggccaacaaggcgaaatccctcctcagtatactaaaaatacaaaaagttagccagccgtggtggtgggcacttgcaatcccagctacttgagaggctgaggcacaagaattgcttgaatctgggaggcggaggttgcagtgagccaagatcatgccattatactccagcttgggcgacagagtgagactccatttcaaaaaaaaaaaaaaagaaaattttttttaaagttatttaaactgattttatatgcaccatttatttataacaattttattttattttataatgttttacatttgtgtctctcattagatactcagactaaccctatgatctcataggggagatataattgtcccattgtttttacaaggggcctgatgaccagaggttaaaatgtatgtacagagtcactctacaaatatgccatataattatcatttgaaaccacatcttccgttctctgatacaatgcttttcccattgctccaggtcacttctcatatgatttgaaaaccaaccaaccaataacaactttacctatgattagaatcccatcatttaaagagtgacaatttagttacaaaagattaaaaagaattcaacagcaacaaaaaaaaactagattaaaattgggcaaggacttgaatacacatttgtattatacaaagaagatactcaatggccaacaagtatttgaaaagatgctcaacatctctaatcattaggcaaatgcaaatcaaaaccacagtgagatattacctcacacacctaagaatggctgctgtaaaaaaagaaaacaaaaccagaagaatcctgaaataacaaatgttggtgaggatatatagaaattggaacctttgtgtattgttggtggggatgtaaaatggtacatccattatgaaaaacagtataatggttcctcaaaaagttaaaaatagaattatgattgtacaattccaagaattgaaggtagggtctcaaagagatactgatatgcccatgttcatagcagcattatgcagaacagccaaaaggtggaaggaatgaatagataaaacaatatatatataaaatagataaaacaatatatatcttgagggcgttattctaaatgaaataagccagcaagaagaagacaaatattgtataattccacttacatgagatatttattgttgtcaaattcataaaaacagaatgtagaatggtggttaccaggggttcagtggagtaggaaatggggagctgttgtttaatgggtatagagtttcagttttacaagatggtgtttggtcacacaacagggtaattatatttaacagtaccaaactgtattcttaagagggattaaggtggtgaattttattttgtgtgtcttttaccacaattattatttttaaaattttatttttacagtgacacggtctcactctgtcacccaggctggagtgcaatggctctatcatggctcactgtagccttgagctcccaggctgaagcaatcctctttccacagcctcccaagcaactgggaccacaggcacatgccaccatacctggctttttttttttttttaatatttttttttaaagtcagggtctcactatgttgcccaggctggtcttgaattcctggtctcaggtcatcttcctgccttggccccccaaagttctgggattacaggcataagccaccacacccagccaaatgttttttaattttaaaaataaaataaattgtataggtagaattaaaaatacataaatcagatcatgccaaccctttaaagtcatctagtgtgcttaagataaaatttaaaatccttttaaaaaagatttaaaaatgtatagtaaatgcccacatgattctcacagttaggtgtgcttctttcattgtattaaggatgtataaattttataagactaaatatcgtgagatatttattattgaatatatagcaattcaaaatacagtagtccctccttttctgcaagggatacattccaagaaccctagttgatccctgaaatcacagatgttactgagccctgtatataccttgttttttcatttatatacatacctatgataaagtttaacttataagttaggcacagtatgagattaacaataactaataataaaatagaataattataataatataagttatgtgaatgtgttctctgtcaccctctctcataatattatattgtacagtactcacctggttttagacatcagttgatcataagtaactgaaactctgtaaagagaaaccacacataagggagactactgtattttatgaaatatgtatgtgcatattaaatggaaaatgttttaaaaatattcaaatgttaaaacattgcaaactgatttaaagatccactcacaaaggcaatcagcttgcaaattcaaaggaagttgctattacctgtattttctcagttataccacagtggagctattcataatgtatcagaaagctaggcgtcacagttggatattatgtatataaatcagttgatttttgactcaaataactgaagtgtgttttggagataagttttatgattggaattggaaatgactgaattttgtggagcaaagcttttaactgtgttcacttggagatattctatagtgctttgactctggtttactactgtgcccagtggggtagatatttttttaaaaagacacgtattcaggaaaaaattttatttataaagattacaatatttgctcttgaaaataagaaataatgttagtcaaagaagccctgaatattactgtaaatcattgtacatgtattagtccttatggatttctttgcactagtaaaaatataattattcattttatttatataaggtctttgtgctgctgtaagaaaataccaccaatggtaatttacagtcaggcactgcatatttcaatcagtggtggacaacatgtgcaaaggtggttgtagaagattataatacagtgtatttactgtattttctgtgtttagataggtatttaccactgtgttacagctgcctacagtaacatcttctataggtttgtagcctaggatcaataggctatactatatagcctagctgtgtagtaggctatactatttagatttgtgtaagaatagactgtgaggttcacacaatgatgagatcacctaatgtcatatttctgagaacatatccctgttgttaagcaatgcatgactgtataagaaacactcaataaataatgtatggtagaaggtgattaaataccaaaataaatgaaaaccattaaagtgggcttaaaaacaaagtctcataattttagttactcatcacataaaaatgctttagttgttgcctgttccctaacagataagtgaatgttcacctaaggagactcaggagaaatccccaatactgagacaaacccagagattgagggataactgttctgattcagagggttttgtttgatcttacccctaaactttacaatgaaagtatgtttggtaatacagttaatataaaaatcagggttggctgggtgtggtggctcacgcctgtaatcctagcactttgggaggccgaggccggtggattgcctgagctcaggagttcgagaccagcctaggcaacatggtgaaaccctgtgtctactaaaatacaatcgaaattagcagggcgtggtggcgtgcgcctgtagtcccagctactcgggaggatgaggcaggagaatcgcttgaacctgggaggtggaggttgcagtgagccaagatcacgccactgcactccaacctgagcaacagagtgagactccatctcttaaaaaaaaaaacaaaaacaagcaggggtccccgacccccggaccatggaccagtagcagtccgtgacctgttgagaactgggctgcacagcaagaggtgagcagcagatgagcaagtgaagcttcatctgtatttacagccactccccactgctcacattagcacctgagccctgccttctgttagatcagaggcagcattagattcttattggagtgtgaaccctattgtgaactacacatgtgagagatctaggttgtgcactccttatgagaatgtaatgcctgatgatctgaagtggagctgaggcaatgatgctagcgctggggaacagctgcaaatacagattaacattagcagagaggtttgactgcacagagaccatagtaaatcaattacttgcagactcatttcaaaacccaatcagtgagtggcaggtggcaagctgcatctgacgtcaagctttatagtggcaagtgaggtgatgtacttcaattgtacagctgcatctggtggtaacgctttaagtcagaatccagcacttcttttaattcatgagtggcctgcttattattttatttaccactttcatctgcttctctttcctgcattacacacttttcttagtcagagttttggtaaacccaccagctaaccctacccaaaataagtaaaagccaaacatcactggagagcttctttgaaaagggagacagacccaatgatgagatagcagaagactctaagactgccaaccaaaaaaaaaaaaaagctgcatttaaaagaaaataccgagagtcttacataagttatgggttcattgcagtaggtgatttcacattctcagagcctgctttgtgtaatatgtggtgactggctgtccaaagccatgaaaccttcaaaactgcttcaccacatggagactacacgccctgcattagaagacaagcctttggagtttttcaaaagaaaagaacatgaacataaagaacagaagcaattactaaaggccactatttcatcaaatgtgtctccactgagaccatcattcttagtggctaaccacattgctaaagctaaggagccctttacatgaagagttgatcctgcctgctgctaaggacatatttcatgaacttttaggagaggctgcaattcaaaaggtggcatatcttcccctttgagctagcaccctaactagacgaatcaatgaaatagcagagtacatggaggcacaactgttagagaggattaatgaatcactgtggtatgcaatccaggttgatgggtctaccagtgttgacaacaagggaacaatgcttgtttttgtatgatgtatttttcaggaggatatacatgaggaaatgttttgtgtgcttttgttgccaaccagcaccacagctgcagaactattcaagtctttgaatgattacatatcaggaaaacgaaactggtcattttctgtcagcatatgcacagatggagcagctaccattacttgacagctttttggtttcactacttgggtcaaagaggtcgcttctgaatgtgagcctacacaccctgttatccttagagaaatgctggctagccaaaaaatgtcacctgaacttaacagcattttacaggatgtgattaaaattatcaaccacattaaaatacatgcccttaactcacatctgtttgcgcagctctgtgaggagatggacacagagcacacacatcttctctaatacacaggagtgagatggttttctaaaggtagatcactggccagagtttgagttacaagagccgcttcagagatttcttttaggagaatagttcttttcttttagaaaaacaatcaccactggcagcacatttcagtgacacagaaagggtcccaaaacttgcttacttgtgtgacctattcaacctgcacagagaactcgatctgtcgcttcaggggagaacaacaagtgtgttcaagtcggcagataaaatggctccattcaaaaccaaactggaattatgggggtgatgaaggaacattgggatttctgacatgtttcaagcattagcagagattttgagagactgagccagggctgcctttctctcagctagtgtatgatcacctatctcggctttcaaaagagttgagtattacctcccaaccacaaaagacccccgaactggaaggaatggatttgtgacccattcctgaataagtcaggtgaattgcctttgtccttgctagaagaggatccactgcttgacttcaaattatggtggccttaaaagtatgtttgagacaacttcaaatctccatatgttctagactaaagtcaaggcggaatatcctgagattgccacaaaagcactaaaaagcctgcttccattgccaacatcctgtctttgtgaagcagggtttcctgcagtgacagcaaccaaaatgagattatggagcagactgaatataagcaacacattttgggcgtcactatctcccatcaccccgagatgggaccatctagttgcaggaaaacaagctcagggctctcactgattcaacattatggtgagttgtataattatttcataatatattacaatgtaataatagaaataaagtacacaataaatataatgtgcttgaatcatcctgaaaccacttccccacccccagttcacggaaacattgtcttccatgaaactagtccctggcgccaaaaaggttggggaatgctgaaaaatgaaatccatctttctttgcattctttcaaaagattgagtctttcagaatatagaggggggcctataatgggatatattcattaactcatgcaacaaatatttattaaacacctatcatatgccaaacattgtggttaccagggagatagagtgataaacaatatagacatttgcaaaatattcacttcattcccctattgataagcattgatgcatcctgtgtcatatagaaaaggaggaaaattattattcggtaatattatagaacttaatgcaatttaagcaaatgcgtgtatacaaatgtgtatattttgtatatatttgatataatataccatatatatataatatcattctatgtaacctaccacatgttcagaatctgctgcagagattttttctgtgacacaaagaaacattaaatgcttatgcttcttttgttttttgtgggtttttttttctgtttttaaactagggatttggttatcctgcaaattatgaatttacttttgttttaatattctaaagctatacattaatattatttgccacatattggctgagagctattgaatcctttatagtgtaacattcttggcctaacagtctgcatttcccaggctgccagcaaagcaattcggtggggcaattgtggtcatgcaggggccttgtgagcggttggcagagagagaagcatacagatcagacagactcctatcctgcaggaaaggtagccctcctttctcccatcccagcagtcagcaggaggtagagccgctcagagctatatgaagagcctttgggaataggtgcctatggttatgttttgctgcagctgccctatattcacaacctcctgcattccatgcaggcttgacctctgcctctgcctattctctgggcagttctccctgtcaattcagctgtctgggggtcatgggatcccagaggtagctaggatgccagtgtgtttctctgcagttccttcacttacacctttcttaggaactgttgagggctgggagctggtcctggtactcggcaatgttttgcagtgttcccagcatcctccctcttctacctcagtgtcagtagtacctttctatcaactttcagtgttttctttaaaaagaaagtgtgatggtttactggatattttgggttcagtgaagtgggagaggcactttctggctgcatttagtcagccatcctgctccatagtcattggaattatctttctaaattttattttctgattgttgttcctggtatataaaattataattgattttttaattaaactttttagatagttgtagaattacatgtggttaaaatattttctaaagagagatcctctgtaccctctatccagtttcctcaaatggtaatatttagcaaaacagtacagtgtcacaatcaggagtttgacactgacccagtgaagataaaggacattttcatcaacacaaggatccctcaatttgcctatttgtaaaatacccacttccctttccccatctcccacctgaactccttgtaaacactaatttgttctccatttctataatattgttaaatcaagaaacttatataagtggaatcacaccacatgtaatcttttggggttgtgtactttctattagcataattatctagatatttatccatactgtatatcaggcgttggccacattgtatgacagagaagtattccatggtatggatgtgccacagtctaacattcactgattaagggaaatctaggttgctttcaattgtgggtaaatacaaaactactgtaaccccctatacaggttttgggtattaacacagttttcttttctctgggataaatgtccaggggtgcaatagcagagttggcatggtaattgcctatttaattcttaaaataactgctaaaatgtatgcagaatgactgtaaaattgtgcattccaaccagtgaactatgaatgatccaattctttccatcttcaccagcattttttagtcactattttaaaaaatgtagctattgttatagatgtgtgatgatatctcattacatttttttgtttgtttttgtttttttgagacagtcttgctctgtcacccaggctggagtgcagtggcacgtgtgactcagtctcccaagtagctgggattacagatgtgcgccaccatgcccagctaattttcatattttaagtagaggtgaggtttcagcatctatggtctcgaacccctggcctcaagtgatccgcctgcctcagcctcccaaagtgctggaattacaggtgtgagccaccacgcctgttcttattatgattttaatttacattttcctaatgcctaagatgttgaatgtattttccatctgcaaatcctcttgaatgaaatgtctctttataccttttgctcattttctgctttttttgttattgtcatgttcgagggttctttatattgtctgcatgccagtgttttcttggatacattgtttgcaaaatgttcttgtttcgtagcctcttctttcactttcttaccagggtttttcacacggtgaaagttttaaattttgataaagtacagtttatctatacttccttttatggatggtgctttttgtgtcaagtataaaaattccttgtctagcactactccagaagattttctcctatttttcctaaaacttttatagttttacacttcatatttaagtacaatgtccattttgagttattttttatgtaaggcatgagataggtcgaggtttttgcctatggatatgcacttgctccagcaccatttgttgagttgcttttttacttatgtgtaaaatcggttgggcatatttgtgtggggtctattcctggtttctctattctgtttcactgatttatatgtttatctttctggctaataccacacagtctttattattatatctgtatatgtcttgacattgagaagactgatacctcacacttaattctttttcaaaattgttttagctattataattcctttgcctttccatgtaagttgtagaataatattgtctatgtatactaaaaatactcactgtaattttgattggtaacaagctaagcttttgttattaatttggggagaattaatatttttaaatgttgagtctaacaatctgttattctgtatatttatttattagatctttgatacctttcaccaacattttgtagttttcagcacgcaagccctacaacgttttgtagatgtacacctacctatttcattttttttaagcaatgataagtggcattatattttaatttaaagattcatgtgtccatggctaatatatacaaatgtaattgattttcatatatcagtcttgtatcttgtggccttgaagaactcccttattctaggagttttttctaggttccttgggattttctatgttgacaaatgtgccatttgcaaatagggacagtttatctccttctttccagtctgtttgcttcttatttccttttattgccttactgcacttgctaaatattatttacttcattgaataagagtagtgagagcatatatctttttttttttgttcctggtctttggggaaagcattcagtctttttatcattaagaatgatgttagtagatttttaaacaatgctattttttaccaagttgaggaatttcctttttcttctcatctttttgagaatttttatcatgaattggttgaattttgtgaaatgctttcccgcattgattctataatcatgtgattgtgtttcttcaaactgttaatatgatgttttacattgattgatttttgaatattgaaccagccttgcatacatggaataagcaccatttagtcacgatatatagttctttttatatgtaattctgaattcttttactaatattttgttaaggatcttttggatatatattcacatgagaaatatttgtctttgggttttgttttattatactgtctttgtttgctttttgcatctgcgtaatattcccttcataatatccatttggatattccctcctttgattttctgatagagatggtttagaattggtgtaaattttgtgagtatttgtttggattttccagtgaaagaattattgcctagacagtttttggaggagttttaaaatacaaatccaatgatcttaatagttgtaggtctattcaaattactgatttcacattgggtgagtatttggtagcctgttgttcttttgaggaattgcctgtgtctcttaggttaacaaactgatgtgtgtagagtggtttgtagtatttccttactatccttttgattcctacagagtcggtagtgatatctctcctgtttctttcgtgatgtgggaataggtgtactttattttattgggctttacattttgactctgctcaaagattgtgctttttacatatcaaaggtttatggcaatcctgcatcaagcgagtctgtcagtgccattttttcaacagcatgttttcattttgtctctgtgtcacattttggtaattctcacaatattttaaactttttaataatgactgtatctatgatggtgatctctgatcagtgatgtttgatgttactcatacaattgttttggcttaccatgaaccacatccatagaacatggtgaacttaatcaataaatgttgtgtgtgttctgtttgttccacttaatgaccatttccccatctctttctctctccatgggttttcttattcactgagacacatcaatactgaaattaggccaaataattaccctacagtgccctttaagtgttaaagtgaaaggaagagctacatatctctcactttaagtgaaaagctaaaagtgagcaaatttactgagaaaggcatgtcacaagccaaaacaggtcaaaagctaggcctctcgcaccaaacacttagccaaggtgtgaatggaaactaaaagtttttgaaaaaaggtaaaagtgctgtttcagataacacatgaatgataagaaagtaaaacagcttaattgctaataaagagataattttagcagtctggctagattggactagccacaaaattttcttcagccaaaacctaatccagggcaaggcccgaattctcttcagccctacaaaggctaagtgaggtgcagaagttgcacaagaaaagttggaagctagcagaggttgcttcctgaggtttgaggaaataagtcatctctgtaacataaaagtacaaggtaaagctgcaagtggtgatttaaaagttgcagcaagtcatccataatctagctaaaatcattgatgaatctttagtggctacactcaacaacaggttatcaatatagatgaaatagccttctgctgtaagaagatgccatctaagactttcatagctagagataagatatcaatgcctggcttcaaagcttaggctgactcatgagttagtggctaatgcagctggtaactttaaattgaagccattgctcatttaccattttgtaaatcataggtcccttaagaattatgctgaatttactcttcctatgctctataaatgaaacaacaaagctaaatcacaatacatctgtttacagcatgatttactaaatactttaagtccactgttgagacctactgctcagaaaaatagattaaaaaaaatactgctgctcactgacagtgcccctcgtcagccaagagctctgatgaaaatgtacaaagagaataatgttgttttcatggctgctaacacaacatccattctgcagcctatggattagggagtaattttgagtttcaagtcttattatttaagaaatacattttgtcaggctatagctgccatagatagggattgctgtgatagacctgggcaaagtaatttgaaaacattttggaaaggctcaccattctagatgccattcataacattaatgattcatggagggagttcaaaataccagcattaataaaactttagaaattgattcgaccctttatggatcagttcgaggggtttatgacttcattggtggaaagtagctgcagatgtggtaaaaatagcaagagaaatagaattagaaggagagccggaagatgtgactgaatttctgcaatctcatgataaaattttcacagatgaggagctttttcttatggataatcaaagaaaggtgttccttgaggtggaatctactcctggtgaagatgctgtgaatattattggaatgacaaaaaaggatttagaatatgacataaacttacttgataaaacagtggcaggatctgtgaggattgactcttccaattttgaaaaaaattctgtgaataaaatgctattaaatagcattacatggtacagagaagtattttgtcaaaggaagagtcaacctgtggggcaacttcattgttatctttctgttgcaaccaccaccatgatgagttagcagccatcagcatcaaagtaggaccctccactaacaaaaactttacatctcattgaagggttagatggtcattagcattttttgcaataagatcttttaaaatcaaggtatgtacattttgaaaacgtaatcctattgtacatttaataaactgtagtatagcataaacataactttatatatgcactggaaaaccaaaaagttgtgagacttattttgtcataatattcattgtattgtggtggcctagtactgaacatgcagtacctccaaggtgtgcttgtaatttgtttcttttctgtttttctctttgtcagtcttagaggcagctttttttttttaagatccagctttttgtttcattgttttattattttgctgtttttaatgttattggtttgtgctctttattatttccttctttctgcttgatttagttttattatgcttgtcaatttctagattttatgcttatattattgatttgagacttttactgttttcaaaaaaatgcacttattgctatattgtccgtatagcactacttttcctctattccaaaatttttgatatatcttattttcatattttttttcagtttacagagtgtgtgtgtgtgtttgtgtgcacgcgtttaatttctcttgagatgtgctttttgtttcatggattatttagaagtctcttgtttagatttcaaatctgtgccttgtctggtatgtttctgttgtttccattctggtcaaataatattttgggtattatttcaattattttacaataattgatttttcttttaagatacagaacatggtctatattgaaataagttctgcaggcatgtatttgctggttttgactagagtgttctttaaatgtcagttatgtcctggtggttgatactgttgagttcttctgtatctttgttgattatataactagttctttctaattttgtgaggcttcttgatgtctccaactatgtttatgtcttttctttcattttttcaggtatatcagttttgcatcacatgttttgcagctttgttgtttgttatatacacctttaggattgttttgtcttcccgatggattaatttttttatcattatgtattgtgcctctctgtctctggtaatttcttttcttttgaagcctactttacctggtattaatacagccactcctgctttcttatgtctacttggtagatctttttccatgtttttatagtcaacattcttgtatctttatatttttagtgagtttcagatggagagcatatttttgagtctgcctttaaattcactctgctaatctctttcagttggtgtatttacaccatttacatttatataattaattatctgtaggagcttaagtctcccactgtatttcttgtattttgtttgttctcacttgtttctctttttcctttttcctttcttcttgggagttatttgaatatttttaggagtttcatttttatttataaatatttttaatgatatctcttttctagtggttgtttattggttactctagtgtatgtgtgtgtgtgtgtataaaattttatcaattttatcaattcatgtgaagtgtaggaaacttaaatttatatctcattaccctctcaatacaattgcctgaaatatttcttgtacgtacatatagactcacattagacagtgagtctgtgagagtctataatagtttcctgaaatattttgtacatacatatagactcacattagacaatgttacagtttttgcttcagcattcaaacataaaagcccaagatgagaattttgtctgttgtatttacccatatatttgcctactattataatgtttttcttcctgatgttccaagagttcttatttttttgcttactttatgtttagaaatctttcattgaccattatattagggttggtatgctggtaaaaagttttcttagtttttcttcatcaaagaatgtcgtaattttttttttcatgtctgaagagtatttttactggatataggatgtgggttcacagttcttttatttaagcacttcaaaaagtacttccagtggggcgccaagatggccaactaaaagcagctatggtgtgtggctcttacagagaggaacgaaagggacgagtaaatgcagcacctttaactgaaacatccaggtacttgcattgggactgatcagggaaacaactcaacccacagagaatggagaagagcaggacagggcagggcagggcaacagcttacctgggagcaacatggatacaagagaacctacccctgcccagggaagcagtgagtgaatatgtgaccctgggaaaccatgcccctcccacagatctttacaagtccggtcaggagatccccttgtgaatccattccaccagggccttcggtctgacacacagaactgtgtatagtctcaacagaaaagctgctcaggcatgcatggagacccgggaactttacatactctggctctagtatccctaacaaaggtgattgcaacttaggcagggcgggagcttggacatccatatttacccctaggaagggatctgaatccagggggctaagaagcattgatctgtgggccccatttccacagcttctcacaggataagacccactggcttggaatttcagccagcccccagcaacagagttgtacctacctgggacaaaacagagttgctggcgggaggggcagactaccatctttgctgcttggataactcagccattccagcctgtgggcttaggcgagtccaaaccaactgggcatggaagggatcacctagcacagcaaagctgctctaccaaaatgtggccagactgcttctttaagagggaccctcaatccaaatcctcttcttgggtgttacctcccaactgacagagttttgatttctctttgggactgagtgcctgcggggaggggcaggctaccatctctgctgtttggacagctcaacctttccagcctgtgggctttggagagtccaaaccgaccagggcagaagggatcccccaacacaacacagctgctctaatacaacatggccgactacttctttaagcagaaccctgatccgttcttcatctctgagcaggacctcccgactggaccctccagccaccctcacttgtattctctggttcacaatgttttgatttcaccctgggactgagttcgagggggaggtgggcgggcgccatcgttgctgtttgggcaactcagcattctgtcctgtgggctttggagagcccacgcccaccagggcagaagcagtaccccagcacggcacagctgctctatgaaaccatggccatcctgcttccttaagcagtccccgatctattcctccttgcagggcgggacttcccaactgtgtcctccagtcactcccatggatgttctgtggctaagaggtttgaaaacttcctgggacagagctcctagagggaggagtgggctgccattttttctgtctcagcaacttccgtagtttacagactttggagagcccaagctaactaggggcagaagtggtacacccacacagcacagctgctttataaaagtgtggctagactgcttctttaagcagatccctgatcccactcttcctgactgggtgacacctcccaaccagtgtctccagccaccacctaccacctggttgtttgggccagcaaccaggtctgtacccctctgggacagagctcccagaggaaggggcaggctgccatctttgcagttttgcagccttcactggtgataccctcaggtactggaaaacctaaggcgactagggactagagcagatgcccagcaaaccacagcagccctgtgaaaagtggccagactgtaaaaaggaaaaaaaaaaaatccaaagatcagcctcaaagattgaaggtagatgtgcccacaaagataaagaatcagcacaagaacgctgaaaactcaaaaagccacagtgccctcttctgttcagatgaccacatcacctctccagcaagggtttggaattgggcagaggctgagatggccgaaatgacagaagtagacttcggaatgtggataaaattgatgttcattctgctacagctgcaccttctaactcaatgcaggaagctacagatcatgataaaacatttcagcaactgacaaggtaaaatagccagtatggagaataacgtaagcaacctgatagcgctgaagaaaacaacagaagaagttcataatgtaattccaagtattaatagcagaatagaccaagtggaggaaagaatcccagagcttgaagactgtctttctgaaataagacaggcatacaggaatagagaaaaaagaatgaaaaagaatggacaaaacctctgagaaatatgagattatgtaaagagactgaatatatgactgattggtgtacctgaaagagatgagaagaatggaaccaacttggaaaatatatttcaggatatcttccatgaggacttccccaacctagctagacagaccaacattcgatttcaggaaatgggagaacccctgtaaaatattccacaagaagatcatccccaagacacataatcatcagattctccaaggtcaaaatgaaagaaaaaatgttaaggacagccagagagaaaggccaggcaacctacaaagggaagaccatctgactaacagcagacctctcagcggaaaccctacatgtcagaagagattggaggccaatattcaacatgctgaaaaaagaaaaattccagcccagaatttcatatgtgcccaatctaagcttcataagcaaaggagaaataagatactttccagacaagcaaatgttgaggaaatttgttaccaccacacctgccttacaatagctcccaaaagaagcactaaatatggaaaggaaaaatcgttaccagccactacaaaagcacactggagtacacagacaaatgacactataaagtaaccacaagttattttaaacaagtctccaaaataaccagctaacatcataatgacaggatcaaatctgcacataacaatactaacctcaaatgaaaatgggataaatgccccaattaaaagacacagagtggccagctggataaagaaacaagacccaatggtctgctgtcttcaagagacccatctcatgtggaatgacacacataggctcaaaaaaggatggaggaaaatttacaaagcaaatggaaaacagaaaaaagcaggggttgcaatcctgttctgacaaaacagactttaaccaacaaagatcaataaagacaaagaagaagggcattacataatggtaaagggttcaattcaacaagaagaactagctatcgtaaatatatatgcacccaacactggagcacccagattcataaaccaagttattagagaccttcaaagagacttagactcccacacaataatagtgggagactttaacaccgcactgacaatattagacagactgagacagaaaattaacaaagatattcaggatctgaactcagatctggattaaatggacctgatatatatctacagaactctccactcaaaaacaacagactatacattcttctcatcaccatgtggcacttactctaaaaaagatcacataatcggaagtaaaacactgctcagctcagcaaatacaaaagaactgaaatcataaccaacagtctcttggaccagagcacaatcaaattagaactaaagtctgaagaaattcactcaaaaccacacgattgcatgaaaattaaataacctgcccctgaatgacttttgggtaaataatgaaattaagatggaaatcaagttctttcaaactaataaggacaaagatacaatgtaccagattctcagggacacagctaaagtagtgttaagaaggaaatctatagcagtaaatgcccacatcagaaagctagcaagatctcaagttaacaacctaatgtcacaatgaaaagaactagaaaatcaaaatcaaacaaatcccaaagctagaagaagacaagaaataaccagaatcagagctgaactgaaggaggtagagacaagaaaagccattaaaaacatcagtaaatccaggagttgtttttttgaaaagattaataaaataggccactagatagactcatgaagagagaatcaaataaacacaatcagaaatgataaggtggatattacgattgtccccacaggaatacaagcaaccatcagagaatattataaacacctctatctgtatcaactagaaaatctagaataaatggataaattcctggacatatacaccctaccaaaagtgaaccaggaagaaattgaatccctgaacagaccaataacaagttctgaaattgaggcagcaataaatagcctaccaaccaaaaaaaaaaaaaaaaaaaaaagcccaggaccagacggcttcacagctgaattctaccaaatgtacaaagaagagctggtaccattcctactgaaactattccaacaaattgaagaggagaaactcctccctaactcattctatgaggctaacatcatcctgacaccaaaactttgcagagatacaaaaacaaaagaaaacttcaggccaatatccttgatgaatactgatgcaaaaatcctctgcaaaattctagcaaactgaatccagcttatccaaaaagataaatcgagctttatctcaaaaaactgagtgaacaggcaacctacagaatgggagaaaatttttgcaatctactcatctgacaaagggctaatatccagaatctacaaagaactcaaacaaatttacaagaagaaaacaaacagcaccatcaacaagtgagcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaagagtcaggaaacaacaagtgctggaggggatgtggagaaataggaacacttttacactgttggtgggactgtagactagttcaaccattgtggaagacagtgtggcgattcctcagggatctagaactagaaataccatgtgacccagccatcccattactgggtatatacccaaaggattataaatcatgctgctataaagacacatggcacacatatgtttattgtggcactattcacaatagtaaagacttggaacctccccaaatgtccatcagtgatagactggattgagaaaatgtggcacatgtacatcatggaatactatgcagccataaaaaaggatgagttcacgtcctttgtaggggcatggatgaagctggaaaccatcattctcagtaaactatcgcaaggacaaaaaaccaaacaccgcatgttctcactcataggtgggaattgaacaataacaacacttgaacacaggaagggggacatcacacaccggggcctgtcgtggggtagggggaggggggagggatagccttaggagatatacctaatgtaaatgacgagttaatgggtgcagcacagcaacatggcacacgtatacatatgtaacaaacctgcacgttgtgcacatgtaccctagaacttaaagtataataaaaatatatatatataaaatattaataaatattgaatcttccaaccacccaaaaaaggaaaagaatgcacaatatcttattaataattttatatggtttacattttgaaatgataacattatgaacttactgtattggattaaataaaaacattttttaataaaaaaaaaagcttgtccaccagagttaaataggctttatccctgggatgcaaacttggttcatcattgcaaatcaataaatgtgatttatcacataaacagaactaaagaccaaaaccacttgattatctcaagagattcagaaaagatttttgataaaattcaacatccctttacttgaaaaactctgaccaaactagatactgaagaaatgaatatacctcaaactaataagagccatagaagacaaactcacagccaacatcatactgaatgggtaaaagctggaagcattctccttgaaaaccggcacaagacaaggacgccctctctcaccgctcctgttcaacatagtattggaatttctggccagagcaatcaggcaaaagaatgaaataaagggcattcaaataagaagagaggaagtcaacctatccctgtttccagatgacatgattctgtatctagaaaaccccagtcgtctcagcccaaaagcttcttaagctgataagcaactttagcaaagtctcaggatacgcaattaatgtgtaaaaatcactagcattcctatacatgaacaacagtacaagtgagagccagatcataaacgtactccccttttcagttgccacaaaaagaataaaatacctaggaatatagctaacaacaaagcgaaagatctctgcaaggagaactataaatcactgctcaaacaaatcagaaattacacaaagaaatggagaaacattccatgctcatggataggaagaatcagtattggtaaaatggccaaaatgcccaaagcaatttataaattcattgctattctgattaaactaccattgacatctagttctgtaaactaccattcacagaactagagaaaactattttaaaatttgtactgaaccaaaaaagagcctgaatagcccaagcaatcgtaagcctaaaaaacaaagctggaggcatcacactacccaacttcaaactatactatggggctacagtgaccaaaatagcatggtagtggtacaagaatagacacataaccaaaggaacagaatagagaatccaaaaataagactgcacatgtacaactatctgatcttgaagaaacctgacaaaaacaagcaatggggaaaggattccctattcaataaatggtgctgggataactggctagccataggtcgaaaattgaaactagacccttcctgacaccatacacaagaattaattcaaggtggattaaagacttaagtgtaaaacccgaaactataaaaaccctggaagacagcctaggcaactacattcaggacattaggtactggcaaagatttcatgacaaaagtgtcgaaagcaattacagtcaaaccaaaaattgacaaatgggatctaagcttctgcacagctaaagaaactatcaacagagtaaatagacaacctacacaatggcagaaaatttttgcaaactatgcatctgacaaaggtctaatatctagcatctataaggaacttaaatacatttagaagaaaaaccaccccattaagacatgtgcaaaggacgtggatacttctcaaaagaagatgtacatacagccaacaaacatatttagaaaagctcaacatcactgatcattagagaaatgcaaatcaaaaccacagtgagatatcatatcctaccagtcagaatggctattattaaagagctgaaaaataacaagacgcttgtgaggttgtggataaaaggaaggcttatacactcttggtaggagtgtaaattagttcagccattgtggaagacagtgtggcaattcctcaaagacctaaaatcagaaatagcatttgacccagcaatcccattactgggtatatacccaaaggaatataagttgctctgttataaagacacatgcacccatatgttcattgcagtacttatgacaatagcaaacatatggaatcaacccaagtgcccatcaatgatagactggataaagaaatgtggtacacatacaccatggaatataaggcagccacaaaagagaatgaagatatgtcctttgcagggacacggatggagctggaagtcattatccttagcaaagtaacacaggagcagaaaaccaaatattacatgttcttacttaggaatgggaactgaatggtgagaatacatggacacgtatagaggaagaacacacaccagggcctacttgagggtagaaggtgggacgagggacagtatcaggaaaaataactagtggatactagtcttaatacctgggtaatgaaataattgttacaacaaacccccatgacacacgtttacctgtgtaacaaaccttcacatcctgcacttgtacccgtgaacttaaaaaagaaaaagtgcttccttctagcctttctggtttctggtaagaaattgattgtcatttgtattacctttcccactttcctgctgttttttttttttttctttttttgagacagagtgtcgcactgtcgcccaggctggagtacaatggcgttatctcggctccctgcaacctctgcctcccaggttcaagcaattctcctacctcagcctcctgagtagcagggattacaggcagggtttggctatgttagctaggccggtcctttcctgctgtttttaaggtatttccagccgggcatggtggctcacgcctgtaatcccagcactttgcaaggccaagacgggtggatcagctgaggtcgggagttcgaggccagcctggccaacatggagaaaccccatctctactaaaaccacaaaaattagctgggcgtggtggcgcatgcctgtaatcccagctactcaggaggctgaggcgggagaatcgcttgaacccaggaggcggaggttgtggtgagccgagatcgtgccattgcactccagtctgggcaacaagagtgaaactctgtctcaaaaaaaaaaaaaaaaagatatttcctttgtctttagttttcgaatatttggccatcataaatcttggtgtggatttcattaactgtaccctctttcaggttttttaaactcttgaatctctatattgagttgttatttttttttaaatgtatcctatccttttatccctcttctttgacactcagatgatattaactttagttcttttgttattgtttgacaattcttggggactttatttttttttccaaaccgttttcttcttttccagattggatgacttctagtgtgttatctcctagcttgctgattgttttcgcatgtttctttcattctagtattgagcacatccattaagttttgtatttcagttattgtgtttttcaggtataaaatttctatttggtcttcctgtgtatcttctacttcttgattaagattctttttctttgctgtgactttttgctcataaaatttgtttcatgtgtttttataattcctttttgaataatttttatcatgacaagactaaaattttttcaggcaactctagcatctctgctgccttggtcttagcacctgtcattagccttttttcattcagtttgagatcttcctggttctttgtatgacaacttattttttaataaaacctgaacattttgggtcttatgagaatgtagtctttatttaaattatctggtgtagctgtctcattctgacacttcatctgagagtagtccctctacctctttgctccaaggttgaggtgggagtcgggttttttacttggcctccttggtaggtaaggcggaaggttttccatgttactgctgtgtaggcatgttagttttggctccctggtaggtctccagtgaaccccttttggctaggattggtaggagtatctttgtggggttggttgaagatgtttggaagatttcatgtagaacttgagttttaatatgctttcaccagaaatataaagcagtggaggagatcataaatcaatttgcatcctctctggaaagccataggcatatgctatattcatgcatgtatcagaaattacaatattaactggctctctataatgcctcgtaattttactggttcttgtcaaaaagtggttagtaaacgttttctgccaggtacagtggctcatgtctgtaatcccagcactttgggaggccgaggtgggtggattgcttgagcttagaagttcaaaccagcctgagcaacagcgaaacccagtcttaacaaaaatacaaaaaaatttagctgggcatggtggcgaacgcctgtggtcccagctacttgggaagctgagggagaaggatcatttgagcctaggcggtggaggttgcagtgagccgagatcgcaccactgcgttctagcctgggcgacagagcaacactccatctcaaaaaataaataaataaataaaaagaggccatatgttaaatattttagattttgtgggccaagaggcaaaattgagaattgtacctaggtacttataagaaagaaaacaaattttctcagatttttttgatttatgaaatcaaaatttactaatagtaatggagtacaatgtttataatttgtgtttactaatatgaagaatgaaagatggtggaaataacagtttagagtttatgtttagtagggtttatagtttgtgttccctgtcatcaaaattagttgcacatgttcatctgttaatgctaatctgtatggagtattttatccttgcaaatgtcttttcatgaaaattgttattggcacatactaatcttgatccattatcttgatttaacttggcatattaatcatttggaatacatttttagaattctgttaggttttcgtgcctttgagcgtgtcattgcattacagattaatcacttaatgaagataagaagtggaaagttctcagttgtagagttaaatagacttatggaaatttcctttcagtttgcatgaggtcaaaaatatttggctggaaatgtaatttgaaaatttatctgctgcccgtttgtcaggaaaggagattttgcttctttaacttttgtcagaaaaagaatgtgttaactttcaacagcataaaacagcttgaaagtacttagaattcaaacaatgtttgcagttgttaaatgactatcgtaatataagttttgcatataatcattgttttggcttataattttagattgattacattaataccatgaaatctttacatcagtttctctttttgaatttttaaatgtatatgtaaaggctttattaattattgattcaaactgtttcttcttttgtgaactttgatggtgtctttaaggaattggtttattccatcaagattatcagattcttgattcatgtcttgttcataatattcctttattatccctttaatgtctatgacatctgcagtgatgtttcctctttgtttctgatattcatgatttgtgctttcagtgaacttggcgagaggtgtattgattttatcaaagaatcaccttttggtttcattcatttttctctttagatttcccattttcagttgcattgatttctgctcaaatttttgttatttatttgcttctgcttaatttggatttaagttgctgtcatatagctagtttgataaggtggaggcttagattattaattttaaatctttcttcttttctaatatatgcattcaatgttataaatttccctctaaacactgcttttactgcctcccttacattttgataaattatggtatcattatttaaataaaaatatttctaaatatattttgagatttatttttgacatgttctttagaagtgttttgtttaatctataggtatttggggatacttcttttattctcctgttattgatttctagtttaattccgttatggtctgagagccaacactataattttgtggtaagatgtgaacgtggtccttttggtgaatgttccatgttagtttgagaagagtgtctattctgcttttattggatgaagtcatcaatagatgagagtatatcaaattgattattagtgctgttgaattcagctatatccttattgatttttttcttgtgagatttgttcatttatgatagaggattgttagtctccaactgtaacaggggtttcatctattactccttgcacttctatcagtttttgcctcatgtattttaatgttccgttgttaggtgtatatatgctaaggactgttatgtattcttggaaaattcatccctttatcataatatattgcccctctttattcctgaaaacttttcttgctttgaaatctgctctgtctgaaattaatacgctaccttcactttcttttgatcagtgttagcatggcatttctttctccatcctttcacttttatctgtaagtatttttaaatttgaagtggattttttggtagaaaatgtataattggaccttatttttttaatctaccctgacaatctctgttttttaattggtgcattcggaccattgacattcaacatcgttattgatgtaggtgaattaatatctaccatattttaaacttttttatttgttgcctttgacctttgttcttgttttgtctcccactcttctaccttttgtgtttctaattgaacattttatgtaatttgaatttctcttttgtcatagcattatcagttaggcctctgtttttaatttttatttttattatttttttgagacagagtctggctctgtctcccgggctggagtacagtggcgcgatctctgctcactgcaacctccgcctcctgggttcaagcgattctcctgcctcagcctccctagtagctgggactaccagtgcgtgccaccacgcccgggtaattttttgtatttttagtagagatggggtttcaccgtgttaaccaggatggtcttgatctcctgacctcatgatccgcccacctcggcctcccaaagtgccggaaatacaggtgtgagccaccacgccctgcctgtttttattttttaatggtcatcctagagtttttaatacacgtttcaactaaacgaagtccaataacactatattcacaagcagtgtgagaaaataatcctaattcctctcttccacgcagtgtatgcttactggaattcatttaactttataaaagcatgcagaagaatacatgtgtatataagcctacataatcatatacattgttgctattattattttgaacaaactattatgttagataaatcaggaaaaagaaaaatttttactttaccttcatttatttcttctctaacgcactttatttaagaagatctcagtttctgactgataatcatttttcttctttctgaagaaattcttttaacatttcttgtatgtcagggctcctggcagcaaattagccaatttttttactgcccgagaaagtctttatttcaccttcacattttttcctttatttttagctgacatgtagtaattgtacatatttatagtctacagagtgatatttcaatacatttacacaatgtgtaattataaaatcagggtatttcgcatatccgtaatctcaaacacttaacaattctttttactgtgaacattcaaaagcttctcttctagttttttgaaaatatacaataaattctagtcatccatatttatactacagtgctgtaaagactagagcttactcctatttttcttttctttttttttttttgagatggaatctcgctctgtcccccaggctggagtgcagtggtgcgatctcggctcactgcaacctctgcctcccgggttcatgccattctcctgcctcagcctcccgagtagctgggactacagacgcccaccaccactcctggctaattttttgtatttttagtagagacggggtttcaccatgttagccaggatggtattgatctcctgatctcgtgatccacccgcctcagcctcccaaagtgctgggttacaggcatgagccactgcgcctggtccttactcctattatctacctttaagtttgtgttcattaaccagcctcttcccatccttccctacccactccccttctaagcctctagcaaccacaattctactctctacgtctatgacctctttttttgtttttaatggatactacatatgcatgagaacatgcagtatttatctctctgacttatttcacataacataatgtcctccagggtgatccatattgctgtgtatgaatgcatttaattctctctctcttttttatgactgaatagcaatcaattatgtatatacgacacatcattctctttatccattcatctgttgatggatgtttagtttgattccatatcttggatattgtgaatcatgcttcagtaaacatgggaatgtaagtatccctttgacataattgatttccttgctttttgataaatgcccattcctgtgattgctggatcagatggtaattaaatttttactttttgaggaacctccatactgtttttcataatggccgtactaatttacatatccacaaacagtgcataagttcctgtttctcttcgtcgtcaccagcatatgttatctttgatcttttataatagccattctgactggggtgagatgatatctcattgcagttttgatttatgtttccctgatgactagggatgttgagcattcattcatatatttgttggctatttgtttgtcttcttttgagatgtctattcagattctttttccagttttttttttttttttgacggagttttacgcttgttgcccatgctgaagtcgaatggcacgatctcggctcactgcaacctctgcctcccgaattcaagcgattctcctgcctcagcctcctgagtagctggggactataggcacgtaccaccacgcccggctaatttttgtatttttagtagagatggggtttcacccatgttggccaggatggtctcgatctcttgacctcatgatctgcccgcctcggcctcccaaagtgctgggatgacaggtgtgaaccaccgctcccggcccctttttccagtttttaatcagattttttgatgggttgtgtgagttccatatatattctggacattattcccttgtcaggtaaataatttgcaaatattttctttcattcaacagactatatttctttactctgttgatcttctttttttgctctacagaagctttttagtttggtatagttccgtttgtctatttttgtttttattgcctgtgcctttgaaatctttaaaatctttgcttagacagatgtcctgaagcatttcttatatgttttcttgtagttattttgtaatttcaggtcacaggtttaaatctttaatccattttgagttgatttttgtggtgagaaggatgtactttcattcttctgcatataaatatccaattttccaacaccatttagatattttattctttttagcaggtattgactgcaaatgggcttgctttcctgatttttttttcagctagttggttattctataaaaacatcactgattcttgcatgttgattttgtatcctgcaactttactgaatttgtttagaagttcaaagatattttatccttttatagattcaggagggatatgtgcaggtttgttacacacacatatatatatatatagcataatggtgggatttgggtttctagtttagtcatcatctgactagtgaatattgtacccaataggtaatttttcaaccccaacctcccctcttttggaatccccagtttctattatttttcttcctagagttttttgaagagtcttcaggattttttatatgtaagattatgtcatctgcaaagagggacaacttgcctttctcctttctaatttagatgaactttatttccttttgtggcctaatttttcttacaaggaattccagttctatcttaaatacaagttgtaaaagtatacattcttttcttgttctagttcttaaaggcttttagcttttctccattcagtgtgatattgtctgagtgtttttcatatttggactttattgtgtttaggtataatctttctatacttaattttttagagtgtttattatgaagggagttgaattttatcagatgctttctttggatttgagatgatcatatgatttgcttttcatctatcattctgttgatgtgatgtagcacatctattgatttttatatgttgaaccatcctcgcatacctgggataaattccactcaatcgtagtgtattttttttttttttttgatgtgcctttggattcagattcctagtattttgttcaggatttttgcatctatgctaatcatggatactgacctctagttttttttgtgattgttgttgcatccttctttagttttggtatctgggtactactgacctcgtagaatgaattaggaagaatttccacctttttaattttttggaagagtttcagcaaaatagatgttcttcttttaaagctttttggtcctgggctttttgttgggagacttttttattgccagtttaatctcgttactcattattgatctgctcaggttttctatttcttcctgatttaatttgtgagattatatgtgtccaggaatgtatccatttaatataagttttctaatttcttagtgtgcagttgttcataataatttctagtggtcctttgtatttctgttgtatcagttgtaatgtctcattttttatttctgattttacttatttgagtcttccttttttcttgattagtctagctactggtttgtaaatatagtttatctttcgataaaaccagtgtttcttgtgatcctttgtgggtttttgtctctatttacttctgctctgatgtttccttcttcttattttaggtttggcttgttcttccttttctggtttcttgaggtgctttgtcagattgattaagtgaaattgttcaaatggtttaagtgtttattgctgtaaacttcccttttagtactgtttctcagtacactataagtttttggtatgctgtttctatattaatttgtttcaagacttctttggtgtctttaaatttcttaattgaaccataagtttctcagggtcttttctctttttttcttgattaatcttattaatttttgattttcatgtatttgtagaatttccaaagttcctcttgttactaatttctagttttactccattatggtttgagaagacacttgatataatactgatttttgaaaatttcttgaggccagtcttgtggcctaacatgtggtctgtcttgtagaatgttctatgtgctgatgtcaaaaaatggatctaaaatggtttacaggccatatttggtccaacagctgcagttggaccaaatatgttctgtaagccatctttagatccatttggacacacatttttgaaggataactttgttgggtatagtgttattaatcagtaggtattttttgttttagtactttgcttaaaccattttttttctctcttggcttataatggttctgctgagaaatttactgttagtctgaaggggattcccttatatgtaacttgatgccttttgctgtttttagaattatttctttgtctttgactcttggcagtttgagagatatatgtctcagggatgacatttttgggttgagtattttggggacatttgacctttccagatcttgatgtctgtctctcaagatttgggaagttgtcagccattattttacgaaataagttttctatgccttttctacactcatttccttctataattcacaaaatgtgaatatttatttacttgatggtttcccatgtcatgtaggtttattcattcttttttaaatttttttttccttttgtctgggttatttttaaaaacctatcttcaagtactaaaattatcttctgcttgatctagtcgattgttgaagctttcaattgtatttttttaattttaatcattgaattcttgagttccgggatttctgtttagttgttttttatgacattctatttaatttctcatttagatcaccagttgttttttttttctgatttatgtatattttctatctgtgttcttttgtatctactaagttttaaaagattattatttaaatttgttaaggtatttcatagattttcttttggggctctgttattggagaattattgtgtttctatggcagtgtcatatttcctttttcatgtgtcttgcatccctacattgataactgtgtatatggttagcaatttcgtctttcagttttctggattagcttttttaggtaaacttttttctgtagacatatctatagtgtcatttgggtagagtgttttggctttggttcaggtggttgcattagtgtagtctctgtatggttactttggctgtaaataatgttaacagtgtctgcagtttccctagggcgttcaggtgaggttgttcatggagtcagcgacaagactttcctggcaacatggatatttggtgggcttgttctttggctcctaagggttgtgcacaggcactggcagtgttagcagtgggttgttcttgggctcctgggtggtgattggaggcacatggtggccttaccactggagttcatgaggtcatcatttgtggtacgcactaggtgggccagccctcaggcccgaagtctccctgtttacacattgactgtagttgtagcaggccctggttgagccagtctttgagttcacaggtggcacacatgggtgccttcatttttagatggatattttatcaaggtacaaacttttggattcaatttatctcaagtattttaaacatattgtcccattgtcttctggatttgatagtttctgttaaaaattcagctttaagttttcttgtttttcttttgaaagtgatatgtcttttttctccctctgactgttgttaaagtgttcttgttatctttgattttcagcattttgagtgttggttgtggtttttttcacctttgccagtgtggtgtttgccatacttcttaagtcagaacattaatatattgtatcagttttgggctagtctcagcaatttttaactttttctgaaagtattgtttctcctcactttctgtctgctttattctaactggaattatatttgtgttgaagtgtttaattcccacatatctcttatgctctgttcatttcatttctttcttgctgtgcttcagtgtggatatttcctgctgacctatattcaaattcactaatctgtgctttgctgtattcagtcagttataaaacccacccaccaactgcttaattgcagatagtgtgtttttcagatataaaatcactatttaatttttaaaatagattttcattctttgttgaagttttccttttttcatctactttgaagatcttttttaaagtccttgtcttctaactctatatcatctgtgggtctgtttatatttattctcttttcccttgattgttagtcacattttgtgcccctttccataccttgtaattttcatcatataccaaatattgtttataatagagcagcagaaattgaactaaatattatttttcttcaattctgtattagaaagataagatcaagtgctaatcacctcaactcaattatgaatcttactgcatcaagtctgggtggcagctttcgatacacttagaatgcctttgattttaaatgtcctaatgacaacaactgttgtgttgcagactcttctgtctggtgactttgtatttatatactgtaaaattgttggagattttactctacctttctggtcctgctccttttactcatttcctctggctccccacccactaaggggatgcttttggttgagagcaaatatcttgtgggaagacctattaaaattttatcctcacagtggtaggctacatctgttctagtgtgactttgtcttctaatcaccacaacattacagggattattatttgccccatggcctgttctcccaactgctgccccaaatcctcttaggtaattctggcactcagcaaatttttcagggagaaaactgtctgtaattttggacttcatcagattccagtttttcatgccagcttacaaattatcaagagctgtgctgttttttcttttccttagtagtgtccttctttcttagctagtctgtctaactggcaaatccttccagaaattaaaataatcagcaggattagctgacttaagagatattaatcatcctgcaaatttagtttctcctttctatttcccttgctcgccaatatttttaaaaatatgattttgtagtttgtctctttttttcctagttgttgtgggggcagtgacttgctactgtgtactagtaaattaatcttgtaacagtaagaacaacatttagaccgacatgtttattattttatgtaatgtatttatatagagttggtgtgcttaaagtagtggattgttattgaaatgttggcttgtttagaatattaatatttgttgctaaattcaccaggcctataaataaatcaatagtaatgtttggggaaaaatgaaaaaaaaaaagctatttttcatttcaaaatgtcttttggtcagcaatagcttaaatgaaatgtagacaaaaattaatttttttttcttttccccatttctatttagtgagtgatagttgcttcaggaatcttgcagaagaccgcagtgggataaatctcaaagatctcgtacaagatccttctttgtgagtattgtgctttcagtattaagtataaattaaaactttattattagtgttccttttctcaaaagagttttatgtgaaaacttatttaaggtacaacaattttttcttttctaataatgcgttttacacatattgaagtctgacagaacagttcagaaatagaatagattttagaaggaatgatgtcatgattaatgattgattttcaaggaggaatcctgatggctgatgatatcttgccaatgtggcagtagctactagccaagaaagatgattagtagttgatttccttgggaaagagagattgaatttgtttacaacaatttgaagttttttgaatatattgtttatagtaattatttgtaattataattagaaatataaagtagttatttgttataacaatatacatttgaatatgttagatatatttctgatgttttacatatggcacaagaattttggagagtttgatagatttcagtttttaatttttttgctcatcagtcagtcccattctttattggcatatctttctaatacatatactctacaataatgtcactttctatttcataaattttttttacacttttatatttactggtaaatatgcatactatctatgaacataccttcccaataagatcactgtttattaaaaaaaaataattaaaactagttaagcctgcgaagcagagtaaagaaaattgaatactgccaggtgccttctataatgatacatataatgcatacaattaaatatgtcctaataggaaattcatctcccagatcacatgtaatataccctcccacgggagtcactaataagtcattgagaattttgtgaggaataaacacaagaatatcttgaacttgaagattattgattctttaatgattgactagtcatgttaaaaaatatgagagtgctgaaaatgtatcgaatattgaagtttatatatgatgtcgtgagttcagaatgcatttccaagtctacctctctccatttttttcttttctccatctttctttttctaactcaaaaggattgcaaatattcctcctccttgatttttatccctactatgaagattgacagttgtcctttgagtcctgtgaaaatttaaccaacaatgtaattattctgttaggatgtaaatatacctagtgaataacatttaattgcattaagagttctactatccttatggatatgggtggaaactttacaatttcctcaaaagactttgcttatttgaatgaataaaataaattactggccaggcgtggtggctcatgcctgtaatcccagaactttgggaggctgaggtgggtagatcacaaggtcaggagatcaagaccatcctggccaacatggtgaaaccccgtccctacaaaaaatacaaaaattagctaggcgtggtggcatgtgcctgtagtcccagctacttgggaggctgaggcaggagaatctctcgaacccgggtggcggaggtttcagtgagctgagattgcaccactgcactccagcctgggcgacagagcgaggctccatctcaaaaaaaaaattattattgtattatttgtaagatatgttttagtaaaataagaatgtatgtctgtttaatgcagcaatatgatgaaaatatttgctcatatgaactccaattatataaaagatttgaagaactacacttgaataatggattataataatcaattgccatgttttggaaaaacttgttgcttcttcctggaatgtagaataacattcatcatttaacctaccactaaattctatatttaattttagtattctaaaaaaaaaattcatctcagactacttcattggaaggacaaaataattctcagtgtacctgtcttaaaacagccggaaatatcttaatatagcatcattctcctaacctgccattatcctcttggattagtctagtatgtaagaatgtcagcattcatggagaaagagtttgtttttactcctgcctgcttggctttctaaggaattttttctttattaagaactgtcaggatatactattgatgacttgaattcatattttaaagatatatttctcattaggtaaaatcttttagagaaagaaatgcccaatgtggaaatatatatatatatatatatatatatatatatatatatatatatatatatgttcatatatatatgttcatatatatatatgttcatatatatatattcatattcttgtgttgttatgatgggaaatattttattctgagttcctgtctgattgcagtattcatttagtatgtacattgtaggtgagtattttttttttttaagctaggtgcctcttttctgtctcagactcttggcataaatgttcactacttttcattgattcaggtatactagatggtcctacaaggagttgaattgttaatggtgcaacattgaataggaagtatatcagaaattttttttgtgtttttacaaaaatctcttcggccaggcacagtttctcacgcctgtaatcccagcactttgggaggccgaggtgggcggatcatgaggtcaggagatcgagaccatcctggctaacacggtgaaaccccgtctccactaaaagtacaaaaaattagccaggcgtggtggcgggcacctgtagtcccagctactcaggaggccaaggcaggagaatggcatgaacccagaggcagagcttgcagtgagcagagatcgccccaccacactccagcgtgggcaacagagcaagactccgtctcaaaaaaaaaaaaaaactcctcctcaaaaaatcactgtcatttgataactactccagactagtctgatggttattaaaattgtatacatgtcattttaatacatgttccaaataaaaattattagaataagatgtgtgttgagtgaatgctatgtatgttgatgtgcctggcagatttttattatgactcacccatttgagctgctgatactgaaaggagttgatggtaaataagaattaagaattttagcctcaatactgttagaaaggaagacagaataatagagcaagaaaaattaggctaaggaaaacccaggcttatctagtcaatattgatactcagagtagtgtattatatgtcttaattggataaatgagcagatacagaatttctgtggacaaagtacagaaataaaactgtaatgagttttattaagaatatatgatataaaacaatgtttaaaccaagagtagtcagagctagatgaggggcttactgcatcagagattgaaagtgcagaacctaaactgactaattcatactctgaatctgtgtcaagctaatggaacaatgataggtactctgtaatttactttaactgtatagtacatactccagtattttactgccattgtagtaaaacttgttactgggcttgaatgaaccaagtgagctattgtgtgaacatggcagagagatgccatgggagaaaaaaattttgagaaagttatgaatctctaagcaagactttctggtcttgctactaacttttcttttttttttttcttcttatactttaagttctagggtgcatgtgcacaaagtgcagatttgttacatatgtgtacatgtgccatgttggtgtgctgcactcattaactcgtcatttacattaggtatatctcctaatgctgtccctcccctctcaccccaccccacaacaggccccagtgtgtgatgttcccttcctgtgtccaagtgttctcattgttcaattcccacctatgagtgagaacatgcggtgtttgtttttttgtacttgggatggtttgctgagaatgatggtttccaacttcattcatgtccctacaaaggacgtgaactcatccttttttatggctgcatagtattccatggtgtatatgtaccacattttcttaatccagtctatcattgatggacatttgggttggttccaagtctttgctattgtgaatagtgccgcaataaacatatgtgtgccatgtgtctttatagcagcatgacttataatcctttgggtatatacccagtaatgggatggctgggtcacatggtatttctagttctagatccctgaggaatcgccacactgtcttccacaacagttgaactagtttacagtcccaccaacagtgtaaaagtgttcctatttctccacatcctctccagcacctgttatttcctgactttttaatgattgccattctaactggtgtgagatggtatctcattgtggttttgatttgcatttctctgatggccagtgatgatgagcattttttcatgtatctatttgctgcataaatgtcttcttctgagaagtgtctgttcatatccttcacccactttttgatggggttgtttttttcttgtaaatttgtttgagtgctttgtagattctggatattagccctttgtcagatgagtagattgcaaaaattttctcccattctgtaggttgcctgttcactctgatggtagtttcttttgctgtgcagaagctctttagtttaattagatcccatttgtcaattttgcttatgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaacggatccagtttcagctttctacatttggctagccagttttcccagcaccatttattaaatagggaatcctttccccattgcttgtttttgtcaggtttgtcaaagatcagatggttgtagatgtgtggcattatttctgagggctctgttctgttccagtggtctatatctctgttttgataccagtaccatgctggtttggttactgtagccttgtagtatagtttgaagtcaggtagcatgatgcctccagctttgttcttttggcttaggattgacttggcaatgtgggctcttttttggttccatatgaactttaaagtagttatttccaattctgtgaagaaagtcatggtagcttgatagggatggcattgaatctataaattaccttgggcagtatggccattttcatgatattgattcttcctatccatgagcatggaataaatgttcttccatttgtttatgttctcttttattttgttgagcagtggtttgtagttctccttgaagaggtccttcacatcccttgtaagttggattcctaggtattttattctctttgtagcaattgtgaatgggagttcactcatgatttggctctctatttgtctgttattggtgtataagaatgcttgtgatttttgcacattgattttatgtcctgagactttgctgaatttgcttaccagcttaaggagaatttggactgagacggtggggttttctaaatacacaatcatgtcatgtgcaaacagggacaatttgagttcttcttttcctaattgaataccctttatttctttctcctgcctgattgccctggccagaacttccaacattatgttgaataggagtggtgagagagggcatccctgtcttgtgccagtttttaaagagaatgcttccagtttttgcccattcagtatgatattggctgtgggtttgtcataaatagctattattgttttgagatacgtcccatcaatacctaatttgttgagagtttttagcatgaggggcagttgaattttgccaaaggccttttctgcatctattgagatgatcatgtggtttttgtctttggttctgtttatatgctggattacgtttattgatttgcgtatgttgaaccagccttgtatcccagggatgaagcccacttgatcatgttggataagctttttgatgtgctgctggactcccacacaataataatgggagactctaacaccccactgtcaacattggacagatcaacgagacagaaagttaacaaagatatccaggaattgaactcagctctgcaccaagaagacctaatagacatctacagaactctccaccccagctttgttctttttgctcaggattgctttggctattcagggtcttttatggtttcataccaattttaggattattttttctatttttgtgatgaatgtcattggtattttgatagagattgcgttgaatctatagatcactgttggtagcatgttcatttttacaatattacttctttttctttattttatttggtttttttttttttttttttgagacggagtttcgctcttgttgctcaggctggagtgcaatggcacaatctcggctcaccgcaacctctcgcctcctgggttcaagcggttctcctgcctcagcctcttgagtagctgggattacaggcatgtgccaccatgcccggctaattttgtgtttttagtagagacagggtttctccatgttgttcaggctggtctctaactcctgacctcaggtgatccgcccacctcggcctcccaaagtgctgggattacaggcatgagccactgtgcctggccaatattatttctttcaattcataaacataggatgtgtttccatttgtttgtgtcctcttcaatttctttcatcagttttttagcttgtttgtgtagagatctttcacccacttggttaaatttatttctaggtacagttgatccttgaacagtatgagtatttggtgtattgctcctgcatgctgttgaacatttaggtgtaacttttgacttgccaaaaacttaattactaactaataagctactgttgactggaatccttaacaatgacataaacagttgactaacacatattttacatacgtattacatactgtattcttgaaataaagtaaactagagaaaagaaagtattattaagaataacaaaattaagaaaaagaaaaatatttactattcactaagtcaaagtagatcaagatataagtctttatgcttttcatcttcacattgaataggctgatgaggaggcggaggaagaggaaaaggagttggttttgctgtctcaggagtggcagaggcagagaagagttgtcagggaggtagaagaggcaggcacactcaagtgtaacatttatggaaaaaagtctgcatgcatgtaagtagacccatgcagttcaagtctgtattgttcaagggtctaactgaattttatttttgtatgtagctgccataaaatggattgctttttcagtttctttttccactagtttattgctgatgtttagaaatggtacttattttttaccttgattttctgtcctgcaaaagtactcaacttgttcatcagttctaagagtctttgaggggagtctttactgttttctatatgtcgtctacaacatgggagatgaacgggaacaaatttggatagtcctttccaatttggatgccctttaattctttctcttgcctaattgttatgactgggacttccagtactgtgttgaatgaaagttgtgaaagtcctttgcagggacatggatgaagctggaaaccatcattatcagcaaaatatcacaaggacagaaaaccaaacaccgcatgttctcactcataagtgggagtttaacaatgagaacacatggacgcagggagtggaacatcacacaccggggcctgtcggggggtggggggctgggggagggatagcattagtaaaaatacttaatgtaaatgaccagttgatgggtgcagcaaaccaacatggcacatgtatacctgtgtaacacacctgcatattgtgcacatgtaccctagaacttaaagtataattttttaaaaaaagaaaaagaaagtggtaaaagtgagcatcttttttttgttccagaacttagaggaaaagcttttaacttttcccaagtcagtgtgatgttggctgtgggtttactgtatatggcttttgttgtgttgaagtacattccttctgtatctaacttggtgagagtttttatcaggaagggatgttgaattttattacatgctttttctatgtttattgaaatgattatattgtttttgtccttcattccattgatgtgatgtgtcatatttattgatttgcatatgctaaaccatcccatttatctcacccatttatgcctgggataaatcctacttgatgatggtgaattatctttttaatatgctgctggattctgtttgctagtatgtggttggtaatttttgcttctatgttcatcagggatgttggtctgtagtttttgcatttgagtccttggtctagttttagtatcagggtaatgctggcctcttagaatgagttttgaagaattgcctccttctcaattttctggaagttttagacatattgattttaattctgctttaaatgtttgatagaattcaacagtgaagccatagggtcccaggcttttttaaaattacaaatttagtcacgttaattttcaattggtttgttggggtttttcatttcttcttggctcagttgtggtaggttgtttgtgtccaggaccatttctgctaggttttctaatttgttggcgtatagttgttcataatagtctttaatgatttttatttatgtggtatcaattttttgtgtcatttttccattctgattttatttatttgagtctttttttatcttggtttatttgggtcttttctctttttgtcttcgttggtctagctagtagtttggcaattttattgatcttttcataaaaccaactttttgactttttttatatgttgtatttttttctcaattttacttatttcagcttggatattttttattttttctactaattcttacagtttgttcttgattttcttgttccttaagttagcttgttaggctatttgaaaattttctacttaatgttgaggtttattgctataaacttctctcttactatagtttgtgatgtatctcatattttttggtatgttgtgtttctcttttcatttgtttcaagaaatttgaaatttttttcttaatttttttattgacccacgttcattgtagaacatgttcttcaatttccctatattctcacagtttcagtagttccttttgttgatttctagttttatttaattttggccagaaaagatacttaatatgacttcaattcttttagatttgttgagccttgttttgtgacctaatatgtggtctgttctggagaatattccatgtgctgatgaaaagtatgtgtattctgctgcatttgggtgatattttctctaaaggtttgttaggttcatttggtctgaagaacagtttaaattaaatgacctctgtcacatgttgagagtggagtgttgaagtccccatctattattgtatcagaatttattccttcctttaaatctaacaatatttgcttcatatatctgggtgctccaatgttgggtgcatattatatttacatttgttatctcctttactgaattaatatctttatcattatgtaatgaccttctttgtttctttttagttgttttttgtttttatgtttgtttgagacacagcctcactccctcggtttgtgtaagtacactctatgaaggtcacataaggttgaaataacctgaggatgcatttctcagaatgtatccctgtggttcagtgacatttgactgtaatgagtggcaaagcagtaaaccttggtctgtattattcgaactcctatatgctgactcacttacgtatttcagtgaaaacccaaagatttttatttagtgttgaaggcctaaacctcatttaaaattaagtataggctgggtacagtggctcacacctataatcctggcactttgggagactgaggtgggaggatcagttgagcccagtaatttgagaccaggctaggcaacatagtgagacactgtctctacaatttttattttttttttttatttttagatggagtctcactctgtcaccaggctgaagtgcagtggcgcaatctcggctcactgcaacgaccgcctcctgggttcaagcgattctcctgcctcagcctcccgagtagctgggattacaggcactccccaccacacccagctaatttttgtattttcggtagagacaaggtttcaccgtgatggccaggatggtctcgatctcctgaccctgtgattcacctgccttggcctcccaaagtgctgggattacaggtgtgagccactgcacctgacccatgaacatttttaagtgattaaaaaaaatttttaatgaatattttatagtacatgaaaattatatttcagtgtctataaatagttttgttagggaacacagccatgcatagtgtttacctactattcatggctgcttttgaattataatagcagagatgataagttgtaacaaggatcatttggcccactaagctgaaaatgtttattatccagtcgtttacagaaaacgttgctgacaatcagatatagaggatagactacaaagtgagctaaataatttatcagtattctgttcaagatagtgtacactgggagattttcagaactttctctgattgacatagaatggaagccaaaattaagatatagggtctgcagaaaacaaaactaaacaaacaatagcaaaaactatccagtactttggttagcaacctctaatccaaaaaagataataaaagctagatagcatttttctttttctatgtttgacaataaaatcaaattcggatttgtccataaaactcctgaaattctatgcaaaatatatttgtgagcaaatgtttgtttttctggggcgaaagtccttagttttcctttgattttctgtgggttttgcagatgcaaataggttaaggattactaatatatatagttaactcccaaataaagaggtttgaatatatctttactttacctgctaaccttcttatagtcctgggtgctttctgttatttacctcctgactgtaaaacatgcaatttttattactattttctgacacacttcattgtcatatgctctggtcattaggtataagtttacatggaaggagtgaggagtatgatgaggtactaacatttatcaactacctgctaggaactaaacaggtgctttatgcctagtttttaatatgatgtttcataattctgttagacatgctgagtaatttgaaattcagagaagttaaatatctgcagatacactatctgtagattctctagtagtaggcctgggactccaacctacgtctctctaataagtcctaaattatcctggctcctctatacaaccaggagagagaacacagaaagcaagtggggaacacagatgtctacctttttttcttatcgaacagttttctataatatttgctatttctaattaccatttttatatgaccattggtgcatataaactatatgacattttggtctctatgagcattaaaaggataaagacattgtattagattgcttgaattgaatggcttgtattgttgttatgaaataccaaagaaatctttataatatttggaattaaaatattaccaaggaagtaaccctgaactgaagcttatatagagcacttgtttgaattatagtgttatattttttatgtttattcatactaggtagtaattctctaaccttatgatttcatagcttcattgcactttaaaaaattataagcatggcattgaactattgtttatgtgggtaacatctattgatatttactatgttaaagaataaaattatttaattcacataaaatataaataagcccactacatattaaaataaataatataatgaaaaatagctgtatatttcaaaactcccaaaatagtcaaaatattaacagtttttttacattttataaatctctataatctctggcttaataaaagatagctaaattttcaaataactgtttctacgtttaatctgttgtaatatgtttttgttgaaatttgtgaggaaaattatgcttggaacaattatgtaacttggaaggaatattttaataactttttctaatgaatatggatattatttgttttgctattttactcaaactggacaataatgatagacagtttcttaaaggtaagtgtagtagtcagagttctccaagaaacagaaccaatgattgattgattgatagatagataggtagatacatacatacatatatacatacgggatttattaggagaattgactcatgcagttatggaggctgaggactttcctgactggccatctgtaagctggaattctgatgtcttaggacaagagaaatttatatcccagctccagaagagagaggaaatagcctatttgctctatttcggtcccctctaattgggtaggtctgcccacattgagggcagatcttacttactcagcctatggactcacttgtgaatctcctctggaaacattctcacaagcatacacagaaataatgctttatcagtactctgtataatccttcaaccagtcaaggtggcaccaaaaattaatcatcataataagtaacattgtggaattcaaagccatattaaggacattttcataatactctgttaagttaaaatctattggtccaccagagtagccaatacaatattgaagaataagaaaaaagttggaggacttgacactatacagcttcaagatttattataaagctgtggtgataggggcagtgtagtattggcaaaatagacaaatagatcaaggaaaaagaatagagagcccagaaatagacccatataaatatagttgctgtggtctgaatgtatatatctgcccagaattcatatgttgaagcttaacccccgatgtgagggcgtttgaaggatgaggcctttgggaggtgatttagtcatgagggcagagacctcatgaattggattagtgtccctaataaaagaggcctgagacaggcccctttcccctaccaccatatgcgattatagccagaagacagacatctatcaatcaggaagtaggccttcacctgaatttcttggcaccttgatcttggacttccagacctgcagaacagtgagaaataaacttcttttgtttatcagccacccagtccatggtattttttaaatagcagctcaaatagacttaagacaatgttcaactggtctttgaaaaaggaataaacaaaatacaatggagcaaagatagtttttttaacaaatggtgctggaacacctggacatctgcatgctttaaaaaattgaatctggacgtagaccttacacccttaaaaaagttaattcaaagtggatcataggactacatataaaacacaaaactataaaactgccagacaataatataggagaaagcctaggtaaccttgggtatggcagtgattttcagctctaaaggtaccatccacaaaagaaaatattggtaagctgggcttcattaaaaactctgctctacaaacacaatgccatgaaatgaaaagagaagccacagactgggagaaatattttcaaaagacgcatctgataatgtactattacttaaaaatatacaagaactcctaaaactcagcaataagaaaatgaacaaccctaggccgagcgcagtggctcacgcctgtaatcccaacactttgggaggccaaggcaggtggatcacttaaggtcaggagttcatgaccaagcctggccaacttggtgaaaccccatctctaccaaaaatacaaaaattagccatgcgcggtggtgcacgactgtaatcccaactactcaggaggctgaggcaggagaatggcttgaacccaggaggcggaggtttcagtgagccgagaacatgccacactgcactgcagcctgggcaacagagcaagactctgtcttaaaaaaataaataaataaaaataaaaataaaaataaactctattgaaaagtgggccaaagaccttaacaaacacctcaccaaagaagatatacagatgtcaaataagtatataaaaagatgttctacattttatgtcatcatggaaatgcaaattaaaacaacagtgaaatattactacatatctattagaatggtcataatctggaatactgacaataccaagtgctgatgaggatgtggggcaagaaactctcattaattgctggtgggaatgcaagatggcatagccactttggaggacagttcagtggttttttaacatgcattccagcagttttgccccttggtatttatccaaatgtgttgaaaatgtacatccacacaaaaatctgcacatagatttttatagaaactttataaatgacaaaacttggaagcaaccaagataaccttcagtgggtgaatggataagtaaactgtggtacatccagataatggaatattattcagtgccaaaaagaaatgagctatcaaactatgagaagataagaaggaaacttaaatgcatattactacatcaaagcagccaatctgcaaaagctacacattgtaagtatccagctatatgactttctggaaaaggcaaaactatgaagatagtaaaagaatcagtgcttgccagaggttagagaggaggaagggatgagcaggcagagtacagaggatttttagggcagtaaaactactctgaatgatactacaatgaaggaaacatgttatgatgcattgtctaaaccatagaatatacaacactgaaaatgaaccctaatgtaaactgtggactttgggtgataatgatgtgtcagtggaggtttatcagtggtaataaatgtgccacttcgttggggtatgttgataatgggagaagctatgcatattgcagtacaagggatatatgggaaattatatggaaaaatttctcacttcctaaagatgctatgaatttctttttcctttaaagaagtttatgcagatttgtggttatctcataaacaaaattaaccataaaagagtaatcctcattagaaaaatatttaagtcacgtttttaaagtctgctcaattttgctgtaaacctgaaactaatctaaaaatgtaaagttttgttttactatccattagccttgagtcttccaattctggaaagatggagtaaatgtactttggtctattcctcatgctaagtacaactgaaagtcctaagaaataatgtggtggtgtgttcttgtttttgtgtgtgtgcctcatatattttatacttggagctgaagcagctgacaacctagaaatatcgaaagacactgacaaatagcttcaacaaaagctttctctgtttagccaaagggcgtagaaaccataccaagtcagaaagcttatactataaccaccctactcctgccaaacactacagaaaaactgtggtcctacaccaacccatgccagcaaaagttgagtggggagcctggattctcaccctcactagactgtgatgaagtaccccaatttgtggtcccctgaaagggtctcagaacctctggtattcaagatcacagctttgagactttaagctttactactaaatgagttaaatttctcacttcctaaagatgctatgaatttattttgtttttccttttaagaaatgtatgtagatttgtggtttatcacgtaaaattaaccataaaagagtagtcctcattagaaaaatatttaagtcactttttaaaaaagtctgaatagttgaagtttatttttcaccaagtgataatttatttttgtcaattttgtgggaaagtaatgacttattatctgtttataaacaaaatttctacacactaatattttacatttgaatacatgtgtaaatttctttactcctatatttgtccctcacaggaatccacatcttcacctcatcttttaataagtattagtatgttttgttgactactgaggcattttatagttaatctacttaaatattagttggatttataccaaaaagttatctaaaataatattgtcaatgatgaattgtattaaacaaatgtgtttgactactctgtaattcagcatttataatttgccttagttatgtagtacgttgtgtgacttcacagtatcaggttttgtgaacttctgtaagcatcctttctgagaaagccaatgggaaaagtataattttttactacttgtaattttggataattgttgtatataagaatgtttactattaaaggcacaagatgaaatgtagactcaacagtattgaatgatgttaagaacaaattagattggagatactggtgtagtgtttttctctggcttctgtcatgtgaactttcattcttatattggatagatggtggatatttaaaagtatggtctaatctaggggttggcaaactatgatccacaggtcaaatctggcctgctacttgccttttttttttttcttttttcttttttcttttcttttttttttgagatgaggtctacctctttcactcaggctggagtgcagtggtgcaatcatggcttactgctgcttctgcctcccaggttccagtgatcatctcacttcagcttcccaagtagctgggactacaggcatgtgccaccacagctggctactttttacaattattatttattgtagagagaggatctctccatgttgcccaggctggtctcaaactcctgggcataagagatcctcctgcctcagcctcccaaagtgctgggaatgagccactgtgcccagcctgctgcctggttttataaataatattttcatcttatgaaattgaaaaatatgacccattcgaaagcactttggaaattgtgaaataaatatttattaaatgactaatttcaagtatcacaaatagttatttaaataataatacattatacagaaaatatatggattttgcctgaaatttcatcacaagttaaaaaatacattttgaaaagggatatgatgaattttgttaatgttagtctttaaactgagtcattctgcttgagcatttcaaaatggagaaaaaggttaaatacttgctgaataagatttgtcctctgatttgcttctggtctgtcactattttgtagataacttgaaatctgtgtgaaattacagaattcataggtaaaaaggggatgtaatattttttggagaaaattgaactatatgttcagtgaatgtaaactcttcttactgatgttgtcatactcttttaaaagtagcagatacctgggactaattattcaggatttattctgaatcagggaaatccagtgcttatgtttactcaataaaactgctattttaaaagaaatatttttatctttggaaagacaatgatacatgaaaattgaagttttgttagaacacagtcttactcattcacctatgtattacctatgggtggtttcactgtacaacagcagagttgagtagtttcatatgtcactcaaagccagaaatacagtcatccatcctttggtatgtgttggggattgttccaggacctctgcatataccaaaatctgcatatactcagtccctccattcggctctggggaacctgcatgtatacaaaacattggccctccatatatgcgggttttgcatttcattaatttgatctatgtttggttgaaaaaaatctgcagataagtggaaccaaggagttcaaacttgtgttgttcaagggtaaactgcattttgactgtctttacagaaaaagtttattgacccgtggtgtagataagaaatcattgtgacctgagtgagaatattagtcaatgtaactcttcaaggtaatgaaaagagtactgagctatgatttaaacttaactgcagagaagtctagcatattccagttatcagcagtgtagcatgataactaaattacttgacctttcagaatcttagttttctcaattgttaaatgaacatactgatactattctactcacttcacagtcttaaaagggatagcattaggagatatatctaatgctaaatgatgagttaatgggtgcagcacaccaacatggcacatgtatacatatgtaacaaacctgcacattgtgcacatgtaccctaaaacttaaagtataataataattaaaataaataaataaaagaaaataatttaaaaataataaaaggtaagtgatgataatattatattaaatatggtgatagaattgctggataatttaatcagggaatgctaaaaagatagtgactcgatgttgataatttcataagcttttcattatgtctttgtgagtatatagttcattagaattgttataagaagttgttgttgaataatttcaggtcaatgtggaagatgtctggtattttaaagtattctgttttagaacaaaatccagctttttaatagcgcatgcaagaccagtaatgatctgattacttcctggctcttcaacttcacctctcactatttgctgtttttatactatttgtataaatgatggaattagagagagaaaggctaagataataggagtgaaagaaacatctatgccagacagaagtaaactatggctgtgtttgccatgatttgtttttacaatctggttgtttacagaaacaaagcaacaaaaactaaatatgaaattaaataatgaagaagctatgccgaaggatgtttaaaatttgaaaaaacaactttataagaacctttatgttttcttatgactggataactactatttttttaaactaatcttaattttagagactataaaaggagagagattacatataggaacttttccttttggaaacaattaaaattgtgtgtcttatacgggctattcaacatgatataaatgtggaaaatctacttacagaaaaatttctgaggttatagtgttaaatgttttctatttctgtagaggatattcaaagaaaaattggtatcagtaaaatggacaactgcacaaaaccctatttgtttttaggggaggaggtgagagattgaggtgggactatacattttcaaagagagaggcacttagctactagaaatttaacgaatattttatttttgacacacatactggaatttctaaactgtgtgagagaagtaaaataattttacagttaaaattatatgaaagaagtagatttgtgatttagatttagagggaaaacctaacagtaatacatgtacgcatgttggctgttgctgttttgaatttatttctcccttatgatctaatttaaatttgtatttttttacttagtaaattattggtctgggacaactcggggatgaaggattttacttaatttttctaaattagcacttctgctattgtctttgcatttattattcatcctagaatagaacaaatatccagttaaaaatctttattatgaccggatgcagtggctcactcctgtaatcccagcaccttgggggccgaggcgggtggatcatgaggtcaagagatcgagaccatcctggccaacatggtgaaaccccgtctctactaaaaatacaaaaattagctgggcgtggtggcgtgcgcctatagtcccagctacttgggaagctgaggcaggagaatcgcttgaatccggagacaggggttgcagtgagccaagattgcaccactgcactccagcctggcaacagagcaagacaccatctaaaaaaaaaaactatattatttctcaattatttttatttcagttatatcacaactatttgaaatttgcttatgaagctaccaaagagtacatgcacagaaaggaaaccttatgcttgccctgccctgccatccagttttccttccctaaaagcaacctctgttacagaggttatctgtgcatgcgcacatgtgcacacacacaaatgtgaatgtacagatacatatatacatatgtatatatgcatatttacatatgcatgtaagtgcaatatgtacatattacacatttgaataaaaatacatcttacaaaaatgtatactgttgtgcatatttctcttttttttacaatatctcaaatatgtttcatatctaaacagacatcactttttaatagctgcatagcatcttgtttatttataactaatacataataactgtacatttgggtgcggccatgatggctgactagaaacagtagcaattggatgctcccatcaaaaagaaccataataagtgtgtgaaaccttcacctgcaaccaaggtattcaggctgtctaatcagaaatgactaggtggctggtgtgatccacggagagaaaggaagagcaatgtggtgtggcagcccacttgggagccacacagggcagggtagcccctaccccgcagccaagggaagacagtgagtgagcctgctaaccagctggggaaactgctttttccacggaactgtgccacccatggatcagaagatcacactcgtgaacctacgctaccagggcctaacatttcaaccccagagccatgtagattctcaacagcctctcagctagaatctacttaagcctaccaagctcctggggggaggggcgaccaacaccacagctatggctgcctactgtctaagccatttgagatccttggggtaggggcagcagccagcactgagactcacgactgcctagcatgctaagctccctgggcgggggaagggtggcatccatctctatagctccaggctgtacttctcccctcctggagccagggaggctggacagcttggtcccaagacatgtcctccacagcccaacacaccagctgtggcagactgcggccacagtgcctcttcaggtgtgaccatgactcatccttcctcactgggtggggcttccctgcaggaactccaaaaactccagccagaggctcagggacagaacccagatctccctgggcttgaacccctaggggaaggagtcgccacagtctctgtggaccagcagactttgcctttcctcctggtagttttggggaatccaggcagcccagacgagtgggttttcccccagtgaagcacagcccttcccccaagggacaatctaagtacttcattaaacaggtcctgttccctgtgccacccaactgggtgagaccctccaaaagggattgtcaaaaaccctatacaggagcgatcctactggcatcagattggtgtcccttgagatcagagatcccagaagaaggagcaggcacccatctttgctgttctccagcctccttgagacatctccagatgtgagagcgaaccaaatgaatagggcctgaagtgaacccccagcaaaccacagcagccatatagaagagggacctgaccattgaaaaacaattaaagagaaaacaacaacaacagcatcgacaacaacaacaaaaagccgtcatgaaaaccccatccaagggtcagcatcctcaaagattgaaattagacaaactcatgaagatgagaaagaatcaatgaaaaaatgctgaaaacccaaaaggccagagtgcatcttctccaaatgattataacaacagcaaggaacctgatagaggatgagatggacaaactaacaggagtagtcttcagaagatgggtaataaaaaactacatggagctaaaggagcatgttctaacccaatgcaacaaagataagaacgttgataaaaggttagaggagctgccaactagaataaccaatttagaaaggagcataaatgaccctatggagctaaaaaacacagcatgagaacttcatgaagcatacacaagaatcaatagccgaatcgaccaagtggaagaagggatatcagtttgaagaccacgttgctgaaataaggcatgcagacaagagtagagataaaagaatgaaaaggaatgaacaaaacctccaagaaatatgggacttcagcgtttaaaaagaccaaatctatgattaactggaatacctgaaggagatggggagaacagaaagaagctggaaaacacacttcaggataatatccaggagaacctccccaacttaacaagacaggccaacatgcaaattcaggaaatacagagaacaccactaagatactccacaagatcaacccaaagacacataatcatcagattctccaaggacaaaatgaaggaaaaagtattaaggacagccagagagaaaggccaggtcacctacaaaggaagcccgttggaataatagcgtaactctcagcagaaaccctacaagccagaagagattgggggccaatattcaacattcttaaagaaaataattttaaacgcagaatttcatatctagccaaactaaacttcataagcaaaggagatcctttccagagaagcaaatgctgagggattttgttaccaccaggactgccttgcaagagctcctgaaagaagcactaaatacggaaaggaaaaaccggtatcagccactgcacaaacactccaaaatgtaaggaccaatgacactatcaagaaactgcatcaactagtgtgcaaaataaccaggtagcatcatgatgacaggatcaaattcacacataataatactgaccttaaatgtaaatgggctaaatgccccaattaaaaacacagattggcaaattaataaattttcaagacctattggtgtgctgtattcaggaggcctatctcaagtgcaaagacccacataggttcaaaataaaaggatggaggaaaatacaccaagcaaatggaaagccaaaaaaaaaaagaaagaaagaaaaaaagaaaaaaaaaagggcaggagttgcaatcctagactctgacaaaacagagtttaaaccaacaaagatcaaaaaaagacaaagaagggcattacataatggtaaagggaccaattcaacaagaagagctgactattctaaatatatatgcacccaatacaggtgcactcagatttattaaacaagttgctagagacctgaaaaaaacttagactcgcacacaataatagtgggagactttaacaccccactgtcaatattagatcaacaagagagaaaattaacaaggatgttcaggacttgaactcatatctggatcaaatggacctaatagacatctacagaattctccaccctaaatcaacagaatatacgttcatctcggtgccgcatagcacttattctaaaatcagccacataattggaagtaaaacgctcctcagcaaatgcaaaagaactgaaatcataacagtctctcacaccacaaggtaatcaagttagaactcaggattaagaaactcactcaaaaccacacaattgcatggaggttgaacaacctgctccagaatgactcctgggtaaataatgaaattaaggcagaattcaagatgttctttgaatccattgagaacaaagacacaacgtaccagaagctctggtacacagctaaagaagtgtgagagagagaaacttacggcactaaatgcccacatcagaaagctagaaaaatctcagatcgacaccctatcgtcacaatttaaaagagctagagacgcaagagcaaactaatccgaaagctagtagaagacaagaaataactaagatcagagcagaattgaaggagatagagacacaaaaacccctccaaaaaaatcagttaatccaggagctggtcatttgaaaagattaacacagtagatagactgctagccagactagtaaagaagaaaagagagaagaatcaaatagacacaataaaaaatgataaaggggatatcaccactgatccaacagagatacaaactaccattagagaatactataaacacctctaggcaaataaactagaaaatctagaagaaatggataaattcctggacatgtacaccctcccaagactaaaccaggaagaagttgaatccctgaattgaccaataacaagttctgaaattgaggcagcaattaatagcatactaaccaaaaaaagcccaggaccagatgaattcacagtggaattctaccagaagtacaaagaggagatggtaccattccttctgaaattattccaaacagttgaaaaggagggactcctccctaactcattcagtgaagccagcatcatcctgataccaaaaccgggaagagacacaacaaaaaaagaaaacttcaggccaatatccctgttgaacattgatgcaaaaatcatcgataaaatactggcaaaccaaatccagcagcacatcaaaaatgttatccaccattattaagttggcttcatccctgggatgcaaggctggttcaacatacccaaatcaatgaatgtaacccatcacataaacagaaccaaagacaaaacgcacataattatctgaatagatgcagaaaaggcctctgataaaagtcaaaatcccttcatattaaaaactctaaataaactatgtattgatggaacatatctcaaaataataagagctatttatgacagacccacagccaatagcatactgaatgggcaaaagctagaagcattctttttaaaaactggtacaagacaaggatgccctatctcaccacttctattcaagatagtattgtaagttctggccagggcaatcaggcaagagaaaaataaagtgtattcacataggaagagaggaagtcaaattgtctctgtttgcagacaatatgattttgtgtttagaaaatcccattgtctcagcctaaaaactctttaaattattaagcaacttcagcagagtctcaggatacaaatcaatgtgcaaaaatcacaagcatttttatacaccatcaatatacaagcaaagagccaaatcatgaataaactcccattcataatcgctacaaagaataaaatacctaggaatacagctaacaagggatgtgaaggacctcttcagggagaactacaaaccactgttcaaggaaataagagaggacacaaagaaatggaaaaacattccatgctcatggataggaagaaacaatatcgtgaaaatggtcatactacccaaagtaatgtatagattcaatgctgttcccatcaaactaccattgacattatttacagaattagaaaataactactttaaacttcatattgaatcaaggaagatcccatatagccaagacaatcctaaccaaaaagaacaaagctagagacatcatgctacctgacttcaaactatactacaaggctacaataatcaaaacagcatggtagtggtaccaaaacaggcatataggccaatgggatagaacagagacctcagaaataacaccacacatctgcaaccatctgatctttgacaaagctgaaaaaaacaagcaatggggaaaggactccctatttaataaatggtgctaggagaactgggtagccacatgcagaaaactgaaactcgaccctttccttacaccttattcaaaaattaactcaagatgtgttaaagacttaaatgtaaaacccaaaactataaaaaccctagaagaaaacctaggtaataccattcaggacacaggcatgggcaaagacttcttgacaaaaatgccaaaagcaattgcaacaaaacccaaaattgacaaatgggatctaattaaactaaagagcttctgcacagcaaaagaaactatcctcagagtgaacaggcaacctacagaatgggagaaaattttgcaatctacacatctgacaaaggtctaatatccagaattcataaggaatttaaacagatttaccagaaacatacaaccccatcaaaaagtgggcaaaggatattaacagacacttctcaaaagaagacatacatgcagccaacaaacatttgaaaaaaaaaaaaaacaacatcactgatcattagagaaatgcaaatcaaaaccacaatgagataccatctcacgccagtcagaatggcgattattaaaaagtcaataaacaatagatgctggtgaggctgtggagaaataggaatggttttacactgttggtgggaatgttaattagttcaaccattgtgaaagacagtatgtagatttctcaaggatctagaaccagaaataccatttgacacagcaattccattactgggtatatacccagaggaatataaatcattctactataaagacacatgcacgtgtttgtttattgcagcactcttgacaatagcaaagacatggaaccaacccaaatgcccgtcagtgatagattggataaagaaaatgtggtacatatgcaccatggaacactatgcagtcacaaacagagaatgcgatcatgtcctttgaagggacatgggtgaagctggaagtcatcatcctcagcaaacttaacgtgggaacagaaaaccaaacaccccatgttctcactcttaagtgggtgttgaacaatgagaacacatggacacacggaggagaacaacacacaccagggcctgttgggcggcggcagcgaggttagggaacttaaaggatgggtcaataggtgcagtaaatcactgtggcacatgtatacctatgtaacaaatgtgcacgttctgtataggtatcctagaacttaaaataatgtaattttaaaggtcaaaaaaccctgtacatttattttatacaaagtgatgtttcaatgtaggtatacattgtataatggtcaaatcaggcagttactatatctaacagtttaaacatttatcatttctgtgtggtgataatattcaaaatcctctcttctgcctatcttgaaatatacattgcattcttattagctatagtcaccctataaagtttcaaaagctggaggttttggtgctcaattgattgaacagtttgactaaagatttccaagtgaatttttaaaacatgcacccaagtttagatgatttattcataaaagtgctcagtatcattgcagggtacttatgttgatttaaaaaatagttcttcaaaggctcaagcaattttgctcatcttagtttagagacatctaaaaacttcaaaaaaaaaaatggcgagcttaacaaactgttaagtccctttcggcatatcttcttacatccttctttgccttccaacaattgtgaataataggactagaaagagaaaaatgagagaaaacctcataaggtattcaatctccatgcttccacaaatgttttggaaatatttggagacagttatgtattagttaaatattatctcaatatgtgctgtagctgaaaatcctgttatcagtataaaactttcttcctgtatttcacaagaattgagccacatttagaggcatccaccaaccattttctggacatgaatttacaagataaataactcccctttagggaaattaaatatttatatattttaagcatttcagtatttaacacaacatgataaggaaagaatataaaaagatttcaatctagagcagtaatttactgagtctgagagattgccagatttgcttggatttgccagatcctgttttagaagtatgccaaagtgtgaatattttatatttttaaatataaaataagtatttctagttacatagttttcacatgacatgctggactgtagattatatggttgcatgtttttcttccactaaacttgcatttagcagcaagtacggagctcaaaagtccctatcatcaatattttatattgtaaaactaattttagtagaatattaagcttttaaattattaaacatgtgaagaactcttaatagtctattatacataagtattaaaacataagagttcagaccagtctgggtatttagaaaaatgagtaatttaaaaaatggatccaaagatattaaaaagaagataatacagtattataatgtgtcaggagatattcaggttaaaataatcatatcttagataatttgccaatgagattaatataatgcctctttctgatgaccacgtttttgttagggcctttatttgaacagtgttcctacagctttcaataactaaaagattagcagccttttctaaacaaccattcttttaaacataaaatagcactattaaacaggattagaactctgtattagattgaaagcaccctgaaatgaagagccccatctatcacattaagcctgtactgtagtccccttttatccacaggggataaattccaaaactgccagtgaatggctgaaaccacagatactactgaacccaagtactgcgataccacaatagctgatctgataacccagatggctggtaagtgaataacaagtgggtagcctatacaatgtgaattcactggacaaagggatgattcatgtcccagtgggatggagtgggaaggtgtaaaatttcatcatactcctcagactggcacataatttaaaacctaagtattatttatgtctggaagtctttatttaatatttcagatcacagttgaccttggaaagcaaaactgaagataaggaaagactactctattctcattgctgggcaaagtccctcatacttagtaagtgatgtctttccttaatgaagtcacagacctaattttatgttttagcccttccacttataagatatacatccaaaaaaaggacaaagcactccaaaggggaaatgtatctttttgtcaagtcagggaatacttagtaaggagaagacaatttgagttatcagtgtcaagagagaagttggattgcaggaacaaagttgatgccattaaaaaaaaaaaagaatagaagttgtttgtgaaataatgagtgtccactgcattagttatatgaagggaagtaatggaaagctatgttggagggaggggaattttttagccagaaaagcacatttgtagttgtacttataaagatgattaacagtagtgcttataaaatggactggatcagagatcctttatacaactgtaaatgctttatatattatttctataaatcaccctgggttcttagttattcatattttaaaagttcattgataactgtatattaagatgctaaaataatagaattgcttttgcaaatacaaatatatgccaaatagattccagttatcaatcatttggtaatttactcctctgtttataaatttcaaaatatgttccaaggcgtggaatctgagaattcttttttccaaaacattgtacatattatatgagctgtgttaaagtgaatctaatcttagtctatgcatcatcatatttcagaagctgttacccaggtcgtgatatgtcttttttcacatacatgtgaatatgaaaatagcactatatgtataaaatttctttttatggtaactcacaaatattatttctctgcatgtttattttatactgttttattttttctgtagccaacttcattagatctgcttgtttgccctcaggtagaacatctgttaagggaataaatgattgatggttgagtagaatctagggaaataatcgagatgaaagaagcagtgttgtacaaaagttaagagctgcagatttgggcttgacaatttggaatgaaatattaggttttccactaaatagggctttttaacctatgtgcctcactttctacatctgtaaacttgggagagtaattcaagatgctacctacttcttaggattatcatgaggcttaaattaggtaatacatgtaaaagctcatagaacatagtctgataagtggaaaggactaatagatgttagctataaatcattattttcataatttgagttacatactctaagaaaggtccacatataccttactagaatagttatcaaactttattatgcaaattttattgtacaaatttgtttttttatgtattttgttttgtttgtttttccataggttattgggggtacaggtggtgtttggttacgtgagtaagttctttagtggtgatttgtgagattttggtgcacccatcacctgagcagtatacactgcaccctatttgtagtcttaaccctccccctccacccttactcccaagtcattaaagtctgttgtatcattcttatgcctttgtgtcctcatagcttagaccccacatatcagtgagaatatacaatgtttggttttccattcctgagttacttcacttagaataatagtctctaacctcatccaggtcgctatgaatgccgttaattcataccttcttttggctgagtagtattcctttgtatatatatgccacagtttctttatccacttgttgattgatgggcacttgggttcgttccatgattttgcagttgtgaattgtgctgccataaacatgcgtgtccaagtgtctttttcatataatgacttcttttcctctgggtagatacccagtagtgggtttgctggatcaaatggtagttcttttttttttttttttttaaattatactttaagttctagggtacatgtgcacaatgtgcaggtttgttacataggtatacatgtgccatgttggtttgctgcatcaacttgtcatttacattaagtatttctcctaatgctatccctcccccagccccctacccccccacaggccccagtgtgtgatgttccccgccctgggtctgtgtgttctcgttgttcaattcccacctatcagtgagaacatatggtgtttggttttctgtccttgtggtggtttgctgagaatgatggcttccagcttcatccatgtccctgcaaaggacatgaactcatccttttttatggctgcatagtattccatgatgtatatgtgccacattttcttaatccagtctatcattgatggacatttgggttggttccaagtctttgctattgtgaatagtgccgcaataaacatacatgtgcatatgtctttatagtagcatgatttataatcctttgggtatatacccagtaatgggatggctgggtgaaatggtatttctagttctagatccttgaggaatcgccacactgtcttccacaatggttgaactaatttacactcccaccaacagtgtaaaagcattactatttctccacatcttctccagcacctgttgtttcctgactttttaatgatcgccattctaactggcatgagatggtatctccttgtggttttgatttgcatttctctgatgaccagttatgagtattttttcatgtgtctgtgggttgcataaatgtcttcttctgagaagtgtctgttcatatcctttgcccgcttgttgatggggttggttttttctgtaaatttgtttaagttctttgtagattctggatgttagccctttgtcagatgggtagattgcaaaaattttctcccattctggagatattagccctttgtcagatggataaattgcaaaaattttctcctgttctgtaggttgcctgttcactctgatggtagtttcttttgccttgcagaagctctttagtttaattagatcccatttgtccattttggcttttgttgccaatcaaatggtagttctacttttagttctttaaggaatctccacactgttttccatagtggttctactagtttacattcctaccagcagtgtagaagtgtcctctgatcactgcatccacaccaacatctaatggtttttggttttttgattatggccattcttgcaggagtgaggtggtatcacactgtggttttgatttacatttctctgatcattggtgatgttgagcattttttcatgtgtttgttgcccattggtatatcttcttttgagaattgtctatttatgcccttagcccacttttagatgggattttttattttctattttttgctaatttttttgagtttgttgtatattttggatatatattagttctttgtcagatgtatagattgtgaagattttctcccactctgtgggttgtctgtttactctgctgactgttccttttgccatgcaaaagctctttaccagctatgtatctttgcttttattgcatatgttttgggatcttggtcatgaaatccttgcctaagccaacgtgtagaagggtttttctgatgttatcgtctagaatttttatagtttcttagatttaagtccataatccatgttgatttgatttttgtgtaaggtgagagatgaggatccagtttcattctcttacatgtggctagccaattatcctagcaccatttcttgaaaagggtgtcctttccccactttatgtttttgtttgcttgttgaagatcagttggctaagtatttgggtttattcctggtttctctattctgttgcattggcccgtgtgcctatttttataccagtaccatgctgttttggtgattgtggccttatagtatagtttcaaatcaggtagtgtgatgcctccaggtttgttctttttgcttagtcttgctttggctatgcgggctcttttttggtttcatatgaatgttagaattttttttttctaatttggtgaagaatgatggtggtattttgaatggggattgggttgaatttgtagattgcttttggcactatgtcattttctttgttgttttttttttatttgtttgtttgtttgtttattttgtttttgagacggagtctctctctgttgcccagactggagtgcagtgacgtgatcttggctcactgcaacctccacctcccaggttcaagtgattctcctgtctcctcctcccaagtagctggtactacaggcatgtgccaccacacctggctaatttttgtatttttagtagagacagggtttcaccatgttggccaggctggtttcacaatcctcacctcaagtgatctgcccgccttggcctcccaaagtgctgggattacaggtgtgaaccaccatgccaggcccagtatggtcattttcacaatattgattctacccatccacgagtgtgggatgtatttaatcataaagggatgctggattgtgtcatctgtgattttgttcagcagtgttttgtagttttccttgtagaggtctttcacctccttggttaggtggattcctaagtattttattttattttttttgcagctattttaaaaggagttgagttttttatttgattctctgtttggttgctgtttgtgtgtagaagagctactgatttgtgtacattaattttgtatccagatactttgctgaattcttttatcagttctaggagctttctggaggagtctttagggtttttgaggtaaacgatcatatcatcagcaaacagtgacattttgacttcctcttcaactatttggattccgttttttactttctcttgtctgattaatgtggctaggacttcgtggtgagagtgggtatccttgtcttgttccagttcttagagggaatgctttcaacttttccccattcagtgttatgtcggctgtgggtttgtcatagatggcttttattacattgaggtgtgtcccttgtatgcccattttgctgagagttttaatcataaaagttgctggattttgtcaaatgctttttttgcatctattgagatgataatgtgatttttgtttttaattctttttatgtgaggtatcacatttattgacttgtgtatgttaaaccatccctgcatccctggtatgaaacccacttgatcatggtggattatgtttttgataatgttgttggatttggttagctagtatttcgttagggattttagcatcgatgttcttcagggatattggtctgtagttttcttttatggttatgtcctttcctggttttggtattagggtgatgttggcttcatagaatgaattagggttggttcccggtttctctatcttgtggaatagtatcaataggataggtataaattcttctttgaatgtctggtagaattcagctgtgaatctgtctggtcctggacttttttctgttgttaatttttaaattactgtttcagtcttgctgcttgttattggtctgttcagggtatgtattttttcctgatttaaggtaggagggttgtatctttccagggaattatccatctcttctaggtgttctagtttatgcacattaaggtgtccgtagtagccttgaatgatcttttatatttctgtggtgtcagttgtagtatctcccgtttcatttcttattaagcttatttggattttttgtctccttttcttggttaatcttgctaatggtctatcaattttatttatcttttcaaagaatcagctttttgtttcatttatcttttgtatttttttgtttgtttcaatttcatttagttctgctctgatcgtggttatttcctttcttctgctggttttaggtttggtttctctttgtttgtctagttccttgaggtgtgacatgagattgtcagtttgtgctcattcagtctttttgatgtaggtgtttagggctatgaactttcctgttagcactgcctttgctgtattccagaggttttgataggttgtgtcactattgtagttcagttcaaataatttttaaatttccatcttgattatatttttgacccagtgatcattcaggagcaggttatttaatttccatggatttgcatggttttgaatgtttcttttggagttgatttccagttttattctgctgtggtctgagagagtgcttgatataatttcagttttcttaaatgtattgaggcttgttgttttgtggcatatcatatggtctatcttggagaaagttccatgtgctgttgaatagaatgtgtattctgcagttgtagaatggaatgttctatatatctatatatatatagatatatctgttaagtctgtttgttccaaggtatagtttaaattgattgtttctttgttgactttctgtcttgatgacctgtctagtgctgtcagtggagtattaaagttccccactattattgtgttgctgtgtatttcatttcttaggtctattagtaattgttttataaatttgggacctccagtgttaggtgcatatatgtttaggactgtgatgttttcctgttggacaaggccttttaccattatataatgtccctctttgtcttttttaattgctgttgctttgaagtttgttttgtctgatacaagaatagctactcctgctggcttttggtgtgcatttgcatgaaatgcccttttccaaccttttacttcatgtgagtccttaagtgttagatgagtctctggaaggcagcagatggttggtgaattcttatccattctgcagttctttctgtctttcagatggagcatttaagctatttacattcagtgttagtagtgagatgtgaggtaccatttgattcatcatgctatttgttgcctgtgtaccttggttttttgttttgttttgttttgtttgctttttaaattgtattttttataggtcatgtgagatttatgctttaaataagttctgttttgatatttttccaggaattgtttcaagatttagaacttcttttagcagttcttgtagtggtggcttggtagtgacgaattttctcggcagttgtttgtctgaaaaagattatatcttcatgtatgttgcttagtttcagtggatacaaacttcttggctgagaattgttttgtttgaggaggctgaagataggaccccaatcccttctagcttgtagggtttctgctgagaaatctgtggttaatctaagtttccctttataggttacctggtgcttttgtctcacagctcttaagattctttccttcgtcttaactttggctaacctggtgacaatatgcctaggcgatgatctttttgtgataaattttccaggtgttctttgtgcctaggtctctagcaagactggggaagttttccttgattattccccaaaatatgttttccaagcttttagaattctcttcttcctcaggaacaccgattattcttaggtttggtcgttgagcataatcccagacttctctgaggctttgttcatattgtcttattattttttctttgtctttgtaggattgagttcatttgaagaccttgtcttcgagccctgaatttctttcttctacttgttccattctattgctgagactttccggagcattttgcatttctataagtgtgtcgtatgtttcctgaagttttgattgtttttttatttatgctgtctatttcattgaatatttcttcttcacttcttatatcatttttttttatttccttgcattgggcttcgcctttctctggtgcttccctgattagcttaataactaatcaataatcttcagaattctttttcaggtaaatcagggattttttcttggtttgtatcaattgatggtgagctagtgtgatttttggggggtgttaaataagcttgttttgtcatagtaccagagttggttttctggttccttctcatttgggtaggctctgacagagggaagatctagggctgaagtctgttattcagattctttggcccacaggggtttcccttgatatagtactcttccccttttccaatggctgtggcttcctgagagccaagctgcagtgatggttatctctcttcttggtctagccatctaccgcgcctacccggctccaggcttgtactaggggttgtctgcacagagtcctgtgatgtgaaccgtctatgggtctctcagccgtggataccagcagctgttccagtggagatgacaagggggtaaaatgaactctgtgaggggtcttagctttggtggtttaatgctctatttttgtgctggttggccccctgccaggaggtggtgctttccagagagtatcagctgtggtagtatggggaggaaccagaggtgggtggggccctagaatgcccgagtgtacaccctttgtgttcagctaccagggtgggtagggaagtgtgtccggaattggttccttccagtgggttcttggtctcactgacttcaagaatgaagctgtggaccctcgcagtgagtgttacagttcttaaagatggtgtgtctggagtttgttccttcagatgttcagatgtgtctggagtttcttccttctggtgggtctcgctgacttcaggaatgaagccgcagacctttgtagtgagtgttacagttcttaaaggtggcacgtccggagttgtttgttcctcccgatgggttcgtggtctcgctgacttcaggaataagccacagaccctcgtaatgagtgttacagctcataaaggtagtgcggacccaaacagtgagcagcagcaagatttactgtgaagagcaaaagaacaaagcttccacagcgtggaaggggaccccagtgggttgctgctgctggctcaggtggccagcttttattcccttagttggccctgcccatgtcctgctgattggtccattttacagagtgctgattggtgcgtttacaatcctttagctagacacagagtgctgattggtgtgtttttacagtgtgctgattggtgcgtttacaatcctttagctagacacagagtgctgattggtgcacttacaatcctctagctagacagaaaagttctccaagtccccactcgacccaggaagtccagctggcttcacctctcagaaggaccatcaggtgggggcagggcccaggatgtctgagctcagactctccttgggcaggtcttgctgcagctgctgtgggggatgggggtgaggttcccaggtcaatggagttgtgtacctaggaggattatggctgcctctcacacgtccttcaggttgtcagggaatttggggaaagccggcagtcacaggcctcacccagctcccacgcaatccacaggggtggtctctcccaccatgcccctgctagcagcaccaagtctgtttccaggcagtgggcaagcagggctgagaacttgcaccaggctacctgcttcccatctgtgaaagaaagtagggctttaattttcctgttcaagttgttaccaagatcagctggagatttccttctccctgtggcattttcccagtgcctctggccgccctccagaaagatccctgtaatgccagacaggaatggcttgcttgtggacccagaaagctcacaggactttttcctctgatgcctctatccgtgtatttcgcttggctgtctaaattgactcagctccaggtaaggtcagaatcttttcccataaactagacattaagtttccccagtgaggatgtgtgttcgggggctgagaatctccctttcccactttctcagtttgggcagtcacattatctcaggtgtctcctgggtcctgcaggagcggtcctctttcttcagagggtctgtgggtcctctcgggtttcctgatttattcctgcagtcgttctgtagccaaaattcaccgtgtgaacctccacacgctgctctgttcatcccagtcagagctgccatgtagtcctgcctcccatccaccatgacagccaatctccctgctgcacaaatttgtgaaaaacgtatattcccatgtcatggtgaagagattctgattcattaacataaggatgagacccagaaatagatgtttttaggaaacatcatagataacctgataaataacatattttcagaaattttctatgggtttcaaaaagtgtaatagttgcactatggtggtaataactgatacattcaggtactactagtgaccatgtaaatcataaaactttggaaacaaatttgccattttctaaagagttattaaaatgttatataatttgattcaattatcttattttttattgttttttgtaaggcagtaatctagaaggttattttaatttatacattatttccaagattttgatattaaaagtgacatagaatctaaattattgtttatctgctcaatggatcattatataaccattaaattttataattatgaatactgtagtatcagggaaataaaaggtagataaaaagcataaatctcatttatttgtacagtacattttcaattgtctaaagattgtctaaaaataaagagtaaaggaatatgttcaaatttaaagtagttggttttggccaagtgtggcagctcactcctgtaatcccagcaaaatgagaagctgagatgggcagatcacatgagaccaagagttcgagaccagcctggccaacacggcgaaaccccgtctctactgaaaatacaaaaatttgctgggggtggttgtgcacatctaaaatttcagctacttgggaggctaaggcatgagaatcacttgaacatacttcttgaataaagaagtcacttcctggactctaagccaagagtctaagccaaatatcagaccagtttttccagggggccttattagcattcatttgttaaagtcaaccttagtttcttaaagctgaccatcatatctaattttgcacatcatactcactaatggtttccagattctggaggaatcaagtagagagaaaaagtaattatttcaattttatttataaaaatataatctaggccaggcatggtggcttatgcctgtaatctcagcatttttggagtccaacgcaagtggatagcttgagcctaagagttcaaggctgcagtgagctatgatcacaccgctgcactcttgccttattgatggagagagatgctgtctctttgtaaaaaacagaaaaacataacctaccacattgcggtaaactataaatatcctaagagaaaatgcttttcttaaatctggaagccaaagcacaaaagagccagcaaaattttgaagaaaaggttattaaataattataatcacccttttcagtttatttagtcaaatctaattaagtcttattctgctgtatcttggcttggcaattttatgagctcatcagttgctttattagagttgtggaaattcttacccagtccaatggtatgatcttaaagttatcagaaacctttattctgtagcacttttcagagccttttccattagacactttggcctatatcagattgtaaatgctttcagagaagaatcaaagtaaaacaataaattgagaatgacaaaaggcttaaaatcaccataaagatctgatgagagtttatttgctaaggaaatttatttattgctgtggctaatgatattttaacataataattggaattgtgactggtaacattatgccaaacctatcatgaataacatattgacaaatttctatcaactttatataactcctgaaacacttatattaataacatatatctatatacatataacctaaagaagatatagcatcagttcttatttgacagtacttcctctgtaatttaacaaatcaaactaattaacataacatctctcttttacaaggcaagagacaaatcctttgatattttccaggaaccctctgggaactctcaatgttaatttaaagtcaaagatacgttatgtagaatttgatttgggccgggcacagtgcctcatgcctgtaatctcaacactttggaaggccgaggcaggcgaatcacctgaggtcaggagtttgagaccagtctggccaacatgatgaaacctcgtttctatcaaaaatacaaaaattagctgggcatgttagtgcccgcctgtaatcccagctactcgggaggctgaggcaggagaattgcttgaacctgggaggcggagcttgcagtgagctgagattatgccattgtactccagcctgggcagtaagagcgaaactctgtctcaaaaaaaaaaaaaaaaaaaaggaaaaaaaagaatttgatttaatttgggaaagtttgtcaaaaatgtcagaaggttttaaacactagaatcacacatcattataaaacaatacttatatataagtattgtttattactttattacttataaacaaagtaataaaatattttataagcacatatagaagttacatagttgtaaataaaactgagtacttttaacattgaaaggattccgcttttttaagtaatcaaaataactgataaaggtaacatgaaattgttcaaaataactgataaaggtaacatgaaattgttctaacatacaaaaccttgattttctaggcagattacttaaaaactgggggaaaaccctttcacgatatcgttatcaagagcagacaggtaatccaagaaaagtatgtcattttaacagagaacacagaattctaatatggcatgtgttctattaatactaaggctttgtttgtttgttttttgtttttaagagacaaggtctcactctctgttgtccaggctggagtgcagtgtagctatcatagctcactgcagcctcaaactcctgggctcaagtgatcctcccacctcatccttttgagtagctaggactacaaggatatgccgccatgcacagctaatttgcctaatttttgtggagatggggtctcactgtgttgcccagcctggcttgaactcctggcttcaagtgatccccccacctctaatgctcaaattgctgggattacaggagtgagccaccatgcctggccactaaagcttattaaaaaacaacaacaacaaaatacttttgactaaatctgtccaatcttagccaactctaccacacaaaataagatcctgtttccaagattacttttccacaaacctgtagttttaaaaaatatattcagtttttgtcctgttcttttttctctttctctttggcacaaccagtcattcttactttaggacaaagtgacactctttttcccttaacaaacccacatccttcattcttttcctcatcaaaaaacacattctacttcccttgaatactttgcatatagggttttttcctgattagatttttttgtgtgtgtgacagggtctcactctgtcgcccaggcttgattgcagtggcacaatcgtagatcactgtaactttgcactgctgggcttaagcatacctccacaaccaactaattttttaattttttgtaaagagttctctgttgtaaagactcatctacttgtaaagacgagttataaaaagtttataaccttttatgaatataatttataaaagtttataactttataaatataaacttttataaattatatttataaaaggttataaccttttggttataaaaggttaaccttttggttataaccttttataaatattatttatgaaagtttataagttaacgtgctttcatctatttaattcacttttaataattatgcttggattgctcatgaaaatttcatgagacactgctcaaaggtagatattctcttaaattttgttgttgacaaatcagacaagtatctaaaatatcacagaagcaaaaatcctaataaacaaaaaccttgtttttgcctttttaaagtgtatacatcaattcatttttattgtacatttgattcttaggttgcatttatagttttattctcataaatatctggtagagatagcataagtttgtttgatgagtaaacctaagtggaaaacaattatatgtcgtattatgtttaatgctgacaactctgacaacattcctgtttttattttaccaacaatctttaaaccagttttatttaccaaagattatcccagatcacatgaacctaaaataattaggttagttttcatatttttgagagttttaggaatacctagtttatacaagcactgatttttctttacatcaattaaatggagcccttttgtataattttctatctggagatagaaaaatatcacaaatctatgtcatgcatacatacacacacacacacacacacacacacacacacacaaacagattcaaataaagatcttacaggtttcatttgaaaatttctgcaatgagtcaataaaacatagtaatgtgaactcaactggtttatataaaatcttgtcttttcgccagcttatacttttattcaatttgtgattctggcatatgggacaaatcgaggttagctactcaatatgaggaccagtgcttttcaccaatatttggggagggtttttttttaagattttaattgcccttctgataggtaattttttttatttttctttttccacaacaaattcagatcttccaatcataagtagtataatggcagctgtggacaaaacttcagacaagtgactaaggagacatctagcagctgttcagttttctccaaactctgtctgagaaaatacaatacccaatctatttccaattagcctttcttttttatttttcagcagaccccctgaagcccttgagaactgagattcctaaagttcaagttactgaggggctggagtgggaagggaaaatgtctaacaggggtagatagagggatgcaggaggtaggggcttggagagaggaatatcaaggattcaagggatgtgcctttccttcaggtataggtagggtacctcttacatgagagtcttaaaatctgcttcagaggaatgccattaagtccttcctacacgtgatttctcacatgccttcagcttagaatattcagtataccaactgaatattttgtgatagcatgtactgaactcttcattagttaaaagttgctaaagtttaaggaagagagcatttaattctcaccctatcatattaaaaattgtatttgaataccctgaacgtagagaaaaagctgggcccagaactaaaataatatcagggtacctgatattggaattttgaactgaattgtgtctcctccaaatttatatgttgatgcactgattgccagtgtgactgtgtctggtctttaggaggtaattaaggttacatgagatcataaaagtgtggctcttcttatagggccacagtcttaatgcaataggacggtggccttataacaagaatacagactcacctccttctcttcctcatgacaacactgcaagaagatggctgtctttgagccaggaagaaagccctcatcaaaacctggccatgctggcaccctgatattggacttttgttatgtaatccacccagtgtatgtattttattacagcagccctacctgattaacacatctgccaagctgaaatgttggacacctgtcaagtttaaggtgtatgtaattgctttcttcagtcttgatatagataggtctttatttagttctaatctttttttcccttcatatttgttgccctcactggaaaacagtatgttttatgtagcagtaagagccttgtaaataatgtttttcaagtgaggacaggacagatagtgtttttgtttgtttgtttgttttgtttgttttttgacagtgtcttgctctgttgcccagtctggagtgcagtggcacaatctcggctcactgaaacctccgcctcctgggttcaagcaattctcctgcctcagcctcctgagtagctgggattacaggtgcacgccaccacgcctggctaatttttgtatttttcatagagacagggttttaccatgttggtcaagctggtgacagatagttttagttgcccccttcctatgaaaatacagaatactgaatccagtttttgtgtattcaattaaaattccactaatgcttcagcttttttaacaagaaaatatttctgttttgaatgtttaacacagagtcacaagatagtcatgtatgcatgcctggtattgaaaaaatcagtaaaaaactgataacttactgactatccaaattgttactatactttgatgtttgtattgtaccatgatgataaatctggtccttagcatagtaattgttattttcataatctctaaatcagtttcttctgggttctgagatccaaaaagatgaaacaaagactaattgttgactgaaagaaatataagtaacagctactgctaacacattttaaaattagaatgcataaattaacaaatagtgccaaaaagtaaacacttttttgcaaggcaaatcatatgccttatctactcccgttcaaattaataaaaatacactatttataaacatgtactactgtactttccttttagctttatttcagaaaaatgtggaataatttacacttccacctctcaggatgctgtcagcagtagcataatagcaaaagtagaagcattttgaaatttaaaaaaggcagaaattaattaaatttaaaacaaattaaaattaaaatatggtggcattataaagatgtgttctgataaaagtctagtatattttactattttgagaagcaaatcaactcatttatgaatccttttaatatttttctgtatttaattgcatttgctagagcagtcttcttctagggatgtttaagatccctttactattaatagctggaaaatgaatagtcagagtactgattgatgatatgatgattttagactattattattttgcatttatatagcatattgcctcatatgtattcaaatatttcataaaagcagttatcagaataacaaagtctgtatttgcacacaagtattacaaacaatttaaagatacacagattgaccctccctcatctgaaaatctgaaatctgaaattctctaaaatctgaaatttttgagtgctgccatgatgccacaggtgaaaaattgcacacctgacctcatgcagtgaattgcaatcaaaactttatttcaagcacaaaattattttaaaatattgtataaaaatcatctttatgctacgaatataaggtatatatgaaacataaatgaattttgtgtttagactttagtcttatatgatttggctgtgtcccccctcaaatctcatcttgaattgtaactcccacaattcccacatgtcataggaggaacctggtgagacataattgaatcatggtggctggtctctcccatgctgttctagtgaaagtagataagtctcacaagatctgatggtttttaaaacgggaatttccctgcacaagctcactcttggcctgctgccatcttagtaagacgtgacttgctcctccatgccttctaccatgattgtgaggcctccccagccacgtggaactcttaagtccattaaatctctttcttttgtaaattgcccagtctcaggtatgtctttatcaacagcatgaaaatggactaatgcagtaaattggtaccagtagtgtggggtgctgctgaaaagatacccaaaaatgtggaagtgactttggaactgggtaacaggcagaggttggaacagtttggagggctcagaagaagacaggaaaatgtgggaaagtttggaagtccctagagactcgttgagtggctttcaccaaaatactgataatgatatggacaatgaaatccagactgagttggtctcagatggagatgaagtacttgttgggaactggagaaaaggtgacacttgttatgttttagcaaagagacttgcccctgccctagagatttgtggaactttgaacttgagaaagatgattagggtatctggcacaattgatttctaaacagtaaagcattcaagaggtgacttgggtgctgttaaaggcattcagttttaaaagggaaacagaacataaaagtttggaaaatttatagcctgacaatgcgatagaaaagaaaatcccattttctgaggagaaattcaagctggctgcagatacatgcataagtaataaggagccaaatgttaatccccaatacaatggggaaaatgtcaccagggcatgtaggaggtcttcgaggcagcccctttcatcacaggcccagaggcataggaggaaaaatggtttcacgggctaggcccatggtccctgtattgtgtgcagtctagggacttggtgccctgtgttccaaccactttagccatggctaacaggggccaaggtaaagcttgggatgtggcttcagagggtgcaagccccaagccttggcagcttctacatgatgttgagcctgcgagtgcacagaagtcaagaattggggtttgggaacctctgcctagatttcagaggatggatggaaatgcctggatgtccaagcagaagtttgctgcaggggtggggctctcatggagaatctctgctagggcagtgcagaagagaaatgaggggttggagcccccacacagagtccctactggggcacggcctagtggagctgtgagaagaggatcattgtcctccagacttcagaatagtagatccactgatagcttatactgtgcacctggaaaagcagtgcacactcaatgccagcccatggcagcagccaggagggaggctgtaccctgcaaagccacagggtcggagctacccaagaccataggaacccaccttttgcatcagcattacctgaatgtgagacctggagtcaaaggagatcatttgatttgacgtaagatttgactgccttgctggctttcagacttgcgtgggggctttagcccctttgttttggccaatttctcccatttgtaagggctgtatttacctgtaccctcattgtatctaggaagtaactaaattgcttttgattttactggctcataggtaaaagggacttgccttatctcagatgagactttgggctgtgaacttttgagttaatgctgaagtgagttaagactttgggtgactgttgggaaggcatgattagttttgaaatgtgaggacatgagatttaggaggggtcggggtggaatgatatggtttggctgtgtccccacccagatctcatcttgaattttaactccctcaattcccacatattgtgggaggaacctggtgggaggtaattgaataatggggttgagtctttccaatgctgttcttgtgatagtgaataagtctcagctgatctgatggttttaaaaacaggagtttccctgcacaggctctctcttggcctgctcccatccacatataaaacatggcttgctcctccttgccttccaccatgattgtgaggcctccccagccacatcaaactgtaagtccattaaacctctttattttgtaaattgccctgtctcgggtatgtctttatcagcagcgtgaaaatggactaatacatatccccaggatatctcattatatatgtatgcatatattccaaaatccaaaaaaagttgaaatttggaaaaacttctagtccaaagtatttcagataagggatgttcaccctctgtctgtccaaaaatcatgaacgaagatctagtttgtgtgtagaaagttgcagtttcaccctaaaaagcaaaacaagctggataagtcatataattcaaagattatataatcaaaattttggttatagcgatctacgagtagttgcctgaggtagagggaatttactagaaagggaaatttgagatctttcttggatgatggaaatagtctatatgttgcttgggtggcagtttcacaattacataaaattgtcaaaatccatcaaacataacatcagagatcattattttttgtatatatattaacttgatatgaaaatctgaatgtggtttaatatgattcaatttgcatttaatttaaaatagattaatttagcaacagtagcaacagtgaaggtggaatacgttgaaaataaaggttatgacttttgtgggcactgatagtcaatgggttgtcagaaagaagagtagtaattcccattttttgtgtggaaccatggatactggtagaaaattttttcagttacactagttctgatctgatctcccactatgattgtataaagcagtgaaaactcatttaatattcttccaggactttcatttatcaatgcctaccaggcagtgataatcaggatagccatatgctttgtctactcttggttaaattaatggaaacaacaacaactttatataatatggtaactatactgtattgtggtagtcaaagttagattcatttagcttgctgcaatgcatagggaggctgtgcaaggagctaaggtattttggtacaagaagttactaggaattcatcataggattcagggttgtgcttaaacgtggtttccgtggactcagtgtccttagagtctgctaggctccatgtgggttcttccttttgtgtcagcctccaggaaactcactcaagcctttgaaaatcaggctcacctatttgtttcctgtctctctggaatcactatctttactcttgagtttaatcgtttgaataccaagctgttgatatatatatcttctgacttttttaggtgttttagaaaatagggaaaatccagtatctttattccttcttggtcagaaataaaagttctcatattttttttactaaaatgttggggtagggtgatatgtggatagacaaaaaagttaatatgccagtgcttatttgtaaaacataaagcttaaatgaagaaaagtaatattaaaatagttatacatcgttttttaaacactatgttcaaggcatcttgatctgtggaattatgtattttagctaagttgtactaaatagtactgattcagatatacaaatcataatacttatcagctaattgaaagctccttgagaggaatatttaatggtttaattttgaacatactacatattttaagtatcaaatgttcagtaaatatatatgtggaatacatgttttctgtgtcagacactgatatggtttggctctgtgcccctacctaaatcttacctcaaattgtaatccccatgtgtcaagggaaggacctgtaatcttcatgtgtcaagggatggaggtgattggataatgtgggtggtttcccatgctgttctcgtgatagtgagttctcacgagatctgatggtttgataaggcagttttgcctgctcttgctggctctctcttgcctaccgccatgtaagacatgccagcttccccttctgccatgattttaagtttcttgaggcctccccagccacatggacatgtgagtcaattaaacctcttttctttataaattacccagtcttgggtagttctttatagcagtgtgagaacagactaatacagtaaactggtaaagtggtgagtgaggtactgctatagagatacccaaaaaggtggttgtgactttggaactgggtaacaggcagggattggaatagtttgtagggctcaaaagaagacaggaaaatgtgggaaagtttggaacttcccggagacttgctgaatggtttttactaaaatgctgacaatgaggtggccaatgaagtccaggctgaggtgatctcagatggagatgaggaacttcttggtaactggagcaaaggtcactcctgccttgctttagcaaagagactagtggcattttgcccctgccctagaaatctgtggaactttgaacttgagggagatgatctgaaattggaacttatgtttaaaagggaagcagagcataaaagtttggaaaatttgcagcctgacaatgtgatagaaaagaaaaatcaattttatggggagaaattgaagcccattgtagaaattttcataagtaatgaggagtggaatgtgaatagccaagacagtggggaaaaatgtcaccagggcatgtcagagatcttggtggccacccctcccatcacaggcccagtggcctaggaagaaaaaatggtttcgtgggctgggccctgagcccctctgctctgtgcagccttgggacatggtgccttgtgttccagctgcttcagctccagccatggctaaaaggggccaaggtacagtttggtccattgcttcagagggtgcaagccccaagccttagtggcttccatgtggtgttgggcctgagggtgcacagaagtcaagaattgagttttaggaacctccacctagatttcagaggatgtatggaaacacctggatgtccaggcagaagtcgggtttaggggcagagccctcacagagaacttgtacaagggcagtgcagaagggaaatgtggctttggagcccccacacagagtccccactggggcactgcctagtggagctatgtgagaagaggaccaccaccctccagaccccagaatggtagaacactgacaaccagtaccatgagcctagaaaagccacaggtactcaatgccagcccattcaccaaagctgcccaaggctgtgggagcccacccattgcatcagcgtaccctggatatgagacttggagtcagaggagataagctttcaaattgagtgactgccccaatggatttagaacttgcatggggcctgtagcccctttgttttggccagtttctcccatttagaatcggtgtagttaccaaatgcctgtgccaccattgtaacttaaaagtaactagcttgggtcctttttgagatgcagtgttgctctttcgcccaggctggagtgcaatggcacaatctcgactcactgcaacctccgcctccccggttcaagcgattcttctgcctcagcctcccatgtagctggtactacaggcacgcactaccacacctggctaatttttgtatttttagtagagacggggattcaccacattggccaggctgctcttgaactcctgacctcgtgatccacccccctcggcctcccaaattgctggggttacaggaatgagccaccgcatctggccttgttttttattttacctgcttataggcagaagggacttgcctgtctcagatgacactttggactgtagacttttgaattaatgctgaaatgagttaagactttgggggactgttgggaaggcatgattggttttgaaatgtgaaaagagatgagatttgggtgaggccaggggtggaatgatacagttcggctctgggtccccacccatatcacatcttgaattgtgatccccatgagtcaagggagggagctgtaatctccatgtgtccagggaaggagatgattggatcatgggggcagttttcctcatgctattcagtaataatcagtgagttctcatgagatctgatggtttaaggcagttttccctgcttgtgctaggtctctcttgcttgtcgccacataagacatgcctgcctccccctccaccatgattgtaagtttcctgaggcttccccaaccatgcggaaatgtgagttaattaaacctctttttttttttttgtaaattaccctgtctcaagtatatctttataacagtctgaaaacagactaatacagacacctagcatttcttattagaattcataatatttattccttccctgagcttaagagccattttcaggtaagatgagaactaacatctatttatataaatccaataaaatatatgaattttgattacaaatgctaattttcactcagttttaagcttctatttcttatgctagtttctcttcattatgttgctatagatctactgattatccactttatgtctttctaaatattcctttatttactgatatattaaaatttttgaacaattaactttatttatcaaagactaacataattcctgatctcttggtagttaagtggggaaggcacatatctatcaaataagcactctaatttgtatataattaaggctgaaataactataccagaattaaggataaagttttgtaaagactgaaataatctattaagtctcatgcacagaagagacatagttcaggaggtattttggatgaaaattgccaaagatattgtagctgaatcccaaacctgagaaatattcttggttttttagtatttttccttcatcaccaccgccattgccaccatccctcttcagtctagtccattaccaaatcccattagctccttctccaaaataacatcaaatccaactatattatctattctaccatcaccctggtttaagccaacatcatctctaacttgaacttgcagtatttctaaatatctgtttccattcctgtcatcctttaatccattctctatatagcagccagagaaaccttttattaaccgtaaatcagaccatgacatttttcttcttaaaaccttggtggctctctataacattcagaatgaagtccagtttattcaggataggctactagaccctggttcctgaccttctctccaatctcatctcatcaccattttattatttatttatttttctcctcactctcttcctacaagctatgctggctgccttttcattgcaagaataaaccaagctccatactattttggtgcctttcagtttttgctgtcctgtacctagaatgtttttctccagttttttacttatttggctcatcgatgttaaaatcagatcacctcttcagataggccttctccaataaccttgtctaaagtgacctcaagttattgtattaacttattttctccctcatttaattttatctccttaagttctgtgaaagctatgaattcattccatttatctttgttgtagctatctttgttggcacttaggtgctcagtaaaaatactttttatgtggatatttccccagtcttcttagtaaagtctgaactataatgaaggatcataatcatagcaaacatttatgtagtctccatataaattaataattgacagttgatgatttctgaaaaccataatccgtattcactcagtaagtgagtattttatattatagctgaaaatagcttacttttaaaggtataaagtaaaggataaggactcatacacacttataaagtctaaagttgttaattcagttcaacagataatttacatttaatactgaaattcactatttactatgttcagtgttgtgttaggcaagctgtctagcttaaaggacactaatgttcaacatgaattctaaatggagtaagtaattggagatctggtatagaaattgagtgaaatgcattattaaaatccatgaaaaccaacaagtcttagtagttattctttacaaaagccataattaagacccacacctcccaaactgtgcaccagggtaccccagactgccatagaaaactcttagggataccataggctttttttaaattttgagggaaaccagcaacatctgtcagatactatgtaaagtactatctcaaggtagttcgcagtttcagtgttagattgtacctttgatgatgtcacatctttatgaagctgggttttgcacagttaactgtgagaaaaagcaagtactacaggaaaattattgtggaagaggaaaggagggcaacagtatccaatatgattcaaaggtttaggatatgtacagggcccaatagttgtacccatcccattagtaagtaattgtagttactattaataattatttaaaattaatatgtttttactttcaatttgtatctattatttaacagctactaatttgttaggatataaaacttaagttgtttggaccttactacttaataaacagaactattagatacttcttttactgggtgccatgaaaacattattgagacacccagagcaccttgaactgagaaagtttgagaacttctgatatagccaaattttattttattttatttttatgattcaaatatcattttattgttaatagcatctttctggagatctggtcttcaacagactctctagaagaaatttatgtttatgataagtgggagactatactatagaagcatagagaaagagaaataatatttactgggtacctactatgttatagacattatttttatttcttgtttaatacttatagcaatcttaagatatataatgatgatcttcccattttatagacagggaaccaaaggtcaaaaaaattagatattttgctaggttacacagctaactggatggtgcctgaagaagctaaaggctttttatggcaatgactaatgtattattttcaacttaagaaagttagttggatggagtgacaaaggaacaaagatctactatattgtggattttattactgtaaataaacactgaaggttacttttttttttaaattcttagtccctattattcatgcaagtttttcatgtcatttgctggatcattaaatttgagtatatttggtagtcttatttccataatagagaatcagtgaagattgttttagtgtttcacatagttaaaattgtattttggtcacctacaacttgataatctatagaagttaagtactaccgagttagattttcattgaattttttattttaactgttttctttcttttttttttctttttttttttttgagatggagttttgctcttgttgcccgggctggagtgcagtggtgcaatctcggctcactgcagcttccgcctcctgggttcaagtgattctcctgcctcagcctcctgagtagctgggattacaggtgagcaccaccacacccagctaattttttgtatttttagtacagacggggtttcatcatgttgtacaggctgatgataacctgaactcctgacctcaggttatccacccgcctcggcctcctaaagtgcagggattacatacgtgagccactgtgcctggcctattttgactgttttcttgcctgtgtgccttgtaattataaagaaatttctggaacccatacaaagatattttctatttgcacttcattttctgttagcctcttctgaaacttctgcagtgttttgaattatctcaaccattctccacatctcttaacctctgtttcttattttctttctttttatctctctttgctgaattctatatcacttcttgagacctgtcttccagtttatgaattttcctttcatctgtatctgatctcctacagtcttctgagtttgtttctccagtcctaaaattattatatgtttcattcatgggaaccctggttggttattttcaaatctgcctagtaagttttcttacattttgtacttttctaggcatattaaacatattaatgttttctaataattctaatatttacagtatttttaggtctggttctgtagttcgtcgtttctacatatactttttgtggtagtatcccctttcccttccccttcctcttcctgttctcccttcctctttctttttccccttccctttcccctctttcgggcttttgagtgaatggagttcattccttcatggagaaatttgattctcccatgcacatgggatactgtcaatgtgaaaccactttcaattttggggtggtgtggattcaggccataaccctgcacaaatgtggatttgtggttattaattctcagggaagcccctttttctttttttttcttttcatattctacccaatccaaggtagacaggcatgtatctctttcaactccctttttggagttttggttgtttttcttagtttatccttttgggtgttactgactgcatctgaattttatgtgatatgacttcacatccatattgaactctgaaagcctggcttttaagcactgggctctttaataccaaggctgtaggccacacatcagcagataccaccagagtccagcaaatactggccccagaactctttccttttctggatttatgattcttttttgcttacagcctttatgaattcttttagtttccaaccagccaaccgtgtgcttaaataagtctttaaaaatgtgtattatattcacactttttagatgtggtatgctagaagtgaccttaactgaatatgttggtctgctatagtacaaaaaaaagcaattcattaaatattttgaatgacagcacaggattctgtgctgactcaagttagagcaagttacacactttagaactcttctctgaatttgctgtcactttacccaaaagtagaattagaactctttggctgccctcaccatagccaagtgactcctaatcctccagggaacatgtaaaatggtaaaatttgcctgaaaaatacagctgactttcataagactacagcaaattttgaaaggtacattggagcagtagtagtgataggaaaccaattgttaggctttctatattcattcttgaacggttaccccaaaagagtatcctaaaattcaagttaaaaattaaaacactgttaatttaaaactgtcttttctgtttcagtttaaaatgttaaatcaaaacagactttcttcttaccctaaaatagttacataagaacagtctgttgtcacagaagtcattctattataaagttactttattataaagggtatagtctctatttaaaatgttaagctacaaatatttatccttttgagccatctgtactgctaaatacccataagtattttagactaagatctgaaaaatggaaatactttaaaacctttgcattgttgattcttgattttttttatggcgtgtgtcttgctttgagcagaaatagattgatgcagacagcttacttgtaaaacattatgttactgtcatttaaaaaaatagttttaaaccctctgatggaaaggggcatctttagatgaagtaatttcattaaaatatccaattcagaatctaagtaaataaacttaaatatataaaaattcttcacttaatgtatttattcccataataaatatgttaatttcataaatttagagctctgttaggtgaatttattttattattttaaatcattaccttagctaacccagaaagtttctattgagaatgtttgttccccactttctcctcatgaaatcattttaatactgtataataccaggaaattgattaatgtcattaatcaactattattatggatatatattttattggatgcttatttcatatttcctttttgggtggcgttctattgaaacatgtgagaaaatattagtaacttgtctactctgcttacccccatcttatataaaccccatttccagaggactggaaactggaaagaagaatacctcagggctgaacatgacaggggcttaagaaaagtatctgagaaattataaccaaaaactgagcctagaatgaatttgcaattcaaattcatattgtctgcactgtataaaaaaatttacattttttcttacagcttttttttttttttttgagacagagtctcgctctgtcacccaggctggagtgcagtggcacaatctcggcgtactgcaagctctgcctcccaggttcatgccattctcctgcctcagcctcccgagtagctaggacaacaggcacccgccaccacgcccggctaattttttgtatttttagtaaagatggggtttcactgtgttagccagaatggtctcgatctcctgacctcgtgatctgcccgcctcagcctcccaaagtgctgggattacaggcgtgagccaccacccccggcccctgcttttttttttttttttttaaacaaaaccatcaatggaaggaaaaacactttaagtgtatgaatttagtttaaagtagtctatgatggatagtgcgttcggacaactgaccaaaacaaatgcagattctctggtgaattcactttgtcctaaaattcaaagaaataccatacattatttaccactgaacacgaaaagctacaaggaaatgaagtactatgaataagaatcatcagaaacactaagcagctgaatcaaccctacatagacattaaatattggaatgattggatatagagtaaaaaacaactatgcttacttaatatgttaaacaaaataaaactaaaaagcaaaagcctaaaaaaaatcaatagggaacagcaaactgtaaaaatgtcctagcaaatttggaaaataatcaattagaaattctagaattggaaacaaataatctaaatttaaaatcacatggagtataacagcagaacagatacaattgaagagagaaatagcaaagtgaataataggctaaaagaaattattgagaatttatcacaaagagcaaaaattcaaaaacaagaaagaggttcaaaactacactgtttcatgcacactggtgtatttatgatatatctcacaaaaatgtctaaaatataatcaaatatatggtcaaatatgctcattcatctttagagctttctataagaagaaaacaaaaggaaaaacattatgtgcaacagtaggggaaggatcagagagttaatagttcatccattacaaattatgttactataaatacttaacgtcatgagggaaatatttaccttaagagtattacatttatacattgatctcaaattcaaagaatagtaagatatgttatttatttaacgatacatataaaaagaaagaatatcttatttaatagtagagcttacttctgaatactagggatacaggtactttaaaattttctttgtaggctctttgtatttcccagttgttttaaactgaacatttagtacttaaaaaaaaaaaaagccagaaagctgctaataagtattaaaaagtggtacttagtgatgtattctagaacttttctgtgctatatctgtgcttttcctgtggtaagtgcttatcatatttttaaaatgactgatatttggctcttatagattcttaatgtatatttaaatgaagtggatgaataataaaagttagtggaaaatttataaagagtaaggccttgaatatttgcaacacactgaactgttgattactggggatttaagctgagagtcttcatttaggtgcaatttagtaagtgtcttagttccttttgtgctgttataacagaataccagagattaggtaatttataaagaaaaaatttatttcttacagttctggaaagccgggaagtccagtatcaaggtgctagcatctggtgagggccttcttgtggcatctcatggcagaaggaagaagggcaagagagcatgtgtgtgagagaggaagaaattaaacttgcagcttcaagcccttttataattgacattaatccattcatgagggtggagtcctcatgtcctaaacacatcccatcaggtcccagctcccaacattagggattcagtttccaacacatgctttttggggaacacattcaaactatagcagtaagcaactttgaagacgttcttgatttgcttattcaatatgtgtaagatctagcaatatttatgagataaatataatatgcaaataattttgttttaatttattcatatgataaatatttattgaatgtcttttgtgtgctacacgttgcactagattttggagatgacttgtgaaaccatatacagtctttgatgagatttagagcatagtagaggatatatatgtatgtatgttacatgcatatatgatttattcaggagtataaggcaattcaatattaggaagtccattaatataaaaggttgggggaaatgtggagagtaataccagagacaaacaactataaaagacatgtaagttgttgtctttgggcagaatcactatgaaatgatggttggataggtggcagctgttgttacatcatatatattttatcactgtcttatgttttcaagtttgtacatatgttactttactaaaaataaaagttaattttctagctgacatcaaattatttcttcctctcaagtcctttgtagctactgtcaccagcagaatatcccatagcctccttctaatatctcctcaccctggcagcctctgatacagggataaagtcctttgagttggctttggctcagttaccttcagtattgtccaattgattcatgataaaaacccgttgtctttatcatgctaaatgaccaaagtgtaaacttccaccttactgtcctttctccttgccttgctatcttcattggttccagtgagtctttcttttttagtcctcttgagcaaaaacaagcttttccacaattccaagggatacatgtcaaacgctcagaatgctttattgaacgctcttccttgacaccatctccctaaaaatgtcaaaacactctaacaacacttttccaaaaggaactcttttgccttgttagatttcaacattcttatatcccccagggtggtgtcacaagtgtcaaaaacagttttgagtctcattgtttacagttccttcatagacaatataataaatacctcactttggccttaacattctgatacatgttaattgttacactattttatccattataaagcataccacaaaattagaaactaaagagaattagattttttatgtatatatatatgatatcttcttttaatggataattatgcacattcctagtatgtgtgcagtttgatttggagaccattatattgaagattccgtcctgtttgggcaggattgcatatgcccctgagcctatatagctcttgttatagaaatttattgtgttgatttttttcactgttcaatatcccacccccatagtagaattgatttttagaagaaacggtgacagtttttagcagccatgatggtggcctagggttgaagaaatatgtgatgtattgttagagtccaagccatgctgttctattaaaatactatttttcttcctgctctttttgaagttgattttatttctgcttattttctaagcctgaatttctggccttcatttgtttttgttcttcttgtttttgtttttgttttgttttgtttttgagacggagtctcgctctgtcacccaggctggagtgcagtggcgcgatctctgcttactgcaagcccggccttctgggttcacgccattctcctgcctcagcctcccgagtagttgggaccacaggcgcacaccgccatgcttggctaatttttttttgtatttttagtagagacggggtttcaccatgttagccaggatgcatttctttttttttaatacttaagtttctttttcttgtttaagaaagttggagttaggactgttgttcattcacaacaaattgacaccactgccttaatatcataaagactctgtattgtttcagttgtttgctcattgggaaaatactccagggtgaggcctcccttacatctgagggacctgattccctgtgtagagagttctttttttttttaattgttccagtttatacttctggtagacttttaatcttcccccccactttaaagtcccagtatgccccactataaattgaaacattgtgttctagtctttatctacaaacttagagaaaattaattacttttcaaggtaacatattcaattttattttcttttttcttagatcactccagtatatccagcaaactcccttaaactaagcccaaactggtgttgttgcctgttgcaatttccttcactagagcatccagaaaagcttacttgcctttgcatataaaatctcttactttgggaggccgaggcgggcggatcacgaggtgaggagatcgagaccatcctggctaacacggtgaagccccttctctagtaaaaaaaaatacaaaaaaaattagccaggcgtggtggctggtgcctgcagtcccagctacttgggaggctgaggcgggagaatggcgtggaaacgggaggcggtgcttgcagtgagcggagatcgcgccactgcactccagcctggacgacagagcgagactccatctcaaaaaacaacaacaacaacaaaaaaactctttaattgctttaaaacagctaaccaagtcttatttcctttatcttcttgtatttttcttatattaccttggcaaaatgaaaaatttggggatttagtgtttgccaagtcaccatatggataaatcaccactagtgaagaataaactatatccatattatgttactttaaatgaaacgattacatttcatcattaccctcagaattaaacctgttatttacactactacttctcatcctttcttctaataggctccaagctttctcctttttcatctttcatctatcccaataaaaacataacttccaattttaattagaatagctatatataataggttgaccaactgtgtatcttctgtagccttctgcctataacctgattataaaattgctttaactaaagtaagttactgcctattctgagttactctattacacaaaatttaattttattacgctactttcttttccatattattttcctcctagcctcttccaattctttgtcttcttgatctcccttattaatccttttctcagggaaggaagatctgatcagccaattcactccaagatttaagtgactagtggttggaaatctgttcctcttcagcattacctgtaatttaaacaaggaattaagttgtattggctttggtgaggcacaacgtgtgtttgtatatgagaatgagttctttatagcacccattcagtcacacaaggctacctacttgtaagtctaatgtttagagtaaacagtgaattatctaatacattttgcatttcttacaccttgaaagaatgttgataaatttccttatacaagtagtctgatctgatgttagacaaatagtgaatactcagttttattgattaattgagtgcattttcagaatactgaaagattaggaattgtggttgactgagcattttgttaagatgttattagagacaaatacaaaaaaattctggctctctggattggactctgtgtagattgattccatctgtaaaaggtgcctcatctttgacagtagatattttagtcactgttacttgttagagattcaatatagcaatgcaatttttttttatttacttataaggatttatgataccaagttgtatttgacatttggattaaatcctgaggggtaaggaagattcgtccctgtggtagaagtttctaaagtcttaagtcaaatgaattctacttacactttagttagaaggccatttaagacaaacgtgccttaaaagatcaagtttttcagtgttaaaattctacatctcaatataggttatgaatactacattaagttcatttggttatgaattcattattttcaccttttgctgctattgttatacttcaactctcttatttttacaactttttattttgaaaactttcaaactttaaaaaaatgttgggacaacagtataatgaacagctgcactctgcacacctagattctcatgattgagaatacatgctgtatctatttatatctctgtcttgccttctctctatatataacttaaaaactgtttcagacatagtgacactttacccctgaatacttcagcatgtttccctaaaattaaggacattgttcaccgtactcttatcatatgctggaaatgttaacattgagacaataatatcataaaatataacatacaaacctatttttagatttctccaattatctcaaaatattatttatagattttttgattcagtattctgtgagggattataaatgataatttgatagtgatatgtcttcaccattttgttatatattgtcagaaatttgatgtagaataattcatatgttagcaactgtggaaagtgttgccaattatgaaaaaaatgtaaatttagataatttagaaatagtccactaagacttttattatatagttgattatattaattaaagtaacttgaattccttgacagtttacttatgtataatgagtgttcatgatgccctaattgaatttttatttttttaaaatttaatttttaaaaataataataatacagtaaaaaaccctttgtgatctttcttaatagtcacatcatcactctaccctgcctatcacagatctgttttacatcactatagtttgtgtttttaagaatgtcaaataaatagaatcagaaagtatgaccagcttctctcagagtagagtctctgagatatatccaagttgtgtatgtcaataatttattcatttttatggtagatagtattccattgtacatatataccatagtttgtttatctactaacccattgaaagacatttgggttgcttccagcttttggctgtcacaaataaatctactgttaatatttgtatataagttttggtatgaacataagttttcatttctctataaatacccagatgtacaattgctggctcatatgataaatgtatacttaacattataaaaacccgccaaactgttttccaacatctgcatcatttcagtattaggctcaatcaattgtcttatcccatgtgaatttgtatcctgtattactttataagactctgagtcttatttagatcctgtggaaaatattgatatttttgttttggccttctgtggattgtgtggttctaaccttggctctattttacaagactttggtgtgcaatttggatctgtcatgaatgtgtaccctctagtggtcactctgggaccagcttgtagatctgttcttagctaaggcctttaaatatttgatatgctaattagtatcaaatccataaatgggcagatccagggtgagtaaaagttcaaaacaactttatgtagttgctttcctggtctcccttccctaagtactttctacttcccttggggctgttttttttgttattgttgttcttcaaaaaagaaattgtttctttctgcagttttacgacatcctcacaccatttagcactggtgataagatgccaccaaggctacatggtgggaagacagggacatagggaaaaaattctacagggtttggtgctgcccttttggcattgctgcttctctgaaaggtaggtcgacctccctcagagttttgactcctgcagtctctcatttctgtcttcttttattttagctgccatgggactgttcagggtttggggcatagaaaaatgaggaagaggagagggggaaacaaaataacctggagatttctcctactctttctctgtctgcactgtaagtgttcagaaaatttctcctggacctcactcacaccacatagtgctcagttctgggtttctggcttcagaggtagtggaggaaaataaatgttaaactcaacattggtattcttccctcatctgtctactagtgttaacttttcagagttttcagataagtctctagccaggttttttagttgaattagcatgagataaagagagtctggtcttatttcatcttactggaatcaggacccctaattgatttttaaatggtattgttgatacaattgtcaggccatttatttcagtatttcactaagtaacttctaaactgtgaaaaaagtaattataaaataaacatcaggtatttttgttcttatttgtatctttgacatgagataaagtttgtggaagatttaacaagaacatcataagaagttgactataaattagatgttaattcattaatttattcactccacagaaattaaacgagtactgactcttggcctgggattgcagatattataatgaacaagataggcagagctccttctcaggacgggttaatagatttgagacagtcatttatagtacattgtaaaaaaaaaaaacaaaactgccccagagttaatgttaaaaattgttttattattttttctttaagataaaacttttaaggggtcaggactctggtaatgttgaatgtacattaatgcatttatgtatggacatagctgaggattttgttaaaatgtgccttaaatgattacataaattaaataagcaatttgttcagcaggttaaaaggaagatatttcatatttttgtaaatgaacacatgaaattttttcctttaagattttaaatgccaaattatttacttaggtagtgaactatagtgttaacattaaataaaaagagatctacatatctactcctatttctgtattaataaactgtgatgatgtatcaataagtaggatcatgtgccattaggacttgaaataatggaatatggtacgtcctaaagcttattttgtcattcatctagccaataatattaattacttaatatcactgctcaagctatcatctttgagaaatactgatttaacaatagtttacactaaatatgtaaaaaataattttaaagtcaagcaaaccataggttaattaccccattacttgagaatgcaaaaaaaatacttttactatagtacttattaataaactcatttttaaatttaaattgcaaaagttatcacaggctttctatggtatatggaattataataacatacttttaattgatgtttgttggaattcacagcatttatagactttttaaatagactttattttttggcagttttaggttcatagcaaaattgagcagacagctcagagattttcccatataccccctgcacccttacatgcatagcctcccccattatcaacattctttaccagagtggtatatttgttgccattgaagctacattgacgtatcattattacccgatccatactttatagtaggattcactgttggtgttgtatattccatgggtgtggacaaatgtattatggcaccattatacaggttgaatatcccttatccaaaatgtttgagaccaaattgtttctgattttggattttggaatatgtgtatatatgtagtgagagatattagagatgggacccaaatctaaacattaaatttatttatgtttcatctacacatggcctcaaggtaattttatccaatattttaaataattttaggcatgaagcaaagtttgcctaaaacgaactataagaaagcaaagatgtcaagtgtggaattttccacttgtagtgtcatgttggtgcttaaagtttttcaggttttggagcatttcagatttcagattttcagcttcagaatactcaaactgtagtataatctagagtagttccactgccctaaaaatcctctgtattctacctattcatccctttctcctcacaagccaccagcaaccatggatatttttaatgtctctatagttttgctttttccaaaatgtcatatagttggattcttatagtgtgtgtccttttcagataggcttcttttagttagtaatatgtgtttaagtttcctccatgtcttttcatggtttgatagcttatttctttttaccattgagcaaaaagaaatgagttgtttatcatccactcacctactgaaggacatcttcgttgtttacaagttttggccattatgaataaagtctgtataaatatccacatacaggcttttgtgtggacatagttttcaattcctttgagtaaataccatggattatgattgctgcatcatgtggtacagtgtgtttagttttgtaagaaaccaccagactgtcttccaaagtagctataccattttgcattctcaccagcaataaatgagacttcttgttgtttcacattcttgccagcctttggtattatcagtgttctgaatattgaacattctaataggcttatagtcatatctccttgttttattaatttgcattttactgatgatatatgatgtggagtatcttttcacattattatttgtcatctgtgtatcttctttggtgatgtgtttgttaaggtccttggctcatttttcaatagagttgttcattttcttattgttgagttttaaaatctctttgtatattttgtataacaattcattatcagatttgccatttgaaaatattttcttccagtctgtggcttgtcttttcgttcccttcacagtgccttttacaaagcagggttttttttttaatttttaatttttgtgagcatatagtaggtctgtgtatttgtaggattcatgagatatttagatataggcatacaatgcgtaattgtcacatcagggtaaatggagtatccatcacctcatgcatttatcctttctttgtgttacaaacaatccatttatactcttttagttatttttatatgtacaataaattactgttgactatagtcacccagttttgctgtcaacagagttgttaattttaatgaaatctaacctactgtttctttcttccaaggatgttgcctttgctgtcatatctaaaaagttattaccaacccaaggtcatctaaatattcttctattctaggagttttatatttttatgttttacatttaggtctgattcattttgaattaatttttgtgaaggctgtcaggtctgtgtttagattcattttttttgcacatcatgtcttttaagattctgagttctttcggaagacattccttggctgggattccaattttggctctgcaaggacatatcactactctcatactaaaaatcagacttataattgtagtctctgttttccaagtcaggaaataaggaaaggaccaggacaccagtagtagccatggtcttaaggctccaaaaagatgtagagaggaaaatacataaatacattaacttagtggaggtgagggaggaggatgaccttggtgccccctcacttttttaagcacaggtaaagttgattcataataatgtcaacatgtacttctttaattttttggtagcaggaaaaaggtaaattaaagcttaccaatgttttgtaaaattctaagtatcactggccctcttgtattttatcaatgctgaaaatgtgatgcttgaatccaaaaacaaatgaaatcaaggtttgattaaaccggttctaagacttcattactttgctacttctgacttactgccacatattactattactcctaattgtactaggttgctttggtttggattccagcaaacgaggtaagttggcacaagtgacctaaaaataaagtttttgtactgctgggatatcatttggctggttttctaattttgttgggcttggatcagaattaattatgtgttattttcatatcaatgtcaagtctgtatttatagcattctttttttttagaagtcacagaatttttaaaagtagcagaaaaacaataaatgatattgaaaaaattttagtacttacattttcgtcatgatcttctaaagcctcctaaaagaaacattgctcttgtgaatggtgctgcagtgaacctacacattcacgtgtctttataatagaatgatttatattactttggatatatacccaataatgggattgctgggttgaatggtatttctgtctccacgtctttgtggaatcaccacactgtctttcagaatggttgaaccaattatattcccactaacagtctataagcattctgttttctctgcaacctcaccagcatctgttatttttggactttttaatagccattctgatggctatgagatgatatttcattgtggtttttatttgcatttctccaatgatcagtgatgttgagcttttgtttatatgcttgttggctgcatgtatgtcttcttttgagaagtgtctgttcatgtcgtttgcccacttattaatggggttgtttggatttttcttttaaatttgtttaagttccttatagatgctggatactagacttttgtcagatgcatagtttgcaaaaattttctcccgttctgtaggttgtctgtttattctgttgatagtttcttttgctgtgcagaaactctccatttgtagagccctgcaggatagatttagcataattcttgaagaccctagtattttcagaatggtcaatgagcattggcttcaacttaaagtcactagctgcactagtccctaccaagagagtcaacctgtcctgtgaagctttgaagccaggcattgacttttcctctctctatgtgaaagtcctagatggtatcttcttccagtatttaaggttgtcttatctacattgaaattctgttatatagaatagccaccttcatcaatgatcttagctagatcttctggataacttactgcagcttctacactagcacttgctgctttacctcgtatgtttttgttacagatatagcttcttaaacctcatgaagcaacttctgctagcttccaacttttcttctgcagtttcctcacctctctcagccttcatagaatcgaagagaattagggccttgttctgaattaggctttggcttaaggaaatgttgtggcttctatcaagaccactcagactttctccatattagcaataaggctttctctctcttgtcatttgtgtattcactggagtagcacttttaatttttttcaaaaactttccctttgtatgcactacttggctttttgccataagagaaggttatctcagcttttgacatgctttcttctctagcttattcatttctagcttttgatttaaagtgagagatatgtgactcttcctttcacttgaatagaaaccactgtagggttattaattggcctaacgatgttgtttctcaaggaataaggagacccaagaagagggagagagacaggaaaatggccagctggtcgagcagtcagaacacacacatttactgattaagtcccctgtcttatatgggctcaattgatgttgactccaaacaattacaagagtaatatcaaaggttaattattacagtttacaatagcagacatgatattaatgaaaaagttttaaatactacgagaattactaaaacgtgacacagacgtgaagtgagcacatgcacttggaaaaatggccccagcagacttccttgacatgggttgccagaaaccttcaggttgtgaaaagcacaataaagcgaagcacaataaaaaaatgtgtttcttaaacaacaagactataatggacaagaaagagctgagactagagacaggagaccaacatgttaatcttaagtcaggaatcctaaagtgaagcaataggagtggttaaaaaaaaaaaaaaaagagaagagagattgatttaataaataattgtaatatagaattagtagcattgaatcctgatacacccacagaaaatatatacaaacgtgtttaaataatgaaaatttatggtagattctgttattggccctgattttcaaccatgtccgtcaaagccctttgccatataattttttaggaacccactgttgggggtggagtggacttccttgccttatgaatttgtatttgaccacttaacttgttgttaccaatggatagagcccctgggtatatacttactctcttgtacatccaccatgcaataagaatatgtgtgacagtattttggtgtcaggagaaggatgagagatacatgggggagagctactcccaggcctggaccagataattcttcagttagccatgtactcatgaatgaacccagctgagcccagcctggagcagccattttttaagcagtgcacagatttaggataaataataagttatgattgttttaagcccctgagttttagggtggcagtcatagctaactgatataaagtttctattctgccaaaaaaaaaaaattttaaagaaagttatattctattctattttcacacatcaattgatgtgaaaacaaaatataatctactgatccaacaggaaaactgcttgcattattggttttatttattagactgccttaatgcagcaatcacgcagctagaaagggaaaaataaaacgaatataatttataaaaatagctttattgagatataccttatatatcataaaatttacttattttaagtgcacaattcagtgatttttagtatacttatttttgccactgtcaccacaatgtaatttcaaacatttccatcatcccaaaagaaatctctgtgcccattaccagtcactttttttctctcccacctccagcttaagactatgtaaccacaaatctacttcctatcactatagatttgcctattctagacttttcatagcaatagaattatacaacatatagggatttttgtgtttagcttttttcactgagcattttttaaggtgcttctatattgaagcatgttttagtagttcttttttatttctggatagtaatccattatctgagtttatcacattttgtttatttattcatcagttaatggatatttgagttttccactttttgtctattatcaataatggtatgaacattcatttacaagtgtttgtacaaacattatgtttttatttctcttagataagtacttagttgtagtagaatttctgggtcatatggtgactctgtcttcagcattctgagaaacttaaagttttccaaagtgactgtgccattttacactcccaccagaaatttatgagggaaaactgatagtaatttaattatactgaatattcaatttatactactagtgactttcatatcataatacagaatgataactatatataaaagataataatcagataatctgaaaataataaaactgtgaaatgtacttctctctatagtgagtcatatgtgtaagttatgcagcaggtgaagaaatgtgtaagataggccttttaaaacacaatcttaaatcttattaaggttttctagagtaatataaataatgcgataatagaaataagatctacttattttctactattctgtaaaattattaaataattaaattttctttctatagtaatcttgttacaccaagctcactttgtactattgtgcctatacagaaattacactaatttttcctccattaaaacattaaaatagccttttgacttttatagacttcagagaagttgtcattatatctcaagtgctatgaatgtgaactgtgggaatgtgaactttactaagaatcaattatatagcctaagttggtgttttatatttgtttttcctgcactgttatggaaacctgtaaaatatgttaacattgaactatttggtcttatttagacagtattttatcttacaatgctgtatgatgaaatcctgcactcaaataaaacattaatcagcagaacttaaataaaaatatatgactgttaattttgtagtcttcctacttgcttagaaattaaatttctaataaatctttgtctctgattttgtgcaaaacaatgctattggctggtgacttcactgtctaagaatatggatttataaaggtatagagagtatcggttatatagaggtatcaggtaaagttcatgcaagccaaatatttttaagcattcaatggtgttttcttgtaggaattaaatgtatttattagcttgactttactgactatgtttgcttaatattaatctattagagcataactgcataacatgggttttaaatgaagcttgctgttactctaaatttatgtcacaaatgtggctctgggaaatttttcaagtttgtctcagtgctttaagccttataaaaatgagcaagtaactcataaataatagacagttcctcagaagtcatttaaagtgcactccttttattggcaaaatttccatatgttctttggctctttgagatgtagactctgtagagctatttaactaccattattttctggtgatttttttcaggtacctttctttatgatttatggttctgtaaaatcttacctcagtgtgtagctagaattatttagtcacatatttttaaataattttaaaatttcgtaaaaattcctgtgacccatgaacatcatcaaccaatgttatgagataaaatacttccctccccaaattagaatgcttttctttcatatatttcaagcgtgagtcagaattggaaaggtactaatttaaatgcattgtgctttctctaaagtggacaaaaggaaaataatagttaataagagagctttctagcatggtaccaaataaatatttgggctggtgaatgagcaagagaagtacaacaatccacttgtcctgactttcaagagttttctccttgccaacttatcacatttgtaattaattaatatttgtgcatttatctgcttaatgtcttcctctctttattataagttgtataaacacaaagattgtctatcttattctctcctttacctctaaccccaggatattgtggggcacatggtagaagttgctcaaaaaagtttttgttgaatatattcatgaatttgaatgttttgccctacaaattaactttaaaagtacttatggagtacatgccgatttaatatacctataataaatatgaatattcattgcatgtgtacatgtcaatatttaacagctatcatttatttaatgctttttttcaactttacaaagtgccctaacatatttttttaaatgtttgttgctcacagtaatcctgtgaggcatatgatgatattgctgtcattcctccatatccacaggtttcttatctaaacctgtggttgtgtaggcaggggcacaactgtgctttgcatccacagatgtggagggccaacagaactcgagcatcctctgcattttgtatccacggtggtcctggaaccaatcctccatggatatggagagtcaactgcatttccattttataggcaagcaatatggagtttagattaaaaaaaattgtttgctccaagaacacataagtttttaagtgatcaatcctggacttgaatcatttgtttttactgtcttttggatggcaacattaactttgtaccatatacctagttcttcattaattaagagatggttacaaaattaagatacatataattgtcataagatcctcaaataaataaatgctttcagttattttacatgtgctgagaatagtagtcacctttgataatgagaatgaagtataataaatctaggttatgatgtttatttaagtctgaatcatgtaaaacagaacaggcatacttctaaactaattctgttagacagaaatagaaatccctgacaattaatgaagtagcacatagtggtctttgaattacctgaattagttattttcttacatatgccacagatacttgagttcagctcattaaattttctattatttcattaaaaccaatgcagttagcggtaataggggagtgaaaggagaaggaaattgtgtagagcaagatactttatttgagagtggttatgtatgaggtggaggtggggaatccaggaaaaccatggagttatgaaaaaattaaaactcattggtatattttatttgaactaaagttgatacaatctccaagaactagaagtatttattacataaaatcatctttttcaaaagtatatgtaaaccttaattgctgtcagaaaaatatgcacaatagtgtgtatacttgcattaaaaagggatatatatatatatacacgcacacacacacacacaaatataaatgggagatataagtgcaattgcatttattgattgattgagaccaattctcactctgtcacccaggctggagtgctgtggcactatctcagctcagtgcagcctccacctcctgggttcaagcgattctcctgccttagcctcccgagtagctgggataacaagcgcgtaccaccctgtccagctaacttttgtatttttagtagagacagggtttcaccatgttggccaggctggtctcaaactcctggcctcaagtaatctgcccacctcagcctcccaaagtgttgggattacaggcgtgagccaccacacctggctgcaattgcttttatatgcatagagggacacataaaaatctggttggcagggtagggaggaaaactttttactgtatgcacttccctaacattatagttatttttaccatgtgaatgtgttgtggtctttctgctccttaattcagctaggtccaagtctttttctcacaaccaggaagaattaggcaggcatgtggacactgtacagtgagtggaatagaatttattaagtgaaaggaaaaattctcagccaagaggggatgtggtggggaggggtgtttcccccacccaaaggtgggaaaattccccgtgtagctggtcctgggccttttatggacttagaatggggagtatgtgctgattggtttgtgattatgcaaaaaaggttaaagtgaagacaccactcaaaggtgggcacgacagtgtagaaaaccaattaggaaagggtaggtatatataaagtaggtgaaggtggggatcagtcagaggaaaggctgccacacaggaagacaagttatcgatccagtccaaaggttaaacttgtagcttggctttcaggctttaaactgtctttggcttgaaagtgggatttcacaggggacccaccccctatctgcctaggcatttggctgcctcctatcactctaattttccccctctgaaaaggtacctctaactgccattagaataggaatgaagacgatcttaactgctttctgctgatagagggcactgtttggggaaaatagcagtcaaatctccctcagaggcttgtctaaggatccccagtaaaagggagccatcgtttgaagctacagttgcgtgaccattttgagtttgatggcctgaaggcgagaagagagaaactgggttattagaagacatgtatcaaaatgaaaaaagggggtaaggacagcttagaaatcctgaggctgccaccatgccaggataactggtggctgtagttgtacctgctaaggtttgggtgcatggggcttggctttggttagctcccttggccttattttcccaaagaaacctccgggttatgggtaccccatttatttctatcacctggcaggatttgcaggataattgcccagaactagaatattgatccagaattttactttacccatccctctgtttcttgtgagctgcagccagagaccactgtttggttcacagggttagtctaaaacgtaggcaaaaacttaaaaacaaataatgagattagaatttaatggcaagtgtatgataagttttgaaacataatttttctctctctagtcctcatttttgtcaaaaacaaatcatgataggactgagttgtttgcaaaataaattttaatcttatacttggcttgaatatttgcataaagtgcagcaagaataattatttttcacgtaggcttttaaaattggctttgatggaactctgttccacaaggaatctcagataagactttcttaaagccgagcccagccatgggtttctaccctcaaatgcctgtgatttgggtaaattccactcttgaggtcccaagataacttggggttcctgggtctattagaaagtgacattctttactcaccacaggttaggaaccctgtatagggactgtgtagacaaggtatgaggccagttttcccaaggggctctgcaagtcaaacttgactccttaaaggaaggcataaccttctactcaaagccttggtaaaacaaccagtttctctaattgtgtcctgttgcaaaagaaaatggattcttattgcactgatgcaaataacaatattaccataagttaaacatacttactgttgttggtttaaagtcttttttatctgaggtaagaatagcaacccctgctcttttttgttttccatttgcatagtatttctccagctctttactttaagcctgttggtgtaacgtgaaatgggtctgttgaagatagcagagggatgaatctggttttattatccaacttgcaactctgttacttttaagtgcagcatttagactgtttacattcaaggttaatattgatatatgaggctgctttgatcatatggtgaagttgttagctggttgttttgtagtttccattgtgtgactgctttatagggtctgtgcactgtatacataagtgaaatatgtaatataactaattaaaatcaaatattgaaaatttaaattagagaaacttctgaattatagtttttgtatatttttagaatagatttattattttacatgtatacaattactaagataatcacaggcctctgtttaaattattgctttctcagaggttaaatagcaccacccaatctaaagttgttttcatgcattatgtcacatcatcctctttataatgttttctttacagcacttacaatatttgaaattttctacttattcatttactacccatttcccccggtagaatgtaagatccatgaatacaattactatatgtgttttgttaactttctatctagcacatgaaataatgcctagcacataataagttctcagtgaatattcagtgaaagaacaaaagtgtttagaagtattattttaataaatagataaaattttagtagtgtatcaagagtctttataatctttagagagccacagtgtttcttgtgtagtttaaaaattactctgtaatctcatttaattatgttttgcacgctttgtatattgtaagaggttaatttatatgaggtctgtcaaattgtcatataatctataagtttttaatgaatgtttattgtatccatattatatgaaataattacaatgggttggtgggggcccacgcgggttcaacatgcatatcgagaagtgttatttctgttcagggcccatctaccctggccacagcatgatgttcatccacaatgattgcaaggtgttcagattttgtaaatctaaatgttataaaaacgttaaaaagaagcataatcctcgcaaagttaggtgaaccaaagcattccataaagcagctggcaaagcacttatagtggataattcatttgaatttgaaaaacatagaaatgaacctatcaaatacagagagagctatggaataaaagtattgatgcaatgaagagagttgaagagatcaagcagaaatgccaagcgaaatttataatgaacagattgaagaaaaagagcgacagaaagttcaggatatcaaagaagtcaagcaaaacatccatcttatccgagcctcttttgcaggcaaagggaagcagttggaagagaaaatggtatagcagttaccagaggatgtggatatggaagatgcttcttaaaaatctctgtaaccatttcttttatgtatatttgaagatgccctttggagacttggaactgctaaattattagtttattttttacataggtcacttaaatgaaaagtgattaatatatctttcctacatttccatctacaaaacatcagatattacggatattagattgcatctcagtgctaaattttcactgatagatatacttaatgtaaatcatgaaaattctacttataactatagaagtgaattgtggatgtaaaatggttatgccatttggataatggcactaggcagcatttgtataataactagtgacaaaaattcatggctagtgataaaatattatttacagtaaaatattccctttattaatattatagaaggggggatacaacaagaaactaacaatttgtatgacagtgtcaaatattattttgattttagtacttcctgttttcgtttatttgcatcttagaagagcataatgacattgtttgatgaagcttaattatgctgcactgctttgacctggtttaacccttctgataggtagttgtggatgttggggatgagaactgaataatctttgcctggagtgacactacactctagaatttccactttggagaaatactcagttcttttttttttttttttttgagatggagtctctttctgtggcccaggctggagtgtagtggcgtgatcttggctcactgcaagctccgcctcctgggttcacgccattctcctgccttagcctccccagtagctgggactacaggcacccaccaccactcccagctaatttctttgtatttttagtagagactgggtttcaccgtgttagccaggatggtcttgatctcctgacctcgtgatccacccgtctcggccttccagagtactggggagaatactcagttttaacttgcgattcctggtagagcatactttatttttctagcctagcaatgatgtagaagcagaggaatcccagtgccttttaaaagttattatgtggttttcttttaaaaagctcctgtttttggaaagtagaatttatgggtacgccatctgttcattatttgcacataaaataaaaccttttgaaaggttaaaaaaaaaaaagaattacaatggaattttactagtgttcattaaaaatatgaccactaaataaaactgcaaataagagaaatggcatatttctaaataaaggcttctaattaatatactaattaccaatggttcatgtcagaatgttaaagctcttgaaagatttcctaatttgcttctttgtaaactactttctctttaagaattatgtaaggcataataatacaaactgattatattccactggccaacctatgtgaaagttctttaaaatgaggaatatattatggtcgatatctttaatgataattacctttccatggtgtaaaatctgaagaacaatcttgtctttatgacagcatttatatatgaaaatttaattctaagaaatatatggatttgcagagaagtgtcacatagtaaaaaaaaaaaaaaaaaaatctgggctctgggatgacattgttctaagtagcagactgttttctgttcataaccttgagcaagttaacttttctgaacctcaggtatagtgctgaaacagtatatgtaaaaatgcctaacacaatgcctattagaaatgctcagtagattctaattctcttttcttcccgagtaaagtggaagcaaagactcttctcaaaagtatggtggccacatttaccaaaatagtagaaaaaaagaatggtgaggtaaaaaggtacccatttaacctcactaaggatgactgtatttaccagtgttaaacaggggagtttctaatcaaaggcttttaggaatcaattttgaccatattttaaaacaatagctacatttattttccaaaattattttggtctttaagtcatagattatatggtaatataaatcagaatgtcttctatcttcaattttggctaaaggcaaatagtaatacctaatacttatttacatgcatactatatactgtcagccgtccacatctgtgggttcctccacatccatgggctccacatctgtgaattcaaacaactgcagttcaaaaatatttagagaaagacaataaaagtaataaaaaataccatattacaactattttttttttaatctttttttttttttctttttttattattattattatactttaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaataggcggtgtttggttttttgttcttgcgatggtttactgagaatgatggtttccaatttcatccatgtccctacaaaggacatgaactcatcattttttatggctgcatagtattccatggtgtatatgtgccacattttcttaatccagtctatcattgttggacattttatataatattcatattgtattaggtatcatgagtaatctagagatgatttcaagcagggttccccaaaccctgggccattgaacagtagtggtccatggctggttgggaaccaggtcacacagcaggacgtgagcggcagacgtgagcaaaacttcatctgtatttacaaccactcccattaccgcctgagctccaccttttgtcagatcagtggcagcattagattctcatagaagcacaaaccctattgtgaactgcacatgtgagggacctacattgtgtgcgccttatgagaatcgaatgcctgaagatctgccactgtctcccatcacccccagatgggactgtctagctgcagcaaaacaagctcagggttcccactgattttacattgtgatgacatgtataattattgcattatatattacaatgtaataagaatagaaataacgtgcacaataaatgtaatgcatttgaatcatcacaaaaccatgcccccaaccccccaatccttggaaaaattgtcttccatgaaaccagttcctggtgccaaaaagtttgggaaccactgatttaaagtatatgatgggaggatgttcgtgggtcacacacaaatactgtgtctttctatataagggacttgagcattagtgtatgttgttatctgcagggggagggaaggtgttctgaaaccagtccctcaaggatacccagggaggactgtaccaagtactgttctgtaaacttggcctagattaactcatatagttaatcctatatggtaggtttttttttttaatcattttacggatcaggaaactgatgcaagatgaattaagaaaacgtgcctaaacttacacaacaaatacgtgccaggtcagggctgagattctgatctaggtaaactgactctagattttatgcttttaattttcacacagtattctgagataaatccagagaagtggtacaaacttgaaacaggtctaaaaagttaagcacagaatggattgagacctttaaaaagctgaaggaaaaatatagagaataacttctgtagctatatatcatcaagaaaaatcagtaaatctattgtatagaaataatagcacaaatttaaaatataaagataatataattacttattgtacatgattagtattctaagtttaaaatataataaaaattaaagaattacttgactttttaaaaacttttttcttttgccctcctgtgaggacagtcattattattttaaaaaagaagataatcatatttaatagttaagcatgtatgcacttagttgctttaaatgatttaaaaatactatcaacctgaactactatatatccagataataaaaaaatgaaaaataacatgtgatgtcagaaccactgttaatcttttagaaatctgttgattatctttgagtaaaaagaacagaagggtgaaccttgattgaccacttcccattctttctgatgtgagagggtatctcaagtcaaaaaagaacaggtactgacaaggttgcacagaaaagggaacacttattcactgctgatgggagtgtaaattaatttgcccattgtgaaaagcagtgtggcaatatttgaaagaaaaaaacagaattaccatttgacccagcaattccattattggatacataaccaaaggaatataaattcttctgccataaacacacatgtatatgtaagttcattgcagtactattgacaataacaaagacatggaatcatttaaatgcccatcagtggtagactggataaaggaatgagagcatgtcttttgcagcagcctttggagccagaggctattatgttaagtgaactaatgcaggaacagaaaaccaaatgccgtatgttctcacttataagtggaaaacatggagtacacatggattcaaagacaggagcaacagacagtggggcctacttgagggtagagggtgggaggagggagtggaacgaaaaactacctattgggtactctgcgtattacctgggtgacaaaataatctgtacaccaaactcccatgacgcacaatttacctatatgacaaacctgcacatgtactactgaaacagaaaaaaaaaagaatgactgaatgtacactatgatggaaaagctgtataatttattatctacatatagtcatctatttagaatgaaatatatatctggataattaacttcagctgatatgtactagttcttcatttcaatctttcttattcaggaattgattaaatagagactccagttccacctgtggtggagtagcttctatgaaaactagctagaatacataaaacaattgtttgaaggaattggagaacaaccagtttaagcaggacttgagggataatggttcttgggagaacagaatagaagcactggaaatgaactccacatttaccctaactttttccctgagagcatttttcaattcctagtgtggaagactggaatccaagtggaaaatgacaatctttctgtcattagccaactttagccagctcttaagatgcatatgtatatgtacaagttgaaattccaggaaattcatcaataaacagaatttgagtgtctgaacaagttagcagagatttcaggaggtgcatgggactaagaagaaaggctgaattttaagccctgccaaggcagaagggccttggtaaacttagttggaaccctagaaggactacactttaggagtgaaggcaaaatactgaaaaaaagagaaaaactatagttttagatatttactagttactcattgcatttagatatattgaatgaaacactagactcacaaaaacagtaaatgaacagacagttcattagaaaatgccacattgaaatacacacagaaaaatgaaaggtaaaaccaaaggaacctaagatacgtatggcacatggtaaaaataactgacatttgtgcaatattcccaaaagaaggatggatagacagaatgatatagaaacaatatttgaaaaaatactgattgagaattttgtaaaattgaaagcatcaaagcaaaaatttaggaagcaagataaattttatatgcacatgtgtttgtatatgtatatatacacatacatacatatgtgcaaacacacacaaagccaggtatactgtagtcaagctgctgcaaaacaaagaaaaaatttcattaatcttgcctctgcttccagtctttttagaacagtgattttaccaactatagttttctttcctaagtccattatttccccccatttttaaaaaaacttagcgtccctgttgatggctttcaatatagttagcttctcaacttccttggtcctaatcctctcctcaaattccacctttgtctttataagtagagttacttcatataagcttttaatttttcaaactatgtgttgaaaaagaaaagtaatatgaaagaaaagatttatttaaaatatttcaagatgcctattacgcatttctactcattatattcactctctgtagtaagtatataagactaaagacttgaatctataattcccttagttagtcccctcagacttctaatgggaagaggctccctaggacttctaaggaaggacaatgggctgtccttcccctgaatttctttaatttttacattgctagtcactagccctgtatatctttccctggtactttttcagtttctaatccaggctgccaaggagtactagagagattatcatcctttctatttgttctattgcagactcgctttttgaacagaaaaaaaaaaaaaaaaagaaaagagggaaaatgaagagtgaaaatagtgaataattctgggattgagcctagagaagtagaaagtgttttatcagtaacttctgtcttcttagtaagacagagggcaaatttatctgatatgggtatgtgttataagcttagggggaaaatggaaatttggaattgctatcagaatacatagagtaattgctttcagaataaacggaatagttgctactcatgccagtagatgtgtgagccagctacaaagataatcagaagagttgtcaagtatcagtcatgtccaagccacagttaaatagcatacatttataataaattatatcactgattcccagcaacatacaacaatgtttgtatgtagtaagtgttcaaaggattattaaataattgcagttatcaatagtgtatctgagatgactaaacagactaaagaagagaatacttgcacatatcaggaaaagatctaatagtcataatgaatagtgttttacgaattgccaacaaaagttcaaaacaatataaataatagtacacaaatgaaaattattcataaatatatggatctatttgaagaatttggagataactcagaggaaaacctctaaaatatacaaagatttagaaaatcaaatttatgaggaagattaaagttaactgggaatttttaagttactaaagataaaactgagtaatgatctaaccaactagtatacagagttggtatatatggagaggagtatggccatctgtttggtatatacatgcaagacagagcaaaataacatcaatataaattgcaaaatgagggagttttaaaattatttatcctaatggaaaaaaagtatatggcatgagaaattagaatagattaccagatgattatagagaagataatctctcttttaagttattgaaaactaaaattgatttttaaaaattctatttcatacctgctttattctaaacactaggccaagttttggaacacagaaatgaatagctgacactattcctgacttttcaatattctgcaggaaaagagctatatgagcagtgactttgaaagcaggactttttatgatgataaaaggatcaatccattaggcatacatgacaattataaacatacatgtacccaaaaacagagtttcaaaatacattaagcaaaaactggcagaattaaagggacagacagacaattaaacaataatagttgggggctttagtaccccactttcaataatggatagaacaactttgcagaagaggaagacattatagtccagagttatacagtaaaaccatagaaataggtactcagtaaaggtagaatataggagtttatttctaagcattcatggggtgaaggatgcattaagggaatagaagatgaatgtttgaaacaactcaagataattgactagtcgtctagattttaaaagatacgtatactatatatataatatacatatatacttgtctgctaggatcattagagaagaacattttagacagtgtgtagaaaaatgtggatatgtgtaaaaatttgtatctttgggcagctatttgtgactttgaattgttgaaactttaataagtatactgaagtggaataagggacgattgtaatactgggacatgaggctgaagaggtatgattctgtctcaagacagtgaagcatatagataatgctagagtacctacaataattaccaatcatctatgaaatataccaaattttaattctaatctttcacttcttaaagtgtatgttagtcaggatcttatctgatatagttttaaaaagtatttttaaatatttgagcctatgtagagtttttaaaaattatgttaccttttttaacttttattttatgttcaagggtacatgttcagatttgttatacaggtaaactcatgtcataggggtttgttgtacagattattttgtcacccaggtattaagcctagtacccattaattatttttcttgatcctctccctcctcccgtcttccaccctccaatagaccccggtgtgtgttgttcccttctatgtgttcatgtgttctcatcatttagctcctgcttataaattagaacatgtggtatttggctttctgttcttgcattagttcacttaagataatggcctccagctccatccaagtccctgcaaaggacattatcttgttcttttttgtggctgcatagtatttcatggtgtatatgtatatgtacattttctttattcagtctaccattgatgggcatttaggttgattctgtgtctttgctattgtggatagtgttgtgatgaacatatacgttgcatgtgtctttatgatataacgatttatatttctttgggtatatacccagtagtgggattgctggatcaaatgagagttctgtttcagctctttgaggaattgccacggtgctttccgcaatgcttgaattaatttatactcccaccaacagtgtatacatgttcctttttctctgcaacctcaccagcatctgttatttttggactttttaataatagccattctaattggtgtgagatggtatctcattatggttttgatttgcatctctctaatgatcagtgatgttgagctttttctcatgattgttggctgtatgtatgtcttcttttgaaaagcatctatttatatcctttgcccactttttaatagagttgttcattttcttcttgtacatttgttgaagttccttatagatgctggctattagacctttgtcagatgcatagcttgcaaaaattttctcctattctgtaggttgcctgtttaatctgttgatagtttattttgctctgcagaagttttttagtttaattagatcccatttgtcaatttttgcttttgttgcaattccttttggcatctttgtcactaactctgctcattcctgcatccagaatggtattgcctaggttgtctggaccagagtttctatagttttggattttactataatggtacctttaatattaatgaaacctataaaccatgaaagttactgtagaaaattgtaacaagaatctatttcaacccttctattgtgcaatatgttatatacacatatcacagctttttacctttagtagtaactaaaatgtgcatgtttattgattctgcatttgccacactatgttccatgaaacactgatattccaaaaatattaataccgtagtagtccccccatccacagtttcactttctgtcgtttcagttatgtgcagtcaagtgccatccaaaaatattaatattgagagaaagttattataaaaataataacttatagtatattgttatcattgttttattttattattgttcttaatctattactgttaataattaagtaaagtttatcataggtgtgtgtgtgtaggaaaaaacagtatgtagagagtttagtacattttcagtttcaggcatccagtatagatcttggaacatatcccgtatagataagaaaggactgctggaaagattcaaatgggatgaataaaaggattctcaggcctctcagttctttcaccatctttcacccaatgatgtccttcatccttcctaagccactggctccaatggtcacaccctagctcctttcattactaataactatcactcctctataactttcatttcagttatcactctcttcagttgtcacttctttctatttaactccctctagtaattgaactgtgataaatctttgatcaccgtggacctccaattctttttgattggctccttacctctttcatttccctccttacctagcttacattatgtaatcaatcgaatactctattaaatatacctttaattttcatgtccttctcgtcatattgtcttttcttgggtgaatagtagccacccagagataacagataaccctgaattaacaagacattcttgaagaagttaacctgcgagaactcgctcgaccagttaccgcactggcacaagggcaggtaaattgcccagtagaatagaatatagccagaaagagatcaaggcatatgtggatgctggacttacggccaaggtggcattgcaaaattgcaatttttttttatcatatattaagttttagggtacatgtgcacattgtgcaggttagttacatatgtatacatgtgccatgctcgtgtgctgcacccactaactcgtcatctagcattaggtatatctcccaatgctatccctcccccctccccccaccccacaacagtccccagagtgtgatgttccccttcctgtgtccatgtgatctcattgttcaattcgcacctatgagtgagaatatgcggtgtttggttttttgattgggtgtcttcaaacagaaacacacataactcaagtttatatatctatctattgatgaaaatgttgtgaccacaggcttgcagcaatctaaacttttatttctcctaggagcagtggttcagtattagctctttcagagtgtgtggcaattttatagaaataactattacaactactgagaattgactatttgatattttgtaaactattgtaaacgttatcttttgaaaattccacttttgtgaaacaaaaaaataaacctttgtcctttaggaaaaaaaaaaaaaagacagataaccctgtgttgacccttgactcctcttttgtccaaattctcaatgtgtatgtaatccatcattaattcctgttaattctaacctctagaatatatcttgaaattatttactttctccatctccactgctaccattctgggagaagccacagttaaccataggtgggccacagtcccatctgattacttagatagcaggccctgcttttaatctttgacctcgtggtaggcagaattttggactcatgactttcacctgcttttgttactcctgtgaataagttaggttatatagcaaaagtgacattgcagatgaccttaaaatagggaggttatcccgcattatttggttgagcccaatataatcacatgagccttaaaagcagagagaagggcaaaagaggaagtcagagagattggaaacatcatttcttcttgtcagattatttcaaagatgtattcgaataatgaataatggccaaattcacaggtacacgtttagcactatttcttcctgaatagagtattccccatcctaatgaccaatttcatattcttctttaaaataatgaaatttatcacctcagccctgttatttctgatatatgtttttaaaaatcaaagaatttttagaagaatcagatatagtgtgaaaatgaaaataaatttttaaacaaaaagcaataacgtatactttcaaataaatttggtctttaaaaccgtccccttggtatgtgtacaattatacagataccgtttgccccaatgttgaagtttatcctagatatgatttaatatatgagcactttagaaaaattaatgccttgcccttgaaatcacaggacttttttttcccccttcttcctttacttccttcattgctgtttaatccagaccatttccttcctctaccatttggctcagtagcctaggttttctggtctccccagagaagactgccgctgtgcagactgagtggcatgtaaagagcagagctactcctactttgggaagtgcaatcgggcagacttgtcccatgaagtgtatgtcaggaaaaagatggcaggtaataagttcttttgcgtgcttttcacaggctgaaggctgataacatggggatagttgagtaccagaaatattagacacaagaaaataaatcactgccaataatagacttgctttctaacaaatcttaggaatttttgatttggggaaatctttttttttttttttttttgagacggagcctcgctctattgctcaggctgggtttcaatggcgcaatctcagctcactgcaacctctgtctcccgggttcaagctattcttctgcctcagcctcctgagtagctgggattacgggtgctcgccaccacgcccagctaatttttgtatttttagtagagacggggtttcaccatgttggtcaggctggtcttgaactcctgacctcgtgatcctcccatctcggcctcccaaagtgctgggattacaggcatgagccaccgcaccagatgatttggggaaatctttaataatatctttcctaggtcgtgactctcttttgctttagaacttacacatcactgatgtaagagttcttttttttgtttgttttaaagaagtggactctcactgtgttgcataggctggtctcaaactcctggcctcaagaaatcctctcaccttggattccagaagtgctgggattattggcgtgagccagtgaacctagccctgaagtcagttctaaatattgtcaaacatagagtattttactatcattgggccctagataatctttatattttgtcatcttgactgctgacataaggtaattgagcatcatatctagaaagttttttttttttttttttttttttttttgagatggagtctcgccctgtcgcccaggttggagtgcagtggctcaatctcggctcactgcaactccgcctcccgggttcatgccattctcctgcctcagcctcccgagtagctgggactgcaggcgcccaccaccacacccggctacttttttgtatttttagtagagatagggtttcaccatgttagccaggatggtctcgatctcctgacctcgtgatccgcccgcctcgggctcccaaagtgctgggattacaggcatgagccaccgcgcccggccatatctacaaggttttaatgtagatatcattcagactaatttctgtaatcttgtcattgttatttcctcaaagtgctgtaccacaaataagaaaataatttgaatgcaattagaaaaaaaaatttacttttatcccaaagcattagtaagacatggttagcaataatgcatatattttaccttacttattaaacttgtcgtgcttctcaacgcatttcttcctgaggttggacatttttataatataatttagcatttttaaacctatgtatattttttctctcaaaaagtcttgtattccacttatattgtttaatgacctgttcagtcagtgtgtgattctcagttgggaactttcaaagtaattgaacataatttttctctaacccaacttttatttctatctgattttatatatgatttccataattatattattgttcaaatagagcaaatcaaaggtccctcctttgtaccattaacatgtatccacttttcaactattttttctctgttaaaacattttaaaaatatagctacatttggaaatgatataaaagtatactttatttaaaatactgtaggaaaatttcaaacattgttgtcttgtgtaaaattgtaactccaggtctgctcagatactacacctttgctttaaaacatgccttttctctgaatgccactgaaattgtgagattaaaacctatacgttcttttttttttctttccaacttttattttagttcagggtgtacatttgcaggtttgttacatgggtaaattgcatgtcccgagggtttggtgtacagattattttgtcacccaagtaataagcatagtttttggatcatttggttgggtatctttttttttaatggaaaccagaatggtatttattattttacatttgggagaggagatatcctaaagggtccagaatacataagtctcttacgtatgatactcctttttttgttactgaggtatacttataagtgcagataagtaatcagaaggttccttggtaagcgctgaattagaacaaaggcagttaggtaatttggagtttaatagcctagagtacctgatagagatgtgctgggggccacaaccctgtatgtaattttaaagtttctaagtagccacattttaaaaagtaaaaacagatgaaattaactttaataatatatttaacccaatatatcaaaatgttattttaacatgtagtcaatatattaaaattattctgtttttcatactaagtattcaaaatctggtgtgtattttacacttttgtacatctcaactcattcatttcctagttccttcagttgcttaagaaaaattactgaatgtttctgtctcaattttcccatttttataatagagataattgcaaggattaaattagataatatatgatacacagttggcacatgatcttatataaagcttagttgctttctaaaaaatatttcaaacagttgaatatgacgtataatggcatcactgtctcaaggcaaagaacattttaaggattaaattatctgtaactcccgaattctcatctcttccccttggacagtgctgggcacacacgtctctctgactccctattcaaattacgtaaaaaaagaagcagaatcaatgttcgttcaccagttgtagcacatgtgtcacactaatgcaagatgttaataacaagggaaacaaggtcatggggaaggaagggcagaaatatgtgaatgctctaatttctgctctatttttctgtaaacctaaagctactataaaaagtaaaaagctatgatttctttcttaaaaaagtcaaacatgtttgctgtcagttcctgatgcatgttagctgtgacagaatacggcagtaaaagtgacagtttcagcattattaaaatcatcaataagaggagcttagttatgggtaaaaaatctaacaatattttctctgtcaatagtcattcattatctacctcttttaaactaatacatggaaaatatatgcacaaaatggttgtttttcctccatggttgttggggtgaatactgggagttattggtagcattctgatggtaatggcagaaatctttcatacattttaaacactattgctggttttgagaatattttcttctcctaatttcaggttgggtgggactatatcagcatacaagatagtaccagatgaaatagaagaaatcaaggtatagtatggcatttttcacctctacaaacatttagcatcttggtgaggggtggggaagagttgctttttctttatgccattgatatttggctatgttagaatattatttaattctcagttatcatagtgaattaaaaatttatatgtatcagataatcaccatcagatttatctgccatttgcaatgaatttctgactacaatattaggagaatcgaaaaggaaccctttcctgtgtagttcattaaaaatctacataagaaaacactgtgtataagcattggtgtgcatagtggattatctttttatcttgttgcaatttcttttccctataagccttcaccacttttaaatatcagtcttttttttaaattattattatactttaagttttagggtacatgtgcacaatgtgcaggttagttacatatgtatacatgtgacatgctggtgcattgcacccactaactcgtcatctagcttaggtatatctcccaatgctatcccgagctggttttttgaaaggatcaacaaaattgatagaccgctagcaagactaataaaaaaaaaaaaagagagaagaatcaaatagacgcaataaaaaatgataaaggggatatcaccaccgatcccgcagaaatacaaactaccatcagagaatactacaaacacctctacgcaaataaactagaaaatctagaagaaatggataaattcctcgacaaatacactctcccaagactaaaccaggaagaagttgaatctctgaatagaccaataacaggagctgaaattctggcaataatcagtagcctaccaaccaaaaagagtccaggaccagatggattcacagctgaattctacctgaggtacaaggaggaactggtaccattccttctgaaactatcccaatcaatagaaagagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccacgatcaagtgggcttcatccctgggatgcaaggctggttcaatttacgcaaatcaataaatgtaatccagcatataaacagagccaaagacaaaaaccacatgattatctcaatacatgaagaaaaggcctttgacaaaattcaacaacccttcatgctaaaaactctcaataaattaggtattgatgggacgtatctcaaaataataagagctatctatgacaaaccaacagccaatatcatactgaatggacaaaaactggaagcattccctttgaaaactggcacaagacagggatgccctctctcaccactcctattcaacatagtgttggaagttctggccagggcaatcaggcaggagaaggaaataaagggtattcatttaggaaaagaggaagtcacattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaggagaataaaatacctaggaatccaacttacaagggacatgaaggacctcttcaaggagaactacaaaccactgctcagtgaaatagtaacagtcttttagtacatatttttctgggttcctttgaaaacacgatatgccaattgcaattaaaaatttacattacagtaatgaaaaattgacttactctttaaaaattagagcattatgacattattctgtctctaacattttactaagtcttatggaatattaattttctaacataatatgttgttctttttcaaaagcaagattgaataattggatattaataatgaagaataaacaatactggttaaattgttaacaatgacatgtaaagatctcaacaaatcactaagcttgatttgattaaacttttcaatatcaagttcactaaattcaaatctttcaataaattcaaattcaattcaaaataattatttaattctatgactcaagactcaaggggcttttttttttttttttttttttttttttgagacagtctcgctctgtcacccaggctgcagtgcagtggcatgatctcagctcactgcagcctccaacctcctgggttcaagtgattttcctgcctcagcctcccgagtagcttggattataggcacatgacaccacacccagctaattttttttttaattttattttagtagagataaattttcttcaagttggccaggctggtcttgaacccctgacctcaggtgatccatctgcctcggcctcccaaagtgctgggattaaggcatgagccactgcgcccagcctcaagggacatttttgaaaagaaaaaaatcttgtaatttgtttgcattatttttaaatcaagtaagcccattgatctattatatgatacactattagcttcagtatgtcaagtgttctaatgtatggtcaacatcagaaattaatgtggtaattctagcttcaaaaaaaatttcaagaaatttattccaactttgtgtgaacttgtaaaatattttagctaggaggaactttaggtctaatccagatctctcatttttcatatgaggaaattgaataaatattttatttgacattcaataatgacttctaaaaatatcatcaaatgttgttaaagggttggaaaagcatgaggatattacttcttgaaatatattttataatgactcaaaaattgaactctagaaactttaagcaattaataaatatatataaataagcaacatttatgtaaagaatattgaattgaaattatgtattataaaggcaccctgtctgataatacaattaaaatgtgtgttaactgatgaagataaaccaagagttttatggaaatacatagaagggacacctggacattggaaaaagtaaatcagcaaagtctttccaagaggtaacccccaggaaattggagttttatacagaagcatagacatgaaataataggataccagattatagggtataaaataaagactggtaagataaagggctggaagcaggcctttatcccatgttaagaagtttggtttttatcctgaaaattatgggattcctttatgtgatttttaaggaagaaagtaacataatcattttgatacttttttaaagccttactgtggtgaatgagaaaagtgatttcagcagagaagaggttctacctagatggaaggagaccaggttgcaggaatgtaggcacaaaatgattagaacctgaactcaagcagtgacaatgaggctagagaagaaaacaagatttgaaaaatattatttcagaaagtaaaatcagcaatacttgataacttattggatgtttaggggaaattggaaagattgactcagatttctggcttgggaaattgagtagatggtgttgctgttaacttaaaaaggatgttttggagacagaatattattaataggaaagaggatgttttggacttactgagtttgaggtccctctcagattaccaaatatccaataagtcattgaataaatcagcctggaactcagaagagagacacaatctagtaattgatattaaggtttgtcctcatacaaaagagttaattgaggccatgctagtcagtgaatggaatctcacggaaaagttatatgaggtattaaaattgggctgaagatgtaaccttaaggaagacttaccctaaaggcagagtattaatatattatttaattagtttaattaatagcaggacttttgcctgtttttaaatagtgatttttttcctaaaggaatcagctttttttttttcattgtgtgtgctttttttattttagagttacaagagttatccctcaggagattccttttaaaaaaagcaggattcatggatgatatgtaacataatttttccgtcgattactggtattatatctaaaataacttgagagtttgaggcctgaggcattaaaaaaatgaggaattcatcttgctttcaaagtactcaaagaaaaactgttctaaaacatttcaccaatatttgatggcacattagcattttcagctgaaatcagttacaatcgtttttgttttagctgaaagaaatgtgaagcatacggatgtaatgttcatttcagttgggtaatatctgagtaatcttaaattgtctaaacagaacaattgagtttgaatttgatatgctacctatagtatataccatgtataaataaatatgcatatgtatttttgttattaaaataatatgactgattaaacataaatcacattttggcagatgtgggaatctttcacagttttctagcaccagaaattatcaagttcataaattttttcaattacacgtatatttattgattgtaataaatcacttcaaaactgaatggattcttagcccttagccacataaagagtgaataaattcctggcccaatcagaagtccctttttcaccctagatgtaaccactattctgacttctttctttttttttttttttgatacggagtctctgtcgcccgggcttgagtgcagtggcacgatctcagcacactgcaacctctacctccccggttcaagcaattctcctgcctcagcttcctgagtagctgggactacaggcatgcgccaccacacccagctaatttttgtatttttagtagagacagggttttgctatgtgggccaggctggtctcgaacctcctgacctgaagtgatccacctgcctcggcctcccaaagtgctgggattacagacgtgagccaccgcgcccagcctactattatgatttttatcattatcaattccttgcttttgttccgttttaccaactatatacacatccctaaacattacaattcatgtttgctctctttgaacttcatatgaattaaatcatattgtatgcagtttttttgtgtcttgcttttttatcaaccgtttttgtaggattcattcatgttattgactgtaactaaggtctttgtttaattgtaaaatacaccactgtaccacagatcactgagacatcctactgttgaatatttagcttgtttccatttgggacgattatgaaaagtgatgctataaacattattataagagcatcctggtactcatgtataagtttctctgaagtgtatactgaagagtggaattcctgggtattaagaaacatgtattttcaactttcctgactgaaatctcacttttctaaagtagttatgccagtttacactaccatcttgaatgcatttattttaaatagatatatttaaatattctttgtctgcaatgtatattactatagattttatttatatgtgaggtgactaaattgatacaatatttttaaaatgtgtctttgtttttccagcccatgggaaaaatcctgagggataattcttaatgaaaaagtccatttttgccccactggtttgaattttgcctcatgtatctcatactaaattttccaatttaggacatatgcatacttaagtctgtcttttcctgaacttctgttccattaatctatttattcttttctcagcactgtatggttttgattatagtgcttttttagcatagtaggaaaggtcctgtgttgtttttcttttttattttattggctcatgtattgattgctccagataacattataatatctctgtcatgtttcaaaagtattcctgctgaggagacttccagccaagatggagtagctttattccttccagatccttcctattactactaaaaatgcctaggcattataaaataaacatagaaagattctgggccaggtgcggtggctcatgcttgtaatcccagcactttgggaggccaaggcgggcggatcacgaggtcaggagattgagaccatcctggctaatacggtggaaccctgtctctactaaaaatacaaaaataataataataattagccatgcatggtggcatgcatctgtagtcccagctacctgagaggctgaggcaagagaagaatcgcttgaacccgggaggtggaggatgcagtgagctgagatggtgccactgcactccaccctggatgacagagcgagactccatctcaaaaacaaacaaacaaacaaaaaaaccaaaagaaagaaagaaagattctgaaagatggaaagaagaaggcagactacctggctacctgggaacctcaggaattgagaaatgacatggcagtgagttacttgggtttccttattatctcctgtatattctggacaggatactgaagaaagccttcaacctggaaccaccaacaggtggcgtaaacaaaaaatacccctacaaaagcctgtttgtctagccaacagacaaggacaagggtcacctaagaggcaagaatggcttttcagcaatatttgccctactacagctaagcaccaatggaaaaactgttcagttcccttatagtttcagttgagtcaagcaggcagctgatattccacatcaccccctgccatcccacagaagtaagtggcatagttctgaatccctcacctggtggtggcagcagggctgagtagggagctattcttccatctttcacctggcagagcagatgtcactctgatttcctggctatgatattaaagttgaaaccaagcagaagttgatctatcaccagcccagtggaaacaagctgtgctccagttttcccagcagggtagtgtcagtggagtccagtgatgagctgagcctccatccccattcagtatcagtgagacttaacaaggcagcacaaagtagagctagttaccactatttcacctttcctttcccacgtaagtgaggcctggcagagaggtgaacctctacccccagctgtatcaacaaggctaagccaggtgaggctattcgtacttctgctcacaatatgagtcaaccatctactctccccaacccttggtattagcatgcgcccctacttggtatcaacagtggagcaaggtaatgtcaactttcaccagaaaggtctcagcagagccaagaagggagctgaacttctaccttacagtcttaaattaagcagtgtgaatcagtgcttcacttttgccagagtggtgtcagtgagaccttgcagaagctgaacatacatgtccataaggcccttgtgttacattgcgacatgggggacatctgctaaaaaagattaaatagtctcaaatataaaataccaaatgtcctaggtgacaataaaaatatcagtcatcataccaagaacaaggaaaatcacagcatgagtgagaaaaaaacagtctacagacaccaacacaaagaagattcaggtgttgaaattatctgacaaagattttaaagcacctattataaaagtgcttcaataagcaactatgaattctctttaaaaatgaaaaaatggaaaatcttgccaaataaaaattataaaaggaaccaaatgaaaattatagaactgagaaataccatcaccaatatagaaaactcacagggggcaacagacggaagtggcacaacatttttcaagtgctggaaaaaagaactgtcaactacaaatgccatattcagtgaagttattcttcaagaatgaataaggacatactcaaacgcgaaaactaaaagaatgtgtcactagaaaaccactctgaaagagtggctaaataaattctttaaagggaaaggaagtaatagaaaaaggcctgaaatttcagaaaggagaaaacagcagaatgggtcaatacaatagattgtattttcttataatttttaaaatcacagttatactgtataatatggtattctatatatgtacatacttaacacaatcatatttaaaatgtggaagggtaaagttgcctaaatggaggtaagatttctgtatttcacttggaatgataaaatgtcaatactggtagagtgtggtaagttatatctgtatattgtaatactgagaacagccactaagaaaagtatacaaagcaatatactcaaaacgctatgaataaaggtagaattctaaaaagtgtttaagtgattcacaataagcaagcatataaaaacaggaaaaagaaacaggacaaaaacagaaaatagataataaaatggcagacttaaggcctatggtcttaatacttaccttaaatataaataatctaaatatgccaattaaaagacagattttgacagaatggatttttaaaaaatgatccaataaatgccattctaaagaaactaatttcaaaaatgatgacataagtaggtagtaagcaataggatacagaaggatggcgaaagatttatgtgtgaacacaaattttaaaaaaaaaagcaggagtgggctgggcacagtggcttacgcctgtaatcccagcctttggggaggtcgaagcgggtggatcacctgaggtcgggagttctagaccagcctggccaacatggtgaaacctgtctctactaaaagtacaggaatatccaggcatggtggcacatgcctgtagtccccacgactcaggaggctgaggcaggagaatctcttgaaccggggaggtggaggttgcagtgagccaagatcacaccactgcactccagcctgggtgacagagtgagactccatttcaaaaataaataaattaataaataaataaaatttaaaaagcattagtggctgtattaatatcagaccaagtagacttcagaacaagaaaaattctggagacagagaggacatcccataatgtgaaaggctcaatccaccaggaaaacagcaatcttaaaagtatgtgtaccaaaaattgaaatatacagaatgctccaccaaaaattaaacaacacacattttttttcaagcacacatgaaacatttaccttggaaaaccatatcctgaatcataaaacaaaccaaaacagtacttaaaaattgaaattatgcatagtatgtcctctgaccataatggaaccaaaccaaaaaaaaaccaaaaaacaaacaaaaaaaaaaaacagaaaaatatcaggaaaagctctaatacatgccagaggaaattaaaagatactctagtaaataatcaaataagatgtctcaaatgaaattttaaaaatttacacaaacgaaaaatgaaaatataacacatcaaaaaatctgtaaagcagtgaaagcagggctgagaggaaaaattatatgcaaagcagacattaagagaagaggaaagttctcaaatcagtaatctaagttttttcctccagaaactagaagaagagcaaaatatattcagagcaatcaaaagaaagaaaacaatgaattaagtattgaaataaataaaattgaaaacaggaaaacaatagtcagtaaaataaaatctgcttctttataaagctcaaagaaattggtaagcctcttgctacattgcaaagataaaggagaaagggcacaatcaccaatgtcatgaataaaacaaggagtattactacagatcttctattctttaaaaggataattaggtaatactattaaaaacttcatactcataaattgtacaatttagtagaaatggaccaattccttgaaaatcacgaacttctaaaactaaccaagatgaaatagacaatctacatggtataaaagccattaagtaacttaaattcataatgaaaaagttcctgaaaaagaaagcctcaggactttctttttggtttcactggagaattctaccaaatatttaaaaaagaattatcatcagttttagtcaatctcctccaaaaaaataaaagatgaggaaatacgtttcatgagtctagtataatgttgataccaaaaacagagaaagacagtgcaaagaaagaaaatggaaaaccagtatctcttacgaactaaaatcctcaataaagtattatcaattacatgcaacaatgtataaaaagaattaagtgccacgacaatttgacatttatttgaaatatacagaaaactacttcagtagtagaaaaacaataaatctaatctaccatgtcaacgagctaaagatgaaaaatcaaatgatcatatcgattgatgcaaaaatagcatctgacaaaattcaaaacccattcataataagaactctcagcaaactaggactagatgggaccttaacttgattaagagcatctagagaaaacctatagctaacagcatacttaatggtgaaagaatgttttccttcaaaaattggaaacaaagcaataatatcttctctgactacttttattcaacatagtactagaaatgctaggtagcacagtaacgcaagaatatgtgctaaaaccacatagattagaaagtaagaaataaaactctccctgtttgcagaccacttgattatctgcataggaaaaaatgactataagaataagtcattttagctgctttgtggcatataagataaacacaaaaagaaaaaaatcaattggatttctatatactataaacaaacatttggaaactgaaatttaaataacaccatttacaattgttcaaaagaaaataaaatatctagatacaaacttaaaagcacacatatgttatctttatgcaaaaactgccaaacaaagaaataaaaggacacttgaataaagacacattctgtgttcaaatattgaaaaattcagcatagtaatgatgtcagttctcccctaattgaaccataaatttaatgctataccctggcaagtgttttgtggctataaaattatataaattcattctaaaattatatggaaaaacacaaaacctagaacagctaagacaatttttaaaaagaacaaagtggaaagaataactctacccaatgaaagtttcattctgtatctacagtattcaagatagtatagtattggcagagaaataaaaacataaatcaatgaaacagaatagagaacctataataggcttatacaaatatattcaattggtttttaataaagatgcaaaagcagttcaatggagaatagacttcaacaaatggtgctggagcaattggaaatcaacaggcaaaaaaaaaaagaatctcagtctatgcctcatgctttattacaaaattatttcaaaatacatagtaggctttaatataaaaagtattatatatatatactgtaaaactgtcagaagaaaaaaaaaagcaaaagtctttacgacctggggctagatgaatgaagaggccttagactcaacacaaaaagcacggttcatacaatgtaaatttcacaaacttgagctcatcaacataaaaaaattttgttctgtgaaagaatgaaaacaaaaactgcaggccgggtgcagtggcacagtcctgtaatcccagcactttggaaggccgaggcaggcggattaccaacctggccaacatggtgaaaccttttctctactaaaaatacaaaaactacccagacatggtggcgggcacctgtaatcccagctactctggaggctgaggcgggagaatcgcttgaacccaggtggcggaagttgcagtgagccaaaatggcaccactgcactccagtctgggcaacagaacgagactccgtctcaaaaaagaggatcaaaacaagacaacagttaatctatgaatgacaaaatattgacaaatcatgtttttaactgtgattgccctaaaacacacaatgacatatgatgattttatgtaatatttataattattaatgataacatactgtaaatcatatcagaattgtaggagtttcccattatttggaacacataccagtaacatatttatacaaatgcagctaaaagaaagctaacatcatttcacatttgacattgcatcctgtatgatttgtataccaaataaacatttcatctttgcattgatgtgctattaatgttaaacccactccttttgtttgtttgtttgtttttgtttatgtttttttgagacggagttttgcccttttgcccaggctggagtgaaatggtacaacgtcagctcactgcaacctccaacccccaggttcaagtgactctcctacctcagcctcccaagtagctggaattacaggcgcccgccaccaggcctggctaattttttgtagttttagtagagatggggtttcaccatgttttagtaaagatggggtttcgccagtaggctgatctcaaactcctgacctcaggtgatccacccacctcagcctcccaaataaacccacttcttaataaaacctatccagttttaatcagtttgaccagaaggtaagatttttctaaacgttgtataaccctttacaatttttgttaaagagcagatcagtgttctgagacaaccctgttgtgcttttattccaatgttcaatttatggaaaaactgaataatacccctttaactatccagtatgttcacacacagaatctcttttacaattaatttttcacaaaccttccacaatttgttcaaaccttcatctttatcctaacttaaaacaatcctttaatatttaatctagccaaataattccacatttccatgccttcttataatcttttaccaaaagcacatcttactttccttacactttgcatgtaaaactgtttcttcagtagtctcaattatgtgttacaatgttaactcagcaatttttatttttaagccatttaattagagctctttcctatgtaaacatcatacacacaacacatacaaatacatacacagacataagatccagtagttaaaaggtttttcacttgccagtttcttaattcaattactggctttagggttgatcccttggaggaacagggccaggaaagcatgcagtttctatggcctaataaccaggctcagctggaaggcaaaaacaggtccccagaattaagggtctcatttttatactgaatcctggatccccaaaagagaaatgctatgtaagaaaacagtgtgatgattttactgtgcatttcattgcaaagcaatctgaagccaatcagcccatccccatgggaatcttctctcttagtgaggggtggggacatcatcataccttccaggtggccaggagcatgcttctgtaatccaaacgtgcagagagctgagtatctttccataactgacattagctatccccaaaagtatatttcctacccagttgttacacaccagagttctctcataatgtgaagtaatttctgatatcccaaaaaataaaaaacataagataacgtaattcaagacaaaacagaaccttagattttgagagggatctgtctactttcaattcctggggtttcatgaggaaaacagaagtttttcccaaaatggggtctgtggtgccttctctgtttttccctaggctgttaaagcttgaatatttacttttaattaagcttttaaccatagcactcttttaaaaaagtttttttaaaaatctcttattacccagctttagtcacgccaaactgccaatatttctggcttttgaactttactaaatgtaacctcccaggggctcagtgaaaggaaagtttaagacagttcatggaggagaggtgaatcaacaaatggcaaaggttacccaaagatcagccaggaagtactcattacctaggctgaaaattgaacctgaatccagggccactattgggaaaagacaaagctttaactgctaagctacagcactgggcaatttctattgcccttcccagaaaaagcctagagcagtaaattttgagtttgaaatggcttttaaatgctcaagataatttttagagctaagtaggacatgaatcccaaaattcctatttcctggaaggtagagaccaagagaaggtactgccacatgattacaaggtcaagctcccaaggacatttttcagcatgtggtctctgggcaagatggttgccctgtgtaacagaaaagataggaaagggaaaggggagaaagagtttgcactgcctgtggcagggcggggagggtcagggaactcaggagctcagggaagccagagaaagtcccacccattgcagtgacactgaatgaaaagttcaggcagccacttgtcagtaatgaagggtttcttttccacaagacccatcagctctgaagtttccccctttggggagaaaaaagctctccatgtcccataattttgtacatgcctaattctgtcaccaacagccatcagcaaagattgcaaggcagattaatccaaagagaatagtaattaaaattctttaatgccaaatacatttttaaccaaatggactttaccaagaggggcctctaaccccctcaatcttaggaagaactctaaccttcctatgttgggccttgaacccaagttcattcaagcatccttgccttttatcaagaggggcttttaacccactctgtcttaagagagactctaactttcccaagttgggactcaaacccaatcccatcctttacctgggtaccccaccacttactgaaagtcggccaatcagtgctgcagtctatttcctttgggttgggggtttcctcagtattgtccctttgggggttatcagggagatgctgcctgaacagggtcctgatccagccccaagagagggttcttgaacctcacagaagaaagaattagagacaaatccataaaaagagagcaagtttattagataaataaataaataaaatggctacccaatgggcagagcagcagcatgagctgctggttggccacttttatggttatttcttgattatatgctaagtaaggggtacattattcatgagttttccaagaaaaggggaggcaattcctggaactgagagttcctcatttttttagaccatatagggtaatttctgacattgccatggcatttgtaaactgtcatggcattggtgggagtgtcttttagcatgctaatgcattacaattagtttataacaagtagtaaagccaactagaggtcactgtcattgccatcttggttttagtggattttggctggcttctttaccacagcctgttttatcagcaaggtcttcatgacctgtatcttgtgctgaccccctagctcatcctgtgagtaagtgtattagtccattctcatgctcctaataaagacataggagagactgggtaatgtgaaaaggaaagaggtttaattgactcacagttccacgtggctggggaggccttacaatcatggcggaaggagaaggaaaagtcacatcttacatggtgacaggcaagagagcttgtgcaggggaactcccatttataaaaccatcatgtctcatgagatttattcactaccatgagaacagtatgggggaaattacccccatgattcaattatctccacctggcgctgcccatgacacatgggaattattataattcaaggtgagatttgagtagggacatagctagactctatcagtaagaatgtcgtaactcctgggaatgcagccctgtacgtctcagccttgttttacctagcccttatttaagatggagtcactcaggttcaaacacctctgacaggaggatcacttgagaccaggagttcaagaccagcctgggcaacaaaatgagaccccatctctacaaaaaataaataaaataatacaaattagctaggcatgttagtgcacaactgtagttctagctactcaagaggctgaggtgggaggatcacttaagcccagaaagcagaaactgcagtgagctgtgatcacaccactgcacagaaaaagaaaaaaaaaaaaactgtcagtcaaccaaggaatactatttttaaaaaatgaagatgaaataaagacatgtccaaataaaaaagtttgttgtcagcagactcaccatgcaaaaaataaaattacagaaaatttttaaaagcagttgaccagagatagtgagtcaaatgcatacacacaaaaacaaggagcactagtaaagtgcaaagaccagctcagtcagggagaccctaacccagtggtgctagaggaattaaagacacacagaaatatagagatgtgaagtgggaaatcaagggtctcacagccttcagagctgagagcctgaacagagatttacctatgtatttattaacagcaagccagtcattagcattgtttctatagatattcgatgaactaaaagtatcccttatgggaaacgaagggatgggccaaaataaaggggtgggtctggctagttatctgcagcaggaacatgcccttaaggcacagatcgctcatgctattgtttgtggtttaagaatgcctttaagcggttttccgccctgggcgggccaggtgttccttgccctcattcccgtaaacccacaaccttccggcgtgggccttacagccatcatgagcatgtcacagtgctgcagagattttgtttatggccagttttggggccagtttatggccagattttggggggcctgttcccaacagtaaagctaattgtacaattatagaagacagtataagtgcatatttcttgtcctttttctcctaattaatttaaaaaacaatacatgtataattggttgaacctacaacatatagacatgtaatatatttgacagggaaagcacaaagaagatgggtggaagcaaagctgaattgcagtaagtacataacaccagatggtatgtcaaatccacaggaacaaaataataaaaccagaaatgggaaataagatggttaatataataagccatataaatatattcttgtcctttcggtttctttaatagacataaattatataaggtaataattatagcaatcttttgttgggttttgagtgtgtgcatatgtctgtatacatatatgtgcatatacatatatatatctgtgtgtgattgtgtatacttatgcataagtatacacatgcatatgtagtatgtgtagtaatggcacaaaaagagagaagagagaatagaactatttaggagtaacatttctatatttcatggaattaagttctgataagatattcatcgtaaaaccctagagcaacgattaagaatatagctccaaaaatatggttaaaaaagggaattaaaatattacactagaaaatattcacttcatgtaaaagaaaacattaaaagggaataaaggaactaataagagacatatagaaaacatagagaaaaatggcaaatgtaaatccagatatatcattaatatcattaaatgtgaatggatttaacaattcaatcataaggcatacattgtcagactgaatgacaagtatttttaaaaacccatctgtgtgctttctgcagtagacatattgtgtattcagagatacatatggattgaaattaaaaggatagaaaaaatatatattatgctgatatagtctggatctgtgtccacacccaactctcatgttcagtgttggaggtggggcctggtgggaggtgactggatcatgagggcagcttctcatgaatggtttagtaccatccccttggtgctgttcttgtgatatttagtgagttcttgagagatctggtcgtctgaaagtgtgtagccccttcccacttgctctctcatgctgctgctctggccatgtaagacgtgtcttctgccataatgtaagtttcctgaggcctccccagatgcccagcagatgccatcatcatgtttcctgtacagcctgcagaactgtgagccagttaaacctgttttctctataaatgacccagtctcaggtatttctttatagcaatatgagaatggacaaatacacatggaaacaacaaaccaaagaaaaataaaatatataattaaaattctttatcagtttgcatacttctataaaaaggtgcttccctttaactattatttagttatgaattgatacagttaatgtagaaaaaacagaagtgcttaatactttttctttgtttgatttgagttcattaacatttctgaaacttcctttatggcccagtagattgtctactttggtaattattaacatttgatcttgaagaggtctataacatttggcaatggttggtttactgttgcatatatgtacattaggacaaatttatttcttgtggttttcagacattttacatttttattaattttatcaatttttcagttagagaggtatacaaaaatatctaaccactttttatgtggatttgtctattttttctttgaattcagttaacttctacttcatgttttttgccaggtacagtagcacatgctataatcccagcttctctggaggctgaggcaggaggatcacttgagccaatagtttgagtccagcctgggcatcatagtgaaacaccctgtctcaaaaaaataaataaataaaataaatagatagacagatagagaggcacactatcttactgggtattgacaatatttttatatctgcatatttgaattgacacttttaacattctgaaatgtttttcatctctaatagcatttcttgccttataagctacttttttggtatgctaatgctacaaccagtctattttgcttggtgctttcatgataatctattttcatcattctcatttcacccttgtcattaaattttaaatgtaaatgactcttgtaaacatttttttacttctttcctgaaacttgttttgcactcactgtatttagacagttttcatttattataattattaataactcaatgtttgttttctatttagcccactggtttcctttttctcttacttccttaccttattttagattaatacagtagcttttattattcagttttcttcttcagttaacttgttatatattcttcgaatgtgttttaggggtttgggtttttttaaggactacccaagggtatatttcaacatccatccattatagtttctactaataataatcacttttaccatttctaatatgaataattgcttttttaattttaatttctaatttttgtgtgtacataataaatgtatatatttatagggcacatgagatgtttgctacacgcatgcaatgcataatagtcacatcatggaaatggggtatcaatcccctcaagcattaatccttgctgttataaacaatccaattatactcttttagttatttttaaatagataattaagttaatttctgtagtcactctgttttgctatcacatactaggacttattcattcattctgttttttgtacctactaaccatccctacctccaccttaccctctccccctctacccttcctagcctctggtaaccatctttttaccctctaactccatgggttcaatcgttttaatttttagatcccactagtaagtgagagcaatgtttttctttctgtgcctcgcttatttcacttaacataatgacatccagttccactgatgttgttgcaaatgactgaatctcattcttttttatggctgaattatactccactgtatataagaaccacattatctattaatctattgatggacacaggttgcttccaaatcttagctattgtgaacacagctgcaacaaacatgggagtgcaaatatctattcaatatattgtttccttttttttttcagtatatacccaccagtatgctaatgctacaactaatgctgcagtaggatttctggaacatatgccagcttaattttttgtttttaaagaaacctccaaactattcttcatagagtttgtaataatttacattcccaccagtagtgtacaagggttcccttttcttcacattctcaccagcatttcttattgcctgtccttttgataaaagccattttacttggggtgagatcatattatagttttgattttcatttctctgatggttaattatgttgagcaccttttcatatgcctatttgccatttatatcaaatattttgcctatttttaaattgaatagatttttttcctgtacagttgttgagctccttatatattctggtcattaatcccttgtccgatgggtagcttgcaaatattttctccattctgtgggttgtctcttcactctattgattgacctttgctgtgcaaaagacatttaatgtgatatactcctatttgtccatttttgctttggttacctatgcttgtggagtgttactcaagaaatctttgcccagatcaatgtcctggagagtttcccctatgttttcttgtagtttcatagtttgaggtcttacatttaattatttaatgcatttttatttgatttttgtatatggtgagacataggtatctagttcctttttttttttttttttttttgcataatggatattcagttttcccagcaccattcattgaagaaagagtttttttccagtgtgtgttcttggcatctttgttgaaaataagttcactgtaggtatgtggatttgtttctgggttctctattctgttccattaacctaggtgtctgtttttatgtcagtatcatgatgtttgggttattatagctttgtaatataatttggagtcaggtaatatgatttcttccagttttgttctttttccttaggatagctgtggctattctgggttttctgtggttccatataaattttaggatagttttttccatttctgtatagagtaacattagtattttgatagggattgtattaaatctgtagattgctttgggtactatgaacattttaacaatagttactcttctaatccatgaacatggaatatgtttatattttttatctctttattttattagtgtatcatagttttcattaatctttcattaagatcttttgctctttggttaaattaattcctaagtatttacttttgtgtgtggctattgtaaatggggttatttttatttatttttcagattgttcactgttggcagataaaaatgctactgatttttgtatgttgattttgtatcctgtaacttcactgaatttatcagttctaatagttttcttgtgtagtctttaggtttttccacatataatgtcatatcatctgcaaacaaggaaaattttacttcttccctttcagtttggattttctttatatatttctcttgtctgactggtctatctagaacagccattactatgttgagtaacactgatgacaatgggcatactggtcttctaccagatcttagaggaagggctttcagtttttccccattcattatgatactagctgtgggtctgtcatgcatggtttttattatgctcagttatattcagtctatcctcagttttttgatggcttttatcacaaagggatgttgaattttatcaaatgctttgttagcatcaattgaaatgatcatatggttttccccatcattctgttgatatgatgtattacattgactgatttgcatatgttgaacaatccttgaatcccaggaataaatcccacttggtcatggtgaatgatctttctgatgtattgctgaattcattttactaatatttcattgaggagttttgcatcaatattcatgagagatattggcctatagttttcttttttatgtgtgtttggtcttagtatcagggtaatattagcctcacacaatgaatttagaagtattccctcgtctatttttcagaatagtgtgaatagaattggtattaattcttcttaaaatgtttggtagaaagcagggaagccatcgggtcttggacttctttactgggagatattttattacagctttgatctcattacttgttattgctctattcaggttttagatttcttcatgtttcaaccatgttaggttatacatatctaggaatttgtccatttctactagattttgcaatttattgggatacagttgctaatagtagccactaatgatcctttgaatttctgcagtatcaattgtaatgtcaccttttttatttttgattgtatttatttggatcttccctctctctttttttctagttaatgtggctaatggtttgtcaatattgtttaatttttcaaaaaaaacttaaatgtttgtttcattgatctttgatttttttttcttcattccaatttgatttctttctcctctgatctttatttcttttctgctactactcttgggtttggtttgcccttgcttgtctagttctttaagatgcattattagattgcttatttgaagtttcctccttttttaatgtaggcccttacagctataaacttccctcttagtactgcttttgctgtatcccataggttttgatatgtattgtttctgttatcatttgtttcaataaatttttcagttttcttcttaatttcttaattgacccagtggtcattcaggagcatattgtttaatttctatatatttgtatagtttccaaaattcctcttgttattgatttctagttttatttcattgtggtcagagaagatgcttgatattattttagtttttaaaaaatgttttaagacatattttgtgacctaacatatggtctattctagagaatgttccatgtgctaaggagaggaatgtgtactctgcagccattgtgtgaaatgatgtgtaaatatctattagatctatttggtctatactgcagaccaaatctgatgtttctttgattttcttcctggaagatctttccaatgcttaaagtaggtgttgaagtctccagctactattgtgttggggcctctctctctttagctgtagtaatatttgcattatttatctgagtgctcaagtactgggggcatacatatttaaaatttttatatcctcttcctgaattgacttgtttatcattatatagtgaccttctttgtctcttctaatagtttggccttgaaatctattttgtctgatataagtgtatcaattcctgctctttttatgtttttattggcatggaatatctttttccattcctttattttcagtctatggtgtctttgtaggtgaagtgttcttctcgtaggcaacagatcaataggtcttgtttttccatccattctgccagtctttgttttttaatggaagcatttagtgtaattacattcagtgttattattgataagtaaggattttctcctgccattttattatttgttctctggttgttttgtggtcttttcatcctgtctttctttagtgaagatgattttctctggtgatatgacttagtttcttgctttttatttttttctctccattgtatgttttttggtttgatattaccatgaagcttgcaaatactatcttataacatattattttaacctgataacaacttaacactttttgcataaacaaacaagcaagcaagccacaaactaataaaagtctacactttaacgttatccctccactgtttaactttttgttttttctatttatatcttaatgtacggactatgtcttcaaaagtttttataattattatttttaattggtttattagtctttctacttaagataagaatagtctgcaaaccccagttacagtgttgtaatattctgtatttttctgtgtacttactattaccagtgagttttgtaccttcaggtgattacttactgctttttttctgatcgaagtacttcgtttagcgtgtcttgtaagacagatctggtgttgataaaaatccctcagcttttgttgggaaagtctttatttcttgttcatgtttgaaaaatattctattctagggtaaaagatttcttctttcagcactataaatatgtcatgcccctctttcttggtctataaggtttccactgaaaaatctgctgccaaaagtattggagctatattgtatgttatttgtagttttttttttatttttctcatgctgcttttaagatcctttctttatccttgaccattgggagtttgaatactaaataccatgaggtattaaataatcttagggttcaatctgcttgatgttctataccactcttctacaatggctattgatatctttctctaggtttgggaagttctctgttattatccttttgaataatctttctacccctatttctttctgtatctcctctttttaggcctgtaactcttggatttgcccttttgagactattctcttgatcgtgtaggcatgtttcttattcttttttcttttgtctcctctgtgtagtttcaaatggcctgtattcaagctcactaattctttcttctgcttaatcagttctgctgttaaaggactttgatgcactctttagtatgccaattatatttttaagctttagaatttcttgttgcttcttttttagttacttaattctctttgttaaatttatctgatagaagtctgaatttcttctctgtcttgtcttgaatttattcttgagtttattcaacacagctattttgtattctttgtctcagtggccacatatctctgtttttccaggtttggaccctggtgccttatttagttcatgtggtgaggtcatgttttcctgggttgtcttgatacttgcagatgttcatctgtgtctgggcattaaagtgttatgtatttcctgtagtctttgcagtctgtgctcatttgtactcatccttcttgggaaggctttccaaatattatgaaaggacctgagtgttataagctttagcgggcatcccaagcccagtaacgctgagattcttgcagacttgtaaaggtaccaccttgataatcttatacaagatcctaaagaattctctggattatcaagcaggctattgttgtcctcccttcctttctcccaaaaaaaatgagtcttctctcattctctctctctctccccgctgcccctctccccactctctctctctctccctctctctctctctcctcccctccccccgctctctcccccctctctctccttgagctacctggagctgatggtggtgtagcacaagcacccttgtggccaccatctctaggactgcactggatcaggcctgaagccagcacaatattgggtcttgctcaagtcctgctgtaaccactttctggctaccatctatgcccgctcccgctcccgctccctctccctctccctctccctccttgagctacctggagctggtggtggtgtagcacaagcacccttgtggccaccatctctaggactgcactggatcaggcctgaaaccagcacaacactgggtcttgctcaagtcctgctagaaccactttctggctaccatctgtgttcactcaaagtcctgcagctctacaatcagcaggttacaaagccaacagggcctattttcttcccgtcagggcagcaagttcccccaggccctaggtgagtccataggtgccatccaggagccagggactgaagtaaagtccttagatgtccacctagtgttctcttgtagtatggctgagcttgccctcaaaccgcatgacatagtcctttgcacttttcccttcacattccaaaagcagaggagcctaaccccatggcaaccaccatctcaggcttatggcgagtactgccattctacctcagatatttccttaaggcccaaaggctcttctatcagtctgtggtgaatgctgcctggtcttgaactcacccttcaggggagtggtataccctctggcccagggcatgtcccagaatgtcatccaagaggcagttcctggaaatcccaagagcctacttgatgctcaaccccctgtggccaagttggtacccgagttgcaagacaaagtccctttcacttttccttctgcttttctcaagcagaaggagttttgccccatagccaccacaggtgggaatgtgcagaatctcacctgatgccagcaagtctcaccatctcacccaagcccttgatacctgggtatcactgctcattattcagtgcccaagggctctttagtttgcagttgatgaatcctgccaggactggatccttccctacaaggctgtgggttcccttctggtccagggtgtatctagaagtgtccaggagctagggcctagaacgaggacctcatgactctgaccagtgccctatcctgctctggctgagctggtatcccagctccaagacaaagtcgtcctcacactttgtctcctctcctcaagtggatggaagtgtctcttttggagccacaagctgtgcatcctggggttaggggaggggtgatgtcagtactcccttagatggtgtctcagtaggtcgcttccctctccacccccagtccactgtcagtggaccctgttcagccctaggactcacctaattattgcagtccttgtggcctcaactgcctttgaagtttatttgctgccccagagcactttagtgccagatggtgaagctttcaggaactcaagttctgattgctaggatcagcagttcccctatggctagggatggtcagctgagttttatccagtttcgctttctgctataacaagggcaacaccgagttcagtgcctcaaaattgcctgctgtccttctccccagggcacagaaatgctgtctgcaccacacctccactgccacgggataggacaggggtcctgttgactattcaaaactttttctatgtcttcaatgcctcttttagcaatatgaagttaaaaccaggtactatgagtgctcacctgagtttgagttttacgaaggtactttttttgtgtagatagttgttaaattggtgtacttgcagggggtggcggaggcaacaattggtggagctttttgttccaccatctcactccacccctctcttcagtaattgcctttttattcgtatctttcttgaatttgaggaaattcttagacattatttttggttattacttcttcctattctatcttctctttctggaatccaattatactatatttttgagtgtgtcccacatgttttgtggctttttatatttttcctctttcttttttcttgttgtttactttctctgcatcagtttgtggaggtttttttattgttgttgatctgtctttgagtttagtattcctatgttttgtagtgtttctcccttttacctgtgtttgcattatttacccctgatgaactttgtaatttcccttctattatgtccattaaacttttttagattccaatgctgtggtgatattctgtaccatttcatccattttgttaattttttttctattttcttgaacatattaatcatagtttacttgaaagttcttggctgtaaactttcaatgcatctcttttgggggttttttttgttctgttttttcctctcaattttgggttctactttctggcaaatcaagtaatttttaataattttatgttatatgtaaaagactcatattggccataggtgacttaatcatagaacattcctccttcttctgtaggcagaaagtgtgagaaatcaattactacaatcccatcaggaattgagctggattacagctgggctacgaacatggtgggttttccattccctcagtcatgaaagacactaggaggtttagctctaatattcataggctgcagcccagctctcttgtctccagcctaaccaatatagcctcaaaaactagcaaatactttgacaggaaataggcattgtactttggtcagacttacttccctagcaagtctttgtttttcaattattatgaacaatgcaaaagatttcattttgcctttcataagctttttgtctagctttgcatgcttctgtataccaccagaatctacaattgctccaaggagaaaaacatccatgagcttgggtttattcaaatttttaagtttaaatgttttaagaggtttctggctaattcttccttagcagaggttgtctgcctagtaaaattaacagtcagcctatgtccaaaatcaacaaatacacacagtgggggtggcttggtaggaaaagctggacattatccgttttactctggaaagtttcctcctctttggaattttatttcacttaatcattattatttctgcaattatctgatatctttaaaagcagcatttttataattatgtgatgttttccacttgttacagtaaaagtattaccctgctgtgacattttgcatcctacccagaaacagaactcctgtattatattttttaactgattattgctaggattaaataaaaaagatacttctgtttaaatctctttgattctggtttgtgtaatgctctgtgtgtcaggcactgttgtaattgctttaaaattactaactcattttaattctctgtattagtctgtttcacgctgctgataaagacatacctcagactgggcaatttacaaaagaaataagtttgttggacttacagttccccatggctggggaggcctcacaatcatggtggacagcaaggaggagcaagtcacatcttacatggatggcggcaggcaaagagggagcttatgcagggaaactcccctttctaaaaccatcagatctcatgagacttactcactattgctagaatagcaagggaaaaacctgcccccatgattcagttacttcccaccaggtccctcccacaacatgggggaattcaagatgaaatttgggtggggatacaatcaaaccatatcatttcacccctggcccctcccaaatctcataccctcacatttcatacccaatcatgccttctcaacagtcccctgaagtcttaacatatttcagcattagctcagaaatccacagtccaaagtctcatccaagacaagtcaagtcccttctgcctatgagcctgtaaaatcagaagcaacttagttacttcctaggtacaatgtgggtacaggtattgggtaaatatacacattccaaatggggaaaattggccaaaagaaagggactacaggctccatgcaagtctgaaatccagcaaggcagtcaaatctttaagctgcagaatgaactcctttgactctatgtctcacaaccaggccacactgatgcaagaggtgggttcccatggtcttgggcagctccactcctgtggctttgcagggtacagcctccctcccagctgctttcacgggctggcattgagtgtctgtggctttttcaggcacacggtaccagatttcattggatctatcattctggggtctggaggatggtggccctcttctcacagctctgctaggcactgccccagtagggaccctgtggaggctccaaccccacatttctcttctgcactgccctagcagaggttctgcatgaggtccccacccctacggcaaacttctgcctgggcatccaggcgttttcatatgtctgaaatctagatggcggttcccaaacctcaattcttgatttctgttcactcgcaagctcaataccacatggaagctgccaaagcttgaggcttgcaccctctgaagccacagcttgagctctacgttgtcccctttcagccactgctggagcggctaagatgcagggcaccaagtccctagactgcacatagcacaaggaccctggtcccggcccataaaaccactttttcctcttagtcctccagacctgtgatgggaggggctgctgcaaaggtctctgacagtccttggagacattttccccattttcttggggattaacattcggctccttgttactcatgcagatttctgcagccagcttgaatttctcctcagaaattcttttctatttcttttctattgcattttcttttctattgcattgtcaggctgcaaattttccaaacttttacactctgcttcccttataaaactgaatgcctttaacagcacccaagtcacccattgaatgctttgttgcttagaaatttcttccaccagctatcctaaatcatctctctcaagttcaaagttattgaactctctagggcagagtcaaaatgctgccagtctctttgcaaaaacataacaagagtcacctttgctccagttcccaagaagttcctcatctccatctgagactgcctcatcctggactttattgtccatattgctatcagcattttgggcaaagccattccacaagtctttaggaagttccaaactttcccacatttttctgtcttctttttagccctccaaattgttccaacccctacctgttacccagttccaaagttcctttcacatttttgggtatctacagcagtgccccactctactggtaccaatttactgaattagtctgttttcacactattgataaagacatacccgagactcggcaatttacaaaaacattaaaaaaagagagacgtttattggacttacagtttcacatggctgggaggcctcacaatcatggtggaaggcaaggaagagcaagtcacatcttacgtagatggcagcaggcaaagagagagtttgtgcagggaagattccctttttacatcagatctcgtgagacttattcactatcacaagaacagcacaggaaaatcctgcccccatgattcaattacctcccaccaggtccctcccacaacatgggggaattcaagatgagatttgggtggggacacagccaaaccatatcatcctcataacaaacatatgcagtaggtataattattgtctctatttcataagtgagaaaaatgagacacagttaaatgacttgctaaaggtcacacagcaagcagttgtatagcagattcaaacctacagtctgggttcttctataatagtgagagttaatagtagaataaatacaaagcatcattcagtagatcattctgcgtgaatgctataaactcactaagaatcatttacatcaatatgtgttactttccagtactccttttctcttaataagaatgttgtttctgaacttcccagttactataccttcccttctcccaaaggtaatcactatcctgatttctagcaaatgaattatctttacttcttttgagctttatatcaacagaagcattttggtgtcttatgttttattaaatatacaagaattgagttatccattcttttgtggaaggacatttcagttgttttcagtttcagggtattatcaataatcgtgcaatgagtagtcttgtacatgtcttttagtgcacatatgtatgcattcttagatttccacctaatggacaggatagacatgacttagaactaccaagttgtggagtatgcaagtgaattctgcatgctagaatctgcctttctcaaatagatgtaccaatttatattctcttcaacattttatgagaactctattttgcttcacattcttactgacagtattgtcaatctttttccattttagtcattttggaatgtaaatagtgacagcaaaatatgtttttaagttttttcattgattacaggtgttattaaacatcttttcatgtctttattagccattgggatctcttcttttgtgaagtgcctgtttaagtcttttctactttttaagaattagattacttgtctttttcttatttattggtaggtatttcttataaattttagatatgaatcctttgatacatgtatcatccatttattctcctcctcggttgtttgccttcttactctcttaaaagtatctttgctgaacagaaattcctaattttaatgtattggcttgtcaatctttcagttatagtaaatatttgttaagtgaatgatcttgaaggagttcagtgtcagctacaagagataatcattgtaaaacataaattctgtatcaaatttatgtataaaatattttagaccaggcgcggtggctcacgcctgtaatcccaacactttgggaggccgaggcgaggattacgaggtcaggagttttagaccagcctgaccaacatggtgaaaccccatctctaataaaaatacaaaaattagccgtgcgtggtggcctgtgcctgtaattgcagcttctcaggaggctgaggcaggaaaattgcttgaaactgggaggcagaggttgcagtgagccaagatcgcaccactgcactccagtctgggcaacatagtgagacttcatctcaaaaaatatgtatatattttagatatgtataaaatattttggaacacagaggaaacagtgaccaattccaaccagagtgtcaaggaattcttcatggagaacatgatgggaaggacttctaaagcaaaagaaatatgaacaaatgtactaaatgtaaataagcattgtggttttcagaagttcaagtgtggctaaagtcaagggattattaattctatttgcaggaaataagaaggtaagttaggttggagtcacattttaaaggagctgtatgttttggtcgggggcatagtttctaaagattttgaagcaaaggaaagacattttcagatttgtttcaggggatatactgttcttatcaaaatggattgataagagacagagacagaccacttagtgtgctttatagcaatctaggtgaatgatgataaaaataaggcttatgcctgtggcaacaggaatggaaagtactgggggtatatcacagtggttaataaaacaggctctgctccttaataggattgtgaccttatgtgtatcttaaccattcagagttttcctaaataataataataataataataaaacctactattgtcattacgaatattaaatgtttgtaaagtacttagcaaagtacttacatagtaaaggaaaactgtgtgatatgattcaaatagacttcagaaacaagaaatacaaaaaagattaattcagggttttcacttagacagcttcttaagagtcccagtccctgagttaaggaattcaaaagaagcagcatattttgggggaataacgactattaggagtctctatggcatacaagtaacaccatacaactggaaatctatttgctcctccaattaaatagtgtagtccttatttcttatttgttcagtgttaatgattttcatcccttttgttttctcttctggtactattcacttaactgagagtatgctttactgtgttattctcagaataagagcatcccagaggattcgtggaagaaatgcaacactttcgagtataaactatcaaatagccaggttttctctctactgtatttgatcacctagtcccttattttttttaaagcagaacttagtattaccattgtataatgtggagtaggtaattttcctctcaaatcagaacattctgatctggtaaagctaagagttcttggctctctttgaaaagatagattaaatctacctgtctttttgctattttttgctgcctatagatcagtgttatattgttcctcttactaattattatataatatatttacacagaagtcttggctaaagttccatcaaattattatacttctttaaccttactaaaatgaatttcctccactattctttacatataaatacatgtaatttatatagacatatgaagtctatagtaacacctatagtaccagtatttctttactactggaaaactaaatcatagtgactattattaaaaattacttgaaaaccagacctctgtattctccatagggctaaatattagtaaactaaataataaaactgtttccagattttttttgttaaagatttttaaagtattaatagaatttaattaattacataatatatattatccatgtctaattatttgtctagctatattcatcatggaaaaaaatgttcaaaggaaaattgacattatgtgtgaaactttgtcaaaaatatgtcattgatgtttgagacaaggtaataaaactatcacagaaattcttctttttcttactaatatataatattaatatgaagatgtattctcacatcaaattttggtatatacagaagtcagtagtaatatgatttggccgagtacctttgctttcataatagttttataatctttgtgtgtgtgtatgtgtacatacaaagaggcacttaattttttagttcttgttatgtacccaaatttatatcagatgctttctgttctcatttcctttcattcttctaatggtggtccatgtttcaataacttgcctatgagcacaaagctagtaagtagactaaaactggaatgggtacccaagtctgtcttactcccaaacctattccttttctgttacctctgcttctacttccctgccttacagtcagaaaatttataaaggtaaacagtttgtcaatgtgaaaaactaaaagtagtttttaaagtatgcagaatattgtgcagacttaaaatcattatagtgaactacatttattaatacagattgattatttatgacatattgtcaaattgaaaatgcaaattaaaacatccatgtgtggaaacaataaaccctggggatttcagaagcagggaggagcagagtagggacaaggattgaaaaactacctgttgggtactatgttcattacttgggcaatgagatcattagaagcccaaacctcagcatcatgcaatatacccatgtaacaaacctgaacgtgcactcctgaatctaaaaataaaacgtaaaaaaagaaaggatttgtcattcttgaaaggacagaaaaaaattcatgtgtgtgtatttttttatgtatgaaaatatttatggaagtatggtcaacaaaggtttaaaattggttgtctaataaaatgtttgtgatttttaaatttccttatacttttttgttgattgaattatttttggtctttttagtaagcatgtattttaagaatcataaaaatcacttaagactactcttacattcagcaaaaaaaaaaaaaagaaacaaaatataagaacaggttaaaatatagaaaatgtatttttcaccaactgtcatttctagaacctagtttacaattgtataacagatgatacatttaattaaatctcttacatatagtcatccattttttgcatattgcatattctagagcagtgagtaaaatggcttgaatgccaaactcatggatttggtactacattttattgacaaataaaataataggtgtttaagctactttgagaataagcttcattccagtataattgaatagctcctatcagagctcctatctgtatcacaagtaactattataaactctaaaccaaacaaagaaacaataactatctgaaagcactggagagtgctctataaagtagacagattctaccatttggaagaaggcactggttgattatcccattcttaaaacttttagcctgagagtaggccccaatctggcctaactggcagctaaaacctgctggcttcttggctacaagaatggtttgggaaaactatagctacattaaagtaaaaagggaaatcctagaaaggagagagccaaagaggggagcctgaaattctataaataaactccctgtatttctggctgacctctgagccatgaatgagctgggtagactacaaacagcacaactagggctaaagggattgaactgaaatttgaattgccatcctctgcatagcagagtttgcagttaggtctgccgaagtcactgcttactaaaatttaaaaaaatcaatattataacaaaatccagtgtctattcaacatatcactcagtgtccagcatatagtctgaaattatttcacaaagaaacaagtgaacatgacccattcttgcgagaaaagataatcaattgagactaaccccaagatgacccacctattgtaattaacagacaaaaattctaaagcagcttctataatcataatcaagcagtaaaggaacatatgcttgtaatgagtgaagagataggaaatcttagcagaaaaaaatagaaactattgaaccaaatagaaatttaagaagtgaaaaagaaagtagctgaaaagtgttttcagggtatcttctttaaatttaagaccccacctgagccagtgaaatcatttagtaaatatatagcatcattaaataaaactactaatccagctctataaagcaggttgaattggctttcaaaccaacaaaatttattcctacttatttgtgtttgggaagtttttacattgtttgctgttggaacatattaatgtatccatgcatgttgaaattatatgtagaatgaaaggaaaattagaaatattcaagattttactctggaaaattatctttgactacaagagagaaactgcactgaagataattattttagcttagcattttttatgggttatacagtatcaatttaatagtagatagcagaatagctagtttaagagttctataaactaccctcactgacagtctgattcctttatataattttttttactgaagtcaaagttataatattagggaaaagtaccatttctaatcaaatatttataccacgtttaattttttgtgtatgttttgctaatagtgcctactataaactcaaattaataacttttataattattttatagttgaattcaaacaaatgacaacaaaaacactaaaagaatggtttgcaggggcaagggcaagatggccaactagacacagacaagtggaacagctcccatggaagtactgagacaacaggcatgcttttaacagatctttacagggaaggcatcaagagtggaccaggagaagacatagaagctgggctaaaggaagagaaagctgggaacgctgcatggacttttgtgcaccaggactcatttttgaaccacaacagctccaggagcatgggtgagttgaactggcaaggagcaacccgctctcaccatgggcctctggaaccccagcaggaggggacccctcaaccaccacagacacgtgaggtggcagggagagttacttagggaagtcttaagggcagcaagccagctgatgtggagcccagagggtttggtgcagaagtaactgtagtggagcatggccagggacagccatccccctagacttcacttgctcccataagagactttagtcctaggagaactgttggacctgatctgtccagggaagtcttgcgcaacagacagggctggtctgacctgagccctccttggtctgctggcctgtcctggggccctagcctggtcatgcctgctggcagggcagtcttgaggtccctgggtacccacgccgtagcttcaacactgatggaccatgcctgaccagtagagagtttcgatgaggcatccctatggccacgcaccagcctgcacgctccctccccagcctgtgcagctttcctagacccatggcactccccacatcactttgctgatgcatgtctacacaggtggcttttgctttacttgcccagccagcacacaggaacgcagtctgccctcctcccttgctgaccaccattgcagacacccttggtaagcacagagctggcaagtctcactcctgccagcaccccacccttgcactaacattgcacagagaacagcagatcatcccacaccctgaacaatcactcttatttgaggggcacagagaaggcacccagatctatgatggtcagcaccctgcccccaagccaacaccacctccagtgcaacagcacagtctctagcaagggccccccatcccccaccagctgtgttgcctccaccactatggtgaacacctgcagggaggcaggcacccctgcatctgttagcactcttctgcagatgctgcacctcagaaccccagcacaatggactgaacctcaaagaggtcaaactggggcccaatgcaagtcccccagagttagagcacacagtccaggagttgggagctgagcattggcctcctaaaatgttccaaaaacaagattggattcttccagtcagctgaatgcatcttataccataatcaaaccctcaaggttatcaaataggataaaagaaaaaaaatccaaaggtcagcaacctcaaagattgaagatagataagcccacaaagatgagaaagaatcagtgcaagaatgctgaaaactcaaaaagctagagtaccttctttcttccagatgaccacaccatctctccagcaagggtccagaacatggctcagatggctgaaatgacagaaatagaattcagaatatgggtagaaatgaagatcattgagctacaggagtatgttgaaactcagtgcaaagaaagtaaaaatcatgataaaacatggcaggagttgacagacaaaatagccagtactgaaaagaacataaccaacatgatagagctgaaaaacacactgcaggaagttcataatgcaatcacaattattaatagcagaatagaacaagctgaggaaagaatctcagagcttaaaggctggctttctgaaataagacaggcagacaagaatagaaagggaaaaaaagtatggaagggaatgaacaaaacttccaagaaatatgggattatgtaaagagattgaatctgcgactgattggtgtctctgaaagagatggggataatggaaccaacttggaaaacatgtttcaggtatcatccatgagaacttccccaacctagctagagaggccaacattcaaattcaggaaatgcagagaactctaataagatacttcacatgaagatcatccccaaaacgtaatcatcagattctcccaagtaaaaatgaaagaaaacatgttaaaggcagctagagtgaaaggtcaggtcacctacaaagggaagcccatccaactaacagcagacatctcagttgaaaccctacaagctagaaaggactggggcccaatattcagtattcttaaaaagaattccaatccagaatttcatatccatccaaactaaacttcataagcaaaggagaaacaagatccttttcagacgagcaaatgctaaggaaatttattactaccagacctaccttacaagagctcctgaaggaagcactaagtgtggaaaggaaagaccattaccagccactacaaaaacacattgaagtccacagatcagtgacactagaaagcaaccacatatgtctgcaaagtaaccagctaacatcatgatgacaggatcaaatccacacatatcaatactaaccttaaatgtaaatgggctaaatgccccaattaaaaacacagagtggcaagctggataaagaaccgagacccattgatatgctgtcttcaagagacccatctcacatatacaatggcatacactggttcaaaaaaaagggatggaaacaaatctaccaagcaaatggaaaacagaaaatgccaagggttgcagttctactttccgacaaaacagactttaaaccaacaaaggttaaaaaagaaaaagaggggcattaggtaatggtaaaaggttcaaatcaacaagaagatctaaatatcctaaatatatatgcaccaacacaggagcacccacactcataaagtaggttcttagggaccttcaaagacacttagactcccacacaataatagtggtagtctttaacaccccactgacaatattagatcactgagaaagaaaattaacaaatattcaggtcctgaactcagccctgagtcaaatggacctgatagatatctacagaactctccacgtaaaaacaacagaatttacattcttcttattgtcacatggcatatatcctaaaattgatcacatcatcagaagtaaaacgctcttgaggaaatacaaaagaactgaaatcataacaaacaatctctaggaccacagtgcaatcaaattagaaattaagactgagaaatttactcacaactctacaattacatggaaactgaataacctgctcctgaatgactgtttggtaaataatgaaattaaggcaaaaatcaataagttctttgaaactaatgtggacaaagatacaacataccagaatctctgggacacagataaggcagtgttaagaaggaaatttatagcactaaatgccatcaaaaaagttagaaagatctccagttaacagtctaacatcacaactaaaaagaactagagaaccaagagcaaacaaatcccaaagctagtggaagacaagtaataaccaaaatcaaagctgaactcaaagagattgagacagaaaaaatgtcttttgtaatggatgagtataaggctccagatagatacagagaatgatgacttatgtaaacttactctctcttagctctattactgtccctgtttttctgtttgatgagttgtttactctttggcaataattttgctaaaaatttctgtaatcatgttttttattgttaaataatgtaaatgtaaagaaaacattatatatttataaatacatgtagtatttccgaaagttttcttaaaaagggtatacgatctctaataacaccataatatactgatctattatgttaatatactgatctattattaatttgttcatatctctgatgtctgtaacatcaagcacatttgtcatggtttttaaaataatatatatgtgtgtttgtgtatgtgtatacatatatatatgacacatgctgggcatagtcattgcacatactaggtatttgcatgtttcttaaactgaaaattaacttatataatcatattcttaagactttgtgccaatttatttaaatataatacatcaagcttacctttagaactattttgaagctttttataaaagataaacttatcactaatgaaatataaattggaaatagtcagaaaaagaagaggatgccaaaatgttaactgtgaaactagttgtttttgtattgtattgttacattaaaaaccaccacaaaatgtggtggctttaacacatatagtgatttgttatttttcacaagtctgggctttctgagtgggaatattttctcatgtcattatttcagccacatgagtctaaggtcactcatgtagctgaaataatgtcacctcagttgggtctggagaatctaagcctcactcagatgtgtaggaccttggtgctggatattccactagacctttctctccaaatggtcacccatcattcccttgtctagcccagccttcctgacatggtagtagaagtttaccaaagagtgaagacagaagaatggaaaccttttgaaacctaggcttcagaacagccataccatgacttattgccccattccattgatcaaatcaagtcagaaatccagcccagttgcaagggttgtagaaatagaccccacctcctgacaggaggatttacaatgactgtatgaccatatttaatttaccacagtagtatatgtgtaattattaagtataaaatttatttctaaacttactgaccatgagtactaagtatcagaatgaagaatgaataaatgtttataatccctcttttttttaactttaaattgaagtttaggggtacatgtgtagaatgtgtaggttttttacataggtaaacatatgtcatgagggttggttgtacagattatttcatcaccaggtattaagcctagtacccattagttatatttcctgcttctctccctcctctcaccctccacccttcaacatgccccactgtgtgttgttcccccatgtgttctcatcatttagcttccacttcttagtcacaacaagtggtatttggctttctgttcctgcattagtttgctgaggataatgggatccagctccatccgtgtccctgcaaagaacatgatctcattgttttttgtggctgcatagtattgcatggagcataggtaccacattttctttattcagtctgtcattgatgggcatttgggttgttcccatgtctttgctattgtgaatagtgctacaatgaacatacatgtgcatgtgtctttataatataatgatttataatcaattgggtatatactcagtaatgggatttctgggtcgaatggtatttctgtctgtaggtctttgaggaatcgcgacactgtcttccacaatggttgaactaatttaccctcccaccaacagtgtaaaagtgtccctttttctccacaaccttgccagtatctgttattatttgactttttagtaatattctgacttgcatgagatgatatctcgttgttttgatttgcattttgctaatcagtgatgttgagcttttgttcatatgcttataggacacatgtatgtcttcttctgagaagtgtctgttcatgtcctttccccactttttaatgggttttttccctgtaaatttatttaagttccttgcaaatgctggatattagacctttgtcagatgcatagtttgcaaaagaattgtctcccattctgtaggttgtctgtttacttttttgatagtttctgttgctataaagaagctctttagtttaattaaatcccagttgtcaatttttgcttttgttgcaattgcttttagtttctttgtcatgaattctttgcccatgcctatgtcctaaatggtattgcctaggttgtcttccagggtgtttatagttttgggttttatatttaagtctttaatccatctttagttaatttttgtatatggtgtaaggaaggggtccagtttcaattttctgcatatggctagccagttctcccagcaccttttattgaataggttgttgcttgtttttgtcatgtttttcaaagatcagagagttgtaagtgtgtggtcttatttctgggttctctgttctgtccccattgcttgtttttgtcagctttgtcaaagatcagacagttgtaggtgtgcggtcttattttagggttctctattctgttccattggtccatgtgtctttttgtgccaatatcatgctgttttggttactgtagccctatagtatagtttgaagtcaggtagtgggatgcctccagctttgtttttttgtttttgttttttgcttttgtttttgtttttttgcttaggaccacgttggctattgaaatccctttatttttttaatgatacatacaaattacaaagaattcaaacaaggcaaaaatgtaaaaaggcagtaaaaaaataaaatgtacttcaaagctaactacccaagagtaataaatatttaacattgtttataaaacattccaacatctttcactgcttattatgtagctagaagaatgtatggatgtttaaatgagtgaaagacatagctatttaaacaattaggataattttctgaagctaatatatagtagcatttatttacacttaagcagaagaaaagggaactgagtaaaagagcctattgactttgaaataactgttttttattagaagagatattatatgctgaaatccctctaaattttaaaaaataggaaagtcattaataggttacagtcatatgttaactatatgttaaaccttagacaggattggttgaatccttgctatgaaagataaggatatttgcactattacatttcttcccacctaccctctccttaccttccaatttctgtttattatatgattttcagaaaaaaactgataaaacaatatccagtcctcaaactagtgcttatttcaaacttgttgcagagatgtaggaagaaaaacaaaaagtcagcccagactgtatcagatctggaacttgcacagaaaaaaaataggggaagcaagaaaccagagacaacatatagtctttgttggaatactctgctcttctgaaattttattaatgtccagtgctagaatctttcttcctagataagggtttagctcatcattatgtgaggactgtcatcaagtttaagattagttttccatttcagtgtgccttcgtttctagaatcttcatcttgaatgccatgagccctccattgcatgtttcttatagaagctgcttacaataagaaaaagatatggagtctcttttagtttgcatctctgtagatttagaggtattcatgagaatttttaagattttgagaattcaccattatgacctctttggagtccagagtagcattaggagcctcaaaatggagaactgtgtgtctcaaagatcttttgtttctgtccttaaccatccagcttttgagacttacgaagctatgttgtttgcttatttggttgttgcttgtggaggtttttcctctagtttttactcttttatgttgattttatgacatattaggagggggatttttgtgatacacctttattctactaaagatgaatggaatggaatactagaaatgcaaggcaataattttttaaagaaatatcctccacataaggaaaagttaatcactaaaataaacaatgtcctcagcctcacttttgcaacagatgcagagggacttttcataagttgctttcatgaaaaaatcttcaatgacctcttatttggtagaggcagctgaatattaaagttttgtcagaataaagtggatctaacaggtgcagaaacaaatatggcaagataaattgctttctaactaagctaagataaattactaagttaaataagataaatttaataagttggtacagtaaatagctaagataaactgctttttaaacatgatagaataaaaagactcagtatctaatgtggcacatagttcagtttaatatgtatacatatatcaccttgaggtatctttcttaaaatgcagcttctgattcagtagatcttggatggaacttcaaattgtgtatttctaattccgtgacaccactggtgccagttctcagatcatacttttagtaacaagattctagacaactatagactaagagctcctctacttgactgaatccttgagaccagagatactgccttatttatctttgcattgctgttctctaaggaagtacctgaataaaagtttgccctgaaatattttcttgttaaatgaattaatgaatcagatgcatgacaactaggggcctggagaactggtattctatactggtgggtgaggaagaattcttttgttttgaaaaccaagtgactgaatgataggatttctattttgtcttaaaatctaaaagccttactaaaatttttgctcacatgaagtctgccatatatcacattagctactttggccaacaaaatattacctcccaaatgcttgaatagattcttaattgctctcaagataacaaatgttattcaagtgaaagaaatctatatattaagtgttaccagttatccatcctggaaatagaaaaactttagtaatattactgtaataaaactgatttttgtttgtttgtttgttcgagacggagtcttgctctgttactcaggctagagtgcagtggcacattctcggctcactgcaacctctgcctccctggttcaaatgattctcctgcctcagcctcccgagtagctgggattagaggcacccaccaccgtgcccggccaatttttgtatttttagtagagacggcgtttcaccatcttggcctgggtggcctcgatctcctgacctcatgatccacccacctcggcctcccaaagtgctgggattacaggcgtgagccactgcgtccagccaactgattttaaactgtatgaaatctttttgggcctacccaactatctgtgaaatttacccttgagtaattgaacagatcgtctccttagactagtagttttcagttgctggctacattttagaattacctgggaagcttttaaaaatcccagtcagtgcccaggctataccaaagaggtgagacccaagtattttttaaagctccgcagataattccattgtgcacccaaggatgagaaccattacttgactattagctctttgaaatctgagtcagtgttcctcttatttttaacttttaacacttaatacatggtaggtacttcataaatgtttacttagtcaacagatgaattatgttataaggaagtattatctgaggcaaaacaggagcattcttcagtataaagggaccatttttactatgtttattagcatcttaaaatttgaaaagtttgaataccctcttaatgttaatactgaaagttggtatttgatatagataaacattttggtgttgagatattttgttgatgcaacttggatttcatatcactttttatcaagatttgatataaatggattgtgatcagaggtgagaaaactgtggcacaggcatttcactaccgtaatggaagtacttaaaggaatgttacaaagagatctaaggtgttctaggatacatcagtcggaaaacaaagatggttaatctacacattgctgagttgtggtatcaaccgtggttttgttttttgtttattgttttcttgagacagagtctcattctgtcacccaggctggagtgcagtggcgcgatctcagctcactgcaacctctgcctcccaggttcaagtgattctcttgcctcaatctcctgagtagctgggactacaagcgcgctccaccatgcttggccaatttttgtacttttagtagagatggagttttgccatgttggccaggctgttctcaagctcctgaccttacgtgatccacccgcctcggcctcccaaagtgctgggattacaagcatgagccactcacccagctggtttttttatataccagaaagaatagagagctatttataagagtgagtatttaagcttttctgctttttaaaatgaagcacagacaattgaagttttaacttcggtttatgaaaccactttataagcacctgtattataataatcattgatttttgaggggctttcctcagaacaaaattataactatatctgggatcaaagttctttagatgggctctcagttatctacaatttatgtttttaaaaatagtttgttgccattaattaatcattgcacagaaaagttcccttcatttggagctctgagctctgcatttctgtgataccagaataaaacacaaactgaaaaaaaagggaaaaaatcattttttaggtcttggatttattctaaataatcatcctacattttgtgtcactgatgaatttgagaattgtggggaccgtattgtacatctcggtatcagcctgctatttgtatttcacaacagttatcggcaattaaatgatgaaattctatttttaaattttgactctgaattataaaaacgtaatgaaacaatgtaataccaatgcaagtatatgattataatttaatgagcacttaattgccctttttagcaaatagctaaaatgtagaatgggttgatagaattagcaagaataagaaaagtcagcagatggagatcctagtttcactttgttataaactaggtgtgtaattttgtaaattatttaagcacattgtacttcagttgtctctttagaaaataaagaggcaaatctgctaaagacccttctagctccaaaattttatgacatgtaattctaatctctataactgtcatagtagtgcattttgaatggctgaaaagaacttcagataagccattaattataaactctttatttacggttttcttatgttttatttactttcaagaatttgatacttgcatcctcattttctataattaataaaataagtactcaaaatttcagtgccttttgatcaagagtgaaactgttccatgaattgtgcttagaaattttcttactgactgttgaaaagaatctgtgtttcctcgttgaatacaaagtgtcctaggactgggatgttttgagcaagcaggcaaatttttctgcacatgactatactattgttttctttcaggaaaccctgatagattggtgtgatgaaaaggaacttaatttgatattaacaactggaggaacaggatttgcaccacgagatgtcactccagaggtgagatagtacatgccttttcatattcaaggattaaactaatcatggtttttttaatcctttttactatatttatattatttttataactttgctaggcataacaaatgacttgtagttctaataatgtgaaaattttgctgtggatgaattgtgaaaaatgtttcctgactttttttctttgggcttaaactagaagtgatagaatatgaggaagattaaactggtccagaggtaatctgtcattttcttgatgtcagcctaatttcaggcacatttccaaaggaagtgatagcagaattctgatggttagcatggcatctggtctgatgtgctttgtcaatacaattcttttcttgaggtacccttttcatttgtctaaaattacagtaagatgactgcaatagaatatactgattttacagtacttttgttgaaaagggatatattttccacaattctaaatgtgaacagcatttaaatgcagaatttaatgagcccaaaagtagaattaatatctaggcttaagaccacaggaagcatcttcaactattttatatataggaagaaaaattagggaaagaatgaagaataagcactattaactaatatggggggggatgtattttttctttaaggaagccataaaccacagatgtcacctcagagctatacataaaattacatcaccacttgtgacattgtttcctttacctacccaaccccccaaaagtgtttcttggatcagtttcaacttaatatttactatgtctttctatttcaaatcagtacactattgtatctactaccttattaacattccacaaggtacttttgctctgcatctattaaataattactggccttcttataatagtacaatggttttcaaacgttagcctgcatcagaatcaatcagaggacttattaaaacacaaattgcttgaccccccacccctagagtttctgatttagtaaagctgcaatgggtcttgagaatctgtatttctaacaaggccccaggtgatgcagatgttgtcgttgttgttggaccatagaccatattttcactatatgaaaatgcaattttaagaattattttttttctattcctctatataaaaaccgtggtacataaacttttgatattattataattagggttttaaataaaatagttttggcttttaaagcaatcaaaatcgagtcgtattgagaggttaacttcaactgcataaagtcatccttacacaatttatttagcttctggcttctatagttagtggttctttggcaaagttttacatttcttttatgctatgactgactgaaaaagtacaattgggaaggaagccatctcctgcagaggtgtgcttgtgttttgtttctttgtaagaacattgactacttatgttaagatatggatttttggagtttgggtgctgtcttaagtgttttagtaaatcactttgcgtttatgtatgcctattttttgtgtgatggtttgatattttcatattttttcataacagaaaaatagaaaaaatttcaccagaaaattaattcataaccaaataacagtattatttttaattccttggataattgatcgtggggaaataatttacatcacaaaatgttttgtatcctactgggctttcagttaatacaaaatgctaggctgaaaattcaaacctttgaattctggctctgctacttatcaacaaggtgaccatagacggagtgcttttactcacacttctgatgctaaatgtgggtttttttactcgaaccagccagttcttcaactctccagatatcaaatgtccttctttttatttcaattaaattctgacactacctaccaggaattagtactagactctgcagatttaagggctgtgtccacaagattgccttcacgtcacatgccagtggcaagtaccagatccccaggctagtcaaaattctgtcctacttgactacaaagtcagttggttcccaaaccgcgtcccccaccccactctgcattttcagattcactaatttgctagaataggtccaaaacctcctggaaacactttacttatgcttaccagtttactataaaggatacaatttaggaatagccaaatgcaggagatgcacagggcaaggtataggggcaaggaggttccatcccctctcagtatttagcgcccctccggcaccttgatgtgttcatcactctggaagctctctgaatcccattgttccaagatattttatggagctcagtctccaacctcacccctcagtgagtggaactgaaaattccaatgctcataataacttagtctttccaatgaccagaccagccccatcctgaggctatctaggcacccaccctaagtcgtctcattagcataaactcaggtgtgatctgaagaggtttgggcctggcatggtggctcacacctgtaatcccagcactttgagaggcccaggcgggtggatcagttgaggcaaggagttcaagacaagcctggccaacaaagtgagaccatgtctttactaaaaatacaaagaattagctgggcatggtggcacacgcctgtaatcccagctacttgggtagctgaggcatgagaatcacttgaacctgagagtagaggtttcggcgagcagagatcacaacattgcactccagcctgggtgacagagggagaccctgtctcaaaaaaaaaaaggcggggtgaggggggtgcagaggtttgttaggaataacaaaaggcactctgtactgctatcactcaggaaattcccaagggttttatgagttctataataagtcaggaaccaagaagaaagaccaaatgtatttttatcttataccttaatagactagtcatttaaccactctgtgccttagttttctataaagcgagggaaataaaagcacctatttaccaaggtggctgtgaccgttcagtgagaactattcctggtattttatgtaagagttaatttataagagttaattttttttatttgttgctatgtaacttatgtaactaccaaatggacacatttgatagtttttcttttttgcatgtaataccagatagacaactatagccttttacttgttttgaagtatgtccatgaagtctttagaatcttgttaaattatttcttaattttggtagggtaagcttcatatttgatctcttccatctctatattatataaatcagaaatcttgaatttctgctattctagtatctaggttttgtttcttttcttttttggcactactagttgacaagtgtctgtttccatggcattgtatatttcattattcagaaattgagcagtattttattcttaaagtttttcagttatttgaaaactattgaggtgctcttatattcatatatacctatagcagctacatagttaaaattatattagaggtttcttaaatggatttaaaatatacataaatatgtcttctctaatacctgtttttgaaaagaagcaatttacctgattgtgaataacttgatctttaataggttcacttcatattttatatgtatatataaatacatatgatatgaatatctatggcaaaagtttgtagcagtcgtgggctattaaataatactaataaaataaataataaataagcaaacataaaatcaatataggcccactaaaaagtaattctactaatttcccttttactttacatcgtagagtagttgcagttcttataatatctaacgtataatattgatgtgtcagaaaggaatttagaaatataatcctcgctgaattatatactgatttgtctgttttgatagttgtatctaaagagaagaagctgtttctagacacatttacctatattatatacatcaggattgccaatatttttaaatgaggtcagaagttattggtagaaagcacaaatactaatttgataaaagtaaaacaatgtaaaacttctcccttaaaatcctaataatgctttatagtcgatgattgtcagtaattagcttaatctgtaaagcacaaagcaaaattgtttgtggatgtgtgtgttgtaagaaaaaaaatgaaggatgaaaatgatgaataggatgaatgaaaaaaaacaatccaaagattttgtcaatgggtatgagctctagataaaatgaaaaatttaatcaacagatttctctccaggtctattaaaaatgagaatagaatatcaagtatagtaaagtttatcttctttattatatattttataggaatagggctatcagaattgattttcctaaattatgaatttgtttatatttttaggccctgcatcatagaatatggttcatctgatacttgcatgccttctagccttctccctgcctctaaatatgagatgctatcaaaacttacatatgaaagcatgataattctcactcatcaactttttagaattttgtcttgataataaaaactggtttttaataatagattgcttgcctttttttttttttttttttttttgagacagagtctcactctgtaacctaggctggagtgcagtggcatgatctcagctcactgcaacctccaccttccacgttcaagcaattcctgtgcctcagcctcctgagtagctggaattacaggcgtgcaccaccaagcccagctaatttttatatttttagtagagacagggtttcgccacattggccaggatggtctcaaactgctgacctcaagtgatctgcctgcttcggcctcccaaagtgctgagattacaggcatgaaccactgtgcctggccagatttcatttttttctggtccgataaaggttggataattcattggcactagtgaaatattagtaattataaagttccacagattatgaaactcatttctatacaaagtattttccctttatgtcccattattacttcaaagcaatgtatgtccaaaaaaggtattattacataaaggatctgtgtttgataatatagtaaattagaaaatgttaaactgttaaatatttaaaagacacaaaataactttcagtacttttagagcactaagctgtattgaattaagggttgtatgctaatatattattttgatcataagtaaaatagttgagtaaaagcctagcatacctgtatgtctcatccacttggtcatttgtgaagcttttgtttttaatcctcaatatgtgttcagtgccatgcttggtactgaagttaaaaaatgagtgagactttcacaggggtaagcaatgtagcccacaagccaaatccagcctgtcaccttttttttgcatgtccagggagctaagaatatattttacatttttaaatggctgaaaaaatcaaaaggagagtaatatttgtgaggtgaaaattatttggaatttgaattttagggtctataaatgaagttttattggaacaaagctacacttatttatgtattgtctatggctaaaacagcagagttcagaagttgtaaacaagaccgcatagcctataaagcctgacgtatttatcatctgatgctttgcaaaaaaagtttgtccacccatggccttttggatgacaacaagtcatctttactcacatttttttattttctcacttttacctttggttctttagtaatccgaataatgttaggtttccttccttatatttttaattttagatggagcaaagaaaaaatgcttttttgccatattgaagtgtattgcctcattgtttcaatagacaatatagcctaataaaaataaaatatcccttattctaaataatatatagaattctgcactttaaaaattaatacaatgaatttgttgtacattaagtaaaatctcactgttaaaaataattttaaactgagaaaaagtaatttgaaactgacattcttaggaatgcctcataacaaaagtatgctgatataattgatgattatactcaaacaaaagaagaaatagcaaaaataccaggaaactgtaaatttgacataaggaatatttatttaaaagagttcttataactgtttcattatggaagtgaagaggcatcagacaaaatgacctctttcaagagggaaaatactacaaaatggtaccaaagaaacctgacttaggaaaagactctgaattttagaaggtatattctgtttatagactacttttaggttgctttggggcagattaatatctaagcttttctacaaatttttttcacttaggttattagatttttttcatgaaaatgtcagttttctagtacaaattaaagaaagttacaaaaattgttttataatcaatttgttgaaatatatgtatttcataattttaagtgtgtgtttactataagacaggtattattttatgtagtcattagtcatttttctttcttatattgtaatgcttcaaaaataagaacactgtataagccctgggaagaagaaaaaattgacctaagttactaacaacatgttaatgattttcagtttgttactcttgtgaaagagagtgagaatttacatttaataactcacctaaaagttaatattggccattttcacaatcagaaaacactctcctacattttaacagaagcatagcaaaaaataccatatttaatcatttgtttttgatagaaaatttgattttgttttgagtaaaataaaatacctgttatacatggtaaggctaaaattagtcatattgaactaggattttgactatcttaaaattgttctatgcaaataggataatttaacaatattaaattgcttacaaagcagaatactagaaacccttatacctgaagtatttaaaactaaatttaataaaatgttccatccctctacagtcagatttgatggttatatttgatggcattttaaggagctcatcctaattttatgaaatagttcccatgtcatatctttgtctaaacacgttggcatgcaatatggtatagtggaaaaagcttacactatagagtcagattcctaaatttaaatattagtgctactacttactaactatgaaacttaaggcaagttgacctgttcaaatctgttttctcatctgctaaattagctaatttttctcatctgctaaattagctgatgcctacctacatctcaaaattgttgattctaataataaaaatagtcaataataacaactaacacttacatatagcaattactgtgtgcaaataactcttttaagcatatgttaactcatttattcttcaaaacaaccatatgaggccaggtgtggtggctcatgcctgtaatcccagccctttgggaggccgaggtgggtggatcacttgaggtcaggattttgagaccagcctggccaacatggtgaaacccatgtctactaaaatacaaaaaaattagccaggcatgttgttgcatggctgtggtcccagctactcaggaggccgaatcacgagaatcacttgaacccaggaggcggaagttgcagtgagcaaagatggggccactgcattccaacctgggtgacagagtgagaccctgttttaaaaaataaataaataagatatgtataaggaaggtactatttattgttatctctgccttaaagatggagaaactgtgacacagattgattcattgacttgcccaagacttttcaagtagtaaatggcaataaatgcatgtaaaaggatctaacataatgcctgtaatctttgtagatgctcagtatttgttctttttcttcctcatttaattaacagtactacctgttatctctaattagatatggtagctccaaatacttttgctactaaccattgtgcttctgatagctattgttaactacaaacataattggtggatatgtcttaaaaataaggacttgtcttgaaacagccagatatgtgaaaaaataactttttagtaatagcccactttatatctgggttttataattatttttgtattgtccactgaaagcagaatttttttttttgtatcataggcacacttaagacctttctgtttggtaagaacagcattcattttctttgttcaatgtaacaaatatttatgaagcaccttggactttatcaaacctaaagctaaagtacatatactcctaaaatagtcatatgacaattcaagacagtttaaacctggtaccagaaatatttagccaattcaggcaaaaagatttattcaaagagaaagattaaaagagagcttgagtaatgagtgaaatttttataaaattcaggctaaaattgaatgggatttaggttttgaaaaaggaagaccttaaaggtaggagtaaagaagaaggaaaatatatgagcaaggcacagagaaatacaaacataaaatctttctggctaaaacagagaattcactttacgtagaaggatggatacactagacctacattattttatttctttcagactggctagagaggtaccaaatacagaaatgagagatttactgtattagtctgttctcacatcgctaataaagacgtacacaagtctgggtaatttgtaaaagaaagaggcttaattgactcacagttcagcagggtgtggtaggccttaggaaacttacaatcatggtggaagttgaagcaaacacatccttcttcacatggcggcagcaagtagaagtacagagcaacagggggaaaagccccttataaaaacatcagatctcaggagaactcactatcatgagaaccatgagaaaagcatgagggtaactgccccatgattaaattattagtacctcccaccaagtccctcccattacacatagagattatgggaattacaattcaagaccagatttgggtgggacacagccaaaccatatcactgccgttattcagagattccttggaaacgagaattcatgagtctcctatcagccagtatagacagtaaaatcatgctttcaggactttcttagactcttttttgaatcagcatttattcgaatgcacatgaatacattcctcagtaggactaactttattctctttggaggttgtttttatgccctggttaaaaaaaaaaaaaaagttctgatgtaatctgcaaacctagtaactatccatttatttacttattaaatttaaactgctgagaggcacacaattccaattttgttgatttgttgtctggaaaccttttcagtcaatatttcccttagaatcaagaatcaagacaatcggaatatgtaatcatagatttgtcagtgctatatcttaattagcttagcatttgtataaaattacaaactttataatagtggagaaatcatagtatctcagagtttgaagagaacaaagaccttcatgttcaaagccctagcatgcccttttcatcattccagcctgaacatttcaaccatcacttcttctatcgaagagttcattgtttagacaactctacttgtttgaaagtctaaatatatcaaactgaaatctgtcaccttataatttctacccacttgtcctaattttgctcttggctgtgctcaaaagaaggttaattcctcctctgcatgacatttctgatatttgaaaagaaatgttatgtttctccttaagtccacttacttatggattatttttgcatttaatttttctaccaggcacagacttacccaaaacatacatcctctattttttatgcatgaaaaaagaaaagctccatagtaaaatggtgccagtataaaaattacaggtacaaaattagaccatttagataaataattagagcaataactgactttgcatttaagactgttaagttttgaaatatgtcccatcaatacctaatttattgagagtttttaatatgaaagttgttgaattttctcaaaggccttttctgcatgtattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagggtattggtctaaaattctcttttatggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtagtgatatcccctttttcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgtgagggtgtcaattttggatctttcctgctttctcttgtgggcatttagtgctataaatttccctctacacactgctttgaatattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccgtgtctgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacagagagccaaatcgtgagtgaactcccattcacaattgcttcaaacagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacaataaccaaaacagcgtggtactggtaccaaaacagagatatagatcaatggaacagaacagagccctcagaaataacaccgcatatctacaactatctgatctttgacaaacctgagaaaaacaagcaatggggaaaggattccctatttaataaatggtgctgggaaaactggctagccgtatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagcactaatatccagaatctacaatgaactcaaacaaatttacaagaaaaaaacaaacaaccccatcaaaaagagggcgaaggacatgaacagacacttctcaaaagaagacatttatgcagccagaaaacacatgaaaaaatgctcaccgtcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattacggcattattcacaatagcaaagacttggaaccaacccaaatgtccaacaatgatagactggattaagaaaatgtggcatatgtacaccatggaatactatgcagccataaaaaatgatgagttcatgtcctttgtagggacatggatgaaattgggaaccatcattctcagtaaactatcgcaagaacaaaaaaccaaacaccgcatgttctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataaaaataaataaataaataaaaataaataaataaataaataaataaataaataaataaataaaaagactgttaagttgaaagggtcctattccacacagtagcactaaagagggaagagtacattgttccttgaggtcagaatttttgcaattttgagaataaggcaaaaacaaaaatttcctatatgaagaacccacaaataaaaattatatattcaatttcctttaaatatatatcctaattgtatacctactctatgtcagaatatgtgctcagcttttatggggccctatggatacgagagatcatatgttaaataaacatacaagcaagtgtagatgcaagtgatggtaagttctgtttctaattacagttctaactagaaaaatagtgttgcccatataaccttttatggagtagcataacatactgcttaattctgctctgtaatggggcataaaattaataataataaaaataacatagtggttaagagcacagactatttgggtttgaatcttagatccacctgttattagtgtgcaaccccatgcaatttacttaactttaaaaacctgttttcttatgtgtaaaatgatagtaagagtacttgcctcatagggtacttacgttatgtaaataatataagcaaggcactaaaaacaatatttccttgctatataaatctttgctattgttatctacaatatgtttagaaagagctttagctttaaaaataagtagatgatggtggaataaatattataagaattattctctgaaagaaaaatcaaacaagatagaacttaaagtacacaatagtatagttgcagaaaaggaaaaagaaatatcaaagaagacatgttaaatccttgttttagcttgaatttatcagtgatgatatcttgaaatcacctttccagttcacccttccaaatctactcttgtaaaatgaaaagaggctagcataccagaatactttggttttgcaaaatatgtgctaagaaattaacaacaaaatataaataaatattttgcagatatattagtaaaatgctaaaagtatatttatctagagacatagtctaaggaatgaagatttcaggatattcctttctttactactgtctggaatcaggaatatggatttctctctctgtgtattaggtatccatctatgaaatggacttactgttgcctttcacataaaatgtaataagatgacaacaaatgagtactttatatctgtcaagtactatgaacttctcagaataatatcactgaattagaagggcagaatatttgtaactttgttgttactgcctgccataaaaggcatctgatagggattcagaaagtagattgaggcaacaaagtaaacaatttgaataattctaataattttaccagtattattttcttatattgaaacttggaactgctactaaaatatgaaggacaaatgtccactggaggtagtaaccattttagatatttattaatggcacatagatgagaattagcagaaaggatccaagttccttcaaaagatgctgagaagaaagaagcagtaaacctctcttgtatgtacagtttgaaaatgatggttgtcagtttcactgaatgaacgagaccgaaggccaaaggcaacaatgtggaagaagcagtccatcatgctggaaggactaattgatatacaaagaaataaattatacttctctatgaagaatgaagataacattatagccatgagtgccactgggataatttaagtgtcttacccctcagcttcttcactcctttctataggttgtattgcagcaaataacataatatccttacgtggaataatcctcaggctaaacctttatggaaagaaaagctaggtcagttttgattaggaggtgcttctgaatgcagttttacaaaattttttaaatactctttttttacaaaatggaggtatttgaaccagagagaatataattgttagttttgaatattgtataactataatggagtcttattataatgtgtcaattgtctgctgtgattcaagattacattgtataggcaaacccattataatgaggtcactttaatacccccattgatgagattcaaaagaaattcatatcatgctaatttctgactattgttagggtatgtatttagaagtttagttaattgtgtgatactttgatataagtttccatttatgggccctatttacttcctctttcattctctcccattttgccattttcaagacttactggtattgtactttgtccttcgagatggcgctgctctgtggggtagatagatgaatgaatatcaccctctttaataaataatatttagaggaatgagaggttacttgtatataatattgaaagcaggccagttgtggtagctcatgcctgtaatcccagcactttgggaggtcaaggtgggcagatcacctgaggtcaggagttcgagaccagcctggccaacacggtgaaaccccgtctctactaaaaatagaaaaaatagccaggcatgatgacatgcccctgtaatcccatctactcgggaggctgaggcaggagaatcatttgtacccagtaggtggaggttgcaatgagccaagattgcgccactgcactccagcctgggtaacagagcgagacactgtctcaaaaataaaaaataaaactaataataatattgaaagcaaatcctagtataagtatacattcccccaaacatttaccatggacaatagtagcagcaatattaacagtaaattctagtctatctttgctcaaattttagttattgctctttgccttctaaatataaaatactataggacaggggtcagcaaacctatttaaaagggccagatggtaaattttttagattttgtaggcatatggtctctgtcaaaactacccaactctgccagaccggtagcacagaggcagccacagatgatgtaaatgaatgagcctggctgtgctctaataaaactttattacggccactgaatttggatttcatatatttctacgtgtcatgaaatattattcttcttttgattatctcttgaatcattaaaaaatacaaagatcacttatagagtgcaggccatacaaaaaaaaaaaaaaaaaacaggaaatgggcaggatttggcccttgggctgtagtttgccaacccctgttttagaacattcctattctatagtacactggcgtctgctctgttaatcttaaagctcatagtatgtgagctttcagaagaatactctgaaaaattgagattgagagaggaagccccataagaagttaatgcttcatggactcaaatatgtacttaaagcctactagatagatatagatatagatatagatatagatatagatatagatatagatatagatatagatataggtatagatatagatatatacatgccaggcactgtttaagatgttgagatagagcaatgagttaagaagtcacaagtccctacctttatggaatttacattttagtgagaggatacaagctattaaaaaacaagtaaactctatagaactggagatggtaagcgctatgtttaaaaattaaccagggagggaggataggtagcccaggtaggaaagagggttataattttaaatagggtcatccattaaggaaggcctcattgataagatgacatttgaacaaagacctaaaggaggagagagaggaagccatggatcatgtggaacctgtatgccacccttagtgtaacagagtagaggcatggcatgaactgacatattttaatgggaaaacaagttaggagactattaaaataatccaggtggaaaatgacagtggcttagaccaatgatagaggtggaggtagtgagaagtagattactgatatattttgaagggagaggtaaacagatgcaataagataaagagagaagtcaggtataagacccaagatttgccttgggaattagaagaatgtagtttccatttactgaaatggagaagactatgggaaaagtaggtttgagggggaagatcaggaattttactttggttatggaaacctgaacttcctttagatatccaagtggagatactgaattgcaattagatattaagtatatgaggccgggcatggtgactcacacctgtaatcccagcactttgggaggttgaggtgggtggatcacataaagtcaggagttcaagaccagcctggacaaccgggtgaaaccctgtctctagtaaaaaagaaaagaaaagaaaagaaaaaagccagacctggtggtgcacgcctgtaatcccagctactcgggaggctgaggcaggcgaattgcttgaacccaagaggcaaggtttgcagtgagctgagattgcaccactgcactccagcctgggtgacagagtaagactccttccccccgcccccgccccaacccccccagccccgcccaaaaaaagtagatattaggtatatgtatctagacttcagtaggaaaatctgggctagaaatattatttttggagtcatcaacatataaatggaattaaaatccatcacaattgatgagatcaccaagatatttactggtattactatttgttgattgatattactgcccctgattctttctcatccactttcaaagaggtaggtagtttctagtaatctgtcccctctgctcattcacaaagagtggaagggatcccactgaattagaaacccgacctacacaggaagtaccattagttgaccatcttcccattttgccgtggtgtaaacatatgagtgaatttttccaagtacctccttgctggaaactgtttgcactggaggtaagtgtgaaaggggaggttgtggggaatgatggggtgagggctgcctaaacttttcccataactcagaaatggtttcattctgaggaagggagaaggttcaggctggttcttatttccctgaaccagtttgtacagccctaaatttgacctgctttcctcaaactgggagtcagaaatcccttttctcttctgtttttctgctgcagaaattcccaacattcccattttgtgggctccagaaaggggtaagcgaagacttcaatcccagccaatcattttcagattaataatttttagtgttttggtttcttttatcatcataaaaaatgcttggatccatttttcacatctgtttaatttccttgtggattgttatgtatctatgttctagggtcattctgtatccctgggcaatagagttcagatccatctgctatttccatttgtgtgctgttctcttgtggattctcatttgcagtttattgattactgtatcctagatggaagacacccaattcaggggactgcctcactctcaatctcatcttttcctgaatggtgttttattcctctgctgagagcttgctattacactacccaactgcttctgatgatctgtcattgtttctctactgttctgtcttcctgcttgattgcctttggtttttgtctctcctttttgcctcacttcactcatctgctgaatgatttgcattcttcactcactggtgctttgtccgtcagcaaatggcctggtactgccatatccatctgctattttagcattttagactgcccagcattatctatctgctcccctacaattcccctatactatggcctaacaagtgctatgccatctgcctgcctgatcttgccctgcccaatctatgcctgtaacactgtaagtaggtgagattgtttagcatttctgctatcatctacacttgccttgtgccactgagttagactgctgactgagttagactgctgactgagtttgcttgactgttgcctcctctacctatttgctacctatggctgccccattaatttatttgagatattgaaatcatctcctttgtacttgcaacttgctgattggcctgtgttgcctcctttacagtttgctgcatttaaaaaatcactggcattgctcctctgttgtcttgtaaccctgatcatattttatttccaataaaagttttgcctacatatcgtccaaacatcttagaaataggaaaatgctttgctatctaacagcccagtccagtttgctcctaaactgactttttaaactaccacctgtcctttctgcttttttatacagctccatattcttctctttatgtaagaatatatttttttataaataatcatctttgcttaagttttcctttcacatcatatattatgtacatttatttcttgtgtatgggatcttttaataattttccatatactaaaattatttcttaatttattattcctaaattttccagggttttataaggataagttactcctattaattttatcctttttaataagaccagaagatttttttgcaactttaaaagcatcatctctaaaaataaatttaattatcttataattctttgtagtttagattaaagtagctttctgctctgctctattttttcctttgagaatatcatttctcagcttcctcatagtttacgtaataccagttctttagagatcctttagatgtatttatcttccttccttttaaactcttttcttgtatgttgggtaaacctttgaaattgatattttctcattattgtatttgcaaagtacttggcatctaaaaataacttgcaacataacattatctgcactgtaaaacttacagtcttatttgcttatatttaaatgaaagctcaaatacaagaaccaaagaagaattttggtgaaatttgcaagagtctaaggaggagatgtaaagtggggtgtgtatgtgtgcatgcatatgtgtatatagagatttgaagtgttttatgtgtgtatctacaatgtcattgtgctcgaagtgtggaaaatgctgagtatccatattaaattttatttttacaaaaaaatctaaagaggtgatagatttagggatacggaaaaagtatggatgggtttttattttcttttaataatatagataaaatttgtcagtgtgaagaaaaaggatgctctagggaagttaaaatcatttcagtagctttttaaaattttggtaaaatataaacataaaatttaccattttaaccaattttaagtgtacaattcagtgatattagcacattcacagttttgtgcaaccgtcaccactgtttctagaacttttatcatcccatttagaaactctgtacccattaaacaaaaactccccattcctccctcccccaacccctggtaaactataatctactttctgtctttataaatttgcctgttctagatacctcatataagtggaatcataccagttttgtctttcagtgtctagcttatttcacttagcaaaatgttttcagggttcatttatattatatcatgtattagaatttcatccctttttaactctgaccattattccactgtatgtatataccacaacttttttatcagttcacctgttggtggacactgggttgttttcagcttttagcttttacaaataatgctcctacaaacattggcatgcaagtatctgtttttcttttggttatataactagaaatggattcaatagcatttaatactttagtccaagaagaaattaaattaatagcaaagagatcagggaaaccacataattaatatgaaagattaataagtccaagatatgatattaggagcagaagaaattataaacttttagaaaggctacagaaggccaaatgataaaatttagaagactattctatgaataaaagggagaatgaagttaaaatgacacagatcttggatgattgtaagaaaacaaaaatgattctgaagaaagttaaattttaaaaaaataaccaacttaaggacagtatgatggcacatctttgaaatggaataatgtgggcttttatagaggagagaggtaggcatttgaaaggcaaggtttaaatgaagatgactaagatgagggaaccaggtcatgtttagaggaaccagcaatgggaacaggaattcatttcaatccagagatccttcatcctgtatactcagccttctaccactcatagacatttttctaaaaagattgctaggctcgaaccccagagattctgattcagtaggtttggaattcggtttaggtaatgtgcacatacatgcctctgtgtgtgtgtgtgtgtgtgtgtgtgtgtgtgtgtgtgtgtctgtgtgcgtgcgcacacgtgaacgtgtgtctgtgtgtgtgttttaatccactgatgaaacacaatatgagttaaattgaactctgtaccgtagtggcctagaccttataagaatttaaaaagttaaagagaattgacccttgtcttcaagcagtttaaaactgcagtagttaaaaaatgatggacttaggaaagcagtttaaaactgcagtagttaaaataatgatggacttaggaaagaagactttcaatctgttaggtgataagttctcatttgttaattcaacaattttagggggggtgatttttatacactctatccatcccttctcaattgaggttccccatctaaactatcaaacacagaaaattgtttgactgtcttctcaattctcctaagggtggcacaccagctagtaccattctatatgtgtgagagataagttaattcactagatacaaaaattctctcagaaccttttaagaaaggttgggtaatctgtagtctgctaggaatatgtgacacaaagacataaaacgtggctcttaaggtgctcacattccaagagaggggaaaagacatttaacaaaaaaaatgcatttctaatatcaaccacacaattttgttcttttcatctaatggtttgaggaaaatgttcaaagtcacagtggctgtatataaggaaatcctttcacctcttctaagcattatttattcaggaagaagaatgtaataagaatgataaagtctgtattacaacttatcacagctgaaggatgctggcagtaacttaaatgtcgataggaatctctttaattttaaagcctagagcattcagtgacaggttagtgatttcattggtagctattaataaataacagtaactaaaactaggcttattagtttcatagtaaagagtagaaaatgggtataggtaagtagataactaatgtccaataggctgttcttgaatgtaattgcaagcacagtgagagatttttgcccccgaagtacaactcttataccaataatgaaaatgttcaggaatttaatttattctcactatcaattaaaactcactaaaattcctgctgtcagaaggtttagtcatattcattagtttttcttacggatttgattatttctgaactataaatttatttgtgctccctatactgatttgtgcatttaaacttgagagcagttagctttcattcctattactcagtacttcacactgattcctttaggataaactttactaacacatttttccttcttccttccaatttcttaccaaactttattttaacagcacagctatggaaagatcaaggttgtcatgttgagaaaagcacaacaatagaaattacgaccagatttagcttgttttcttagcaataatgaacaattttaaaagattttgctttgcctgcattcattctgaaaaacattttaaagcagaaaaagcagattatgccgatattttaataaggtggaataaaggaaaatataagagtaacataattttattaaactcattttattaataataaatatactttttcttatcttatgatctctgaactcctattttattttgaggaagctgaatttaaaatagagtgctataacgtgtttcctttgtgtgaaagttaatctgagaaggcaaaaggtctatctcattcttactaggcttcaagtcctttatatctaataacaagaaaattctctaaattaggcaactactccctaacaaatcatctattttttcttttagttttttattttctccactgaatgacagcagaatgtattcaagaccttgcaaaggatatggctgaagatgtagcttccttatataaacattttgtggaggtttccataaaatgaagtgaaacttttgtgaagtttcactttttttattttgaatatagataataacagtagcaggcactaataatcagtctcctagtttcttaatctctcttctccccctatttgccctcctaccatcaaatacttcactgttgctggcagaaactaactcatggcacaagagatcaggtgggtgagaaagagatcactgggggaaagtaaattgccccagaaagactgtttggtgcaaagatccttttttcacatgtaacaatctttaattttatgaacatcaaaatcaatacctgaaaagtgcactagttagatatttggaatttttcaaatacaaaccaccaccagactttttgtatttgacttagaatgctttttagatttcttataatatttagtacttatgaagaaatttagtgttttttacttatatcagcaacataaaaactgctcaaatttgattcctcagatgttcaggaatcaaattttctttggtttattcatagccgtagtagtacatgtatatttgcattgtaatcaaaggtggtaatcgccctacagagttcttaagcagaggtcctcaaagaaaatactgtatctcttataagttaaattattttctcatccaatgctttctgatcaaaattaagatagactctgtcagagggataaaatatgaagtctgtttagatatcctgcttctcatgaaggttagtaactacatggtaaggctaaaggccatctgtagaaagcttctcttttaccaacaagaaaactggttttcaaatttctcgttactttctcgttagtgttaagatattaggagcacaccattttgcatatgatatgtgttcaactacagcataaaatgacctttttattgtgaaatgggtattcagtccatattgtaatagaaaaatatatggtcatttaggagaaggaaaagatgacgttcatctttttaataacagagttttaaaataactccttttttactgaacatggaaataatacatgctttttgcaagaaaaaaaagaatttggggaaaatatagcaaagcaaaatgaagttaataaaaacaccaataatctgaacccacaattattacctaagactaattcattaatttgcccaactgggagcacaccatatatactggtttatatcttggttttcttagtaatatcatcccaattattataataattactaaaatgtatagtacacttactgtatgccatgtatttttataagtactttgtatattatatctaatttaatccacacaagcctacaaaataggtaggtaccactttacagataagaaaattatatttagaaagattaaatgattaaataaattgacttggatgtagcaaaagatgatagaactagaatttgaactaggtagtctttactccagatcccttgctcttagccactctccttttcatataatgtaagcttttcttcatttaataactgttctacaaaaaaattgggatttgtcaatcactgaaaaatacttaaaaactatgagtaatttaatttccctatcattaaacatttaggttctttcctatttcctatcacattctctttgtataaattgttatgtatacttctaatgatcactttagaaatatttcctaaaatacaataactcactcaaaattgtgaagtttcatattacatattgctaaattaccctcttagaatatgtacaagtttatgtatttgtactatcagtttatgagactgtatttccattaatcattgttaatcttaccaatctggtaggtgaaaaattgtatttttattggcatattgtagaatattaatcatttttaatcttaccaatctggtaggtgaaaaattgtatttttattggcatattgtagagtaatttaaacactgttcttgaatttattcagttttgtttctccttttataaactgcccaggttttctgttttgttttgtttttggctcagtagctgttcttaaatactgattgtaaccacaaagaggagtgtaaagaattggttgtcaagaaataattttggtaaggtcaaatttatgttttggctgtatcattttgacatataaaccattcattttctcatttctcaaactccgttaacataccagtactcaattattttatcactcatgctcttaacaacacagatcaagccaaaaattatatcctgaatcaaaggcattaagttaataaaatacaaacacatttcttcctaataagttagtttttccctttgtgagattttttcatggctgatgcatgatagtttatgttctaactatccttttcttatgtaatgttcactgttaaataatttacagatagaaacttattgaacttcagtaatgtagaattaatggtctattcatagatataagccctggaaaataatgtataatttggacttttaatacacttagctactattagcagtcattttaaaaaataccaaatataaactcttacacaattattttgcttggcaaactcatttttctatataggaattccaaaggagacattattctagcatgcaattaatatgaattatatttgattatctagatattgaaaccattttataaacttctctgacatgtagagctcaacttcctcttaagcattcaagagaacctatttttttttagttgcccataatatgcaaaccatttcagaacccagagatttttggtgagtgaattaacatgtagtttgtatttttacatggaaactatatgtataaatggttttcaaccagggtaaattttggttccccagggacatttgcaatgcctggtgacatttttggttgttacaattggagggtacctagtgatatcaggtgggtagagcccaggaatgctgctaaacatcctgtagtgcatgggacagtcccggcaataaagaattatctgacccaaaatgttaatgcagagattggaaaaaccctcatgacataatatcgagtacgcactaactgccaggttgtgctggaggctgcgggtacatgggtagaaagttatgatcttactggttaggaaagttacatttcattgtgaaacagaaagatctagattttttaaaggataatttaaatgataatgagattttaaaaatgatatgatattaacatataataatgtaatataattgttatgttaatataatcacattttgttataagaatatataattattgtgctgtggtaattttatgtgtgataaatatatgacatatttaggaacaaaaattctgcctgagggacttacttagttttgggaaactttcaaagaagtgacaagtgatactggcactgtttttgttgttgttgtttttattccttaccttttatttaatttacaaaaaaaaaacccacaaatagtaagttacaccataatggattttcaaaaactgaacatatctatataaccatccagatcaagaaaccagaatattatcagtgtcccagaaaatggcccttgttcccccttacagtcacagctcaatcctcaagtgtaactacaactttgacttttagcactacagattactttttttttttcaaagacaggagctccctctgtcacccagactggagttagaattacttttgtgttttaccgaactttgtataagtggaaccatataatatgtaatcttttgtgtctggattcttttgtttagtgtcatttttgtaaaattgattcatattatttcatgtagtgttgttcattctcataactatattgtataatacagctatatttattaacccattctactgtaaaggcacaatggctgaaaccgttaagttgacaaataggtcagtttggctgcagaatgggttttgagggagtggcaagagagagctgggaaaagtaggtaaggtcagatgatggaggatacctttgtcatattaaaggcatttggatttttttttctattaagaaatgagatttttcaaaagatattaaacaaggggaaaatataatgagacttgcattttagaaagaccattttgacagcagaatagaatgggttgagtgggagcaagcttagctgtagcaccaatcaggaggtcattggaatagttcagataaaagatgctgagaacctagaagtagacagtgtaggtggggatagaaagggacatatgattttctctggatagaattaattgcacttttggaataactgagaataagggttgcaaagactagttttctgagccaaccttcaaagcccgtgtgtattactaaaatgcaaaatgtgtgcaataaagaaaaataatagaatttaatgttagaatttaaagttgaattcaaaataattttcaaatgtatctttaatgtttgaacttacagaaaaacagatatcattagttgagaataaattaataaaaatctttatggataatctgaaggaaacttggcaacagtctagactaaaggttaatagtactggccacttgtttgttttcatttcaatttttaaagtatggctttctcttttgttgtttcaggatatcactcatggtacattttgccactattacggtagctttcagttgaggagggaaaaaaatgtgtgtgtgtgcgtgcgcgtgcgcgtgttcacctgtgcacacattcacgcgctaaatgcaggagttgagagaagaaaggaaagggggagttaaaatattgcatatggatgaataagaagaaaagtgtcttaagcagaatgaacttagttccctgttattatttctgggtggggaaattgctctctctttttattttgtttgtgcatgcatgcctaaggagaataaaggcactcagaaagttcccccatagtcaccgggtgatagcttcatttcaaagatgtatcgttttctatctgagacagtagtcaagctaattgtctctttgtgacctacagaatgccagcaattagcttttgataaaaagaacagtgcctatcaatgttttcaaagatgaagaattctgacataaaaaataaaattagtgaactctcatttgatggtaattacacctgttgtctattgactaaagcaaatatgtgatactttttaaaattatggtcaattctgtaagatttttagatgaatttgtatcttattataacatctatattcattaaaagctctaatacacataaatgagggtaatttattcattgtataatcagtgctttttgcattaattggtgaaaggcttctaattgctctgatatacctcagggtctgtcctccacaaatgaagaaccacaggcacttgatttttttgtttgtttctgttgcatttggggaacatctgtattaggtccaaattttagtgaattctaaattttatgctttcaattaatgattttattgtagatttttaaaaatcaagtaaagagtaatctttatactaatttattttgaaaatgtcagattttgaaaacaacagaccaatgtaacactgagtaaagcacatctgcatttttaatttttaggaagaaatatggattccttttcttgtcacatttattacttaaaaaaaataaagtatgcctgttaatcttcaacacagattcaaagatgagaatagtatgtattagtctgttgtcatgctgctaaagagagacatacctgagactgggtaacttataaaggaaagatgtttgacacacagttccacatggctggggagacctcacaatgatggctgaagacgaatgaggagtcatgtcgtacttggcagcaggcaagagagcttgtgcaggggaactcccatttataaaaccatcagatctcatgagacttattcaataccacaagaaccaatgggggaagcacccccatgattcaattatctccacctggccccgcccagggcacaaggggattattacaattcaaggtgagatttgggtaggggcacagccaaaccatatcatactataatggcaaaaatttaaagaatcaaggagctaccttgctttgtatttgcttctacttttcttcatcagttttatcaaaaacagattttggcactgtatttttacctccataatttgagtttttactgaaggatccttgagagtattaaaagcatggcaattagctagaagcaagagttctttttctattttgccgttagtttatctgccatattccttatcatatcattttatcaccaaatgaagtcctaaaatcaacaaatgagaaacttttaaaagtactttgacatcatcttgtattcaatcaagaaaatattgagactttactagttttaagtgagaaagaattaaaagtattagttgtggcaaagatttagtcccttaacccgaatatttgttaaaatcaaagaacaaaataacctatctaatcactgcaaatcattcttatctaaatgttgccatcacaggagtagccaggtatcattagtgtaatcttcagtctcaatacccttcagtcatgagtccaataactcaaacctcatttcaagttcacattccttttatcccaaataatggaaaaatgggaagaatagtaccctttcttttttgtctaagctattaactgcatatgcctgaatggaagatgacagcaactataatatgagacacctattttcccaatgagaagatccataaatggggggattatccatcttaaatgtacatacttttagcaatttagataaaatagtggaacacttaggttaactaatttaaaacacaaatataaatttaaagccacattgaaaatagtatattatttaggacaactgattctttttcatggcaattttttgaaaggtgttatgcaaagtctcaacatataccattaacatcaatgtctttattatcatttccagagtctaagtaatttaaaagttttccatgctatatcatcttttgtttaacagctctattgagatataattcacatatcatacaattcattcattgaaagtgtaaaatttaatggtttttggtatattacatttattttctaaattgtggcaaaatatgtatagcacaaaacttgctattttagcctttttttttttttttcttctgagacgtagtctcactctgtcacccagactggagtgcagtggcacgatctcagctcactgcaacttctgccccccggattcaagcgattctcctgcctcagcctcctgagtagctgggattacaggtgcgtgccaccaagcccagctaatttttgtattgtagtagagacagggtttcaccatgttagccaagctggcctccaactcctgaccttaggtgatctgcccaccgcagcctccctaagtgttgggattataggcatgagccaccgtgcctggccctaatttagccatttttaagtgtacagttcattggtattaattatattcacaatgttgtacaattatcactactacctgtttttaaaactttttcatcaccccagaaactctgtaacctttaagcaataactccccatttcttccttcccataatccctggtaacctttaatctactttctatctttataaattttcctattgtaaatatttcatgtaagtgcagccacacaataattctccttttgtgcatggcttttttcatttagcctaatgtcttctcagttcatgcatgttgtagtatatatcagaactttattgctttttatgcctgaataatattctattatatgtaataccacaattcatttatccgttcatcttttgatgaacacctgggttgttttcatcttttggctatggggatagtgctgttgtgaacattggcaaacaagtatatgttcaagttcttgctttcatttccattggttatgcacttaggaatggaaatgtgggatcatatggcaattctgtgtttcacatcttaagaaattaaactgtttaagagttttatggttttagttcttatactatagataaagaactatagttctttatactatagatctattttgagttcatttttgtatgtggtgtgaggtacgagttcattcttactgcttaattatgaatacatggaatttaaaatttttctatttaaagatattactggaaatgttattccaagcctgaagtagccatttgcctaacattaggacacttaccattttcttttatcctgtaaagatatcctaacattcacaatataaccacatacaatattgctttttattaattatttctgacaggtatcttttatatccaaacaacactagtattgatgaagagatcttttaggcttgtgggccttcatcaaacagtactttttgatttaaaaaaagtgaattcagtaaaatatgcgaggccttataacagttcaaatgtaaggcaactaactgttctttgctgatgagtaactttggtttaaaaaaataacttgccatatggaagttaagatgtgggaacatgggtttgattttgtgctattcatgtatattggaggtgatctcaactctgtgctaattcaaacaatttatatttccaggtaaaaataaactttagaatttgtagaaaattcatatgctagtgttgcatcctgaaattattatttgtctccaaattaaagtgaaaagtgattcaatagagaaacaccttgattccccatatctgtcagttgataaagtagctattgcagaattctacaacagagagaaggaagagtgagatagtaaatagaagagtagcgtttatgagttcaattaaaactttaaagaacagataattcctgtcttatttcctcattatttaaattgtatctaaacacaggatgaagaaaacatctgaactcaatctataaagataacaaaaccttcataccaaagtggaataaaaataacaaggagactatagacctaatcatatgtgaaaatatatgtagaaatattgaaataatatgcaaaaacttgatacagcatcaagttttttctaaatgtacacctcttcctaagcgaaactgattttaagaattcaagaacggtaaattttagacatcctttaatttcatttttatcattattaggtaaatcacaaaagattatatggtcatcttgatgtatgccaaaaagacataaaattcagtgtatttttttccttctaaggatacatagtaaactagaatgaaagaaaaattttaaacatggtaaaatgtgtttatcacaaaaaccaacaaatacaataaagctgaaacactggataaattcttactaaagacagaaaaaagaaaaagatagttacagtcaccattatttgttctagaaagtctaaccagcacagacagtttgggcagtcagtaatatgtgtcaaaaatttgaatgtaatgatataattacatagagagattatatgatggaaatatgagaaaagatatgaagaatgaaatgagaaggtccaaagtacattatatcagagccccaaaaggaaaaaatagaaagaataaaggcaatgatcaaagagataatgactataaagtttacagaactaatgaaaaaacacaaatccagaaatcctaacggtatagtgtatctcaagaaggataaataaaagaaatatgtttctgaacacatgggaatgaaatgtcagcactaaagtaagggaactattgaaagtaaccagggagaaacagcagatcacttacgtagaaatgacagcaggcttttcgacaacattggaataaaacagacaatagaacatgtaaagcattgaaggaaataacgagaattgtttattaagcaaaatatctttcaagaatagagataaagagggagtaaagcaagttggccaaataaaaggctccaccagtcataccccaaacaggaacaccaaacttaacaactctccacagaagaaaagcatctttatcaaaaccaaaaaacagatgagcagttatagtacctggttttaacttcatgttgctgaaggagacactgaaagggataggaaacacagtcttgaattaccaacaccacccctccccagtcataccccagcagcaactggctgcatggcatggagagagaatctgtgcatttgggagaggaacagcacagtgattgtgagacgtagcattggacacagtgctgccctgtcacagcagaaagcaacaccaggcttaactcaactgaatactgcccatagagggaccatttggaccagccctacacagaggggaaccactaatccctgcgattggaaagtgagttttggcaagccttgccaccacaggctaaagtcctttgcagcccaaaataaatttgaaaggcagtctgcgctccaagaactacaattcttgggcaagtcctagtgctgacctgggctcagatacagtgggacgtgggggcacatgacctactaagacaccagccaggacagctaaaggagtgcttgcaccatcccttccccatgcctcaggccacatagctcacagctccaaaagagaccccatgcttctgcttgaggagagggaacagtaaaggggactttgtcttgcatttggaaaccagctcagccacagtaggataggacaccaggcagagtcatgaggccccctttccaggccttagctcccggacaacatttctaaacacaccctgggccagaagggaacctgttgccttgaagggaaggactcagtcctggcaagatgcatcaacttttgactaaagagaccttggatcctccaaggtccagcagtgatacccatatagtatgccatgtgccttaggtgagcctctgagacatgctggcttcaggtgagacccagcacattcctagctttgatagctatcgtgagagactctttctgcttgagaaaagcagagaaaaagtaaaggggattttgtcttgcaccttaggggagtagagcaccaagtgggctcttggggacctgatttcaggccttggagcttggacagcatttctgaacctgccctgggccacaggggagtccactgccctgaagagtgagtcccatgcctggcagcattcaccacaaactgactgcagagcccttgggcctaaaggaaacatcagtgttagcctgacagtactccccttgggtctgttgtggtggtggccataaggtgaggctcctctgcctgtggaaaatagagggaagagtgggaaggactgtgtctcatgatttgagtgccaactcagcttcagtaaaatagaacaccaggtaaatgtctaaggttttttttaattccagtccctcgctcccagacagcatctctggacctaccctgggctgggataactcaacaccttaaagggaaggacacaagcctgtctgacttcacatctgttaatcgtacagccttagtgccttgattgaacatagacagcagccagatagtggttacagtaggccttgggtaagacccagtgctgtgctggcttcaggtctgacccagctgacccatactactggtgatggccactggtgtttgtatcaacccaccatccccagctccggaagcacagcacagagagagactccatttgtttgggagaaaataagagaagagaacaagagtctctgtgtggtaatacagataatttttctggactttaaccaagaccaccaaagtggtatctctgcaagtctgcaagaactatagcattactgggcttggggccgaagtcccttcaaatacctggaaagcctttctgagagagacaggtgccaacaagcccagattgcgaaagctaataaatacctaactcttcaatgccagaaacactgacaaacatctacaagtatcacgatcacccaggaaaacatcacctcacactacaaactaaataaggcactagggaataagcttgaagaaacagagatatgtgatcttttagatagagaattcaaaatagatattttgaggaaactcaaattcaagataacacagagaaggaattcagaattctgtcagataaacttagcaaagagattgaaataataatttaaaagaaacaaacagaaattctagacatggaaaatgcaattgacacacccaagaatgcatcagtctcttaatagcagaatcgatcaatcagaagaaagaattagtgagcttgaagaaagactaattgaaaatacacagttagaggagacaagaaaataaaaaaggatgaggtatgcctacaaaatgtagaaaataggctcaaaagggtaaatctaagagttattggccttaaagaggaggtaaagaaagagataggagtagaaactttattcaaagggataatatgagagaacttccaaacctcgagaaaaatatcaacattgtgcaagaaggttatagataacactaagcagatttaactcaaagactacctcaaggcatgtgaataattaaactcccaaaattcaaggataaagaaagaatcctaaaagcaccaagagaaaagaaacaaatgacatacaacggagctctactacatctggcagcagaggtttcagtggaaaacttacaggacaaaagaaagtggcatgacatatttaaagtgctgaaggaaaaaagttttgctctagaacagtatatctggtgaaaatatccttcaggcatgaaggagaataaagactctcagacaaacaaaagctaagagatttcatcaacaccaagatttcatcaacaccaaacctatcctacaagaaatactaaagggagttcttcagtcttaaagaaaaggatgctaatgagcaataaaaaatatcatctgacagtgcaaaactcactggtagtagtaagcacccagaaaaacagaatattttaagactgtgattgtggtgtgtaaactactcttatctcaagcagaaagactaaataataaacgaatcaacgataataaccgcaacaacttttcaagacgtaataagacataaagagacacaacaaaaagttaaaaagcggggacacaattaaagtgtagcatttttatgagttttctttttgcttatttgtttctatatgcaatcaatgttgtcatcagtttaaaataatgtgttatagtatttgcaagcctcatggtaacttccaatcaaaaaaacctacaatagctacaaaaaaatatataaagcaagaaattaaaacataccaccagagaaaatcacttccacaaaaaggaatacgggaaggaagaaaagaaggaagagaagaccacaaaacaaccagaaaacaagtaacaaaatggcaggtgtaagccctttacttaataataacattgaattataaatggaccaaactctcaaatcaaaagacagagtggctgaatgaatgaaaaaacaagactcaatgttctgttacctgtgagaaacacagttcacctgtaaagacaaatataaactgaaaataaaaagatggaaaaagatattccatgccagtggaaaccaaaaaagagcaggagtagctaaggcaaaatagttttctaaacaaaaactgtaagaagagacaaagtcattatataatgataaaagggtgaattcagcaatgaacccaatgctggagcatacagatatataaagaaaatattattagagctaaagagagagatagattccaatacaataataactggagacttcaacaccctactttcagcattaggcagatcatgcagacagaaaatcaacaaggaaacatcagacttaatcagcactatagaacaaatggacctaatagatgtttacagaatattttatccaatggtggcagaatacacattattctcctcagaacagagataattctaaaggatagaccatatgttgggtcacaaaacaagcctcaaaacattcaaaaaaattgaaatgatagcaagcatcttttctgaccacaatggaatacaactggaaatcaataacgaggaatgttggaaactatacaaacacgtggaaattaaacaagatgctcctgaatgatcaatgggtcaatgaaggaattaaggaaactgaaaattttcttgaaacaaatgaccaaatatgccaaacataccaaaacatatgggacacagcaaaagcagtactgagggaattttatagctataagtgcctacatcaaaaaaaggaaaaaattcaaataaataacctaatgatgcatctcagagaactagaaaagcaagagcaaacaaaacccaaaagtagtagaggaaaagaaagaataacgatcagaacagagataaatgaatttgaaatgaaggaaatacaaaaagatcaacaaactggaaagcttgttttttggaaagttaagcaagattgacaaacctttaaccagaataactaagaaaaaaggagagaagatacaaataaacaaaatcaaaaatggaaaaggagtcattacaattgatactgcataaagtcaaataatcattagtggctactatgagcaactatataccaaaaagttagaaaacccagaagaaatggacaagtttctagacagatacaacctatcaaggcttaaccacaaagaaatccaaaacctgaacagagcaataacaaatatcaagattgaagctgtaaaaaaaagtatcccagtgaagaaaagcctgagatccaattccctgctgaattctacagaacatttaaggaagaactaataccaatcttactcaaagtattccgaaatacaaggaggagggaatacttccaaactcattctatgagaccagtgttaccctgataccaaaatcaggccaagacatgtaagaaagaaaagaaaagaaaattacaggccaatatctctgatgaatattgatacaaaaatcctcaacaaaatactagcaacccaaattcaacagtacattaagatcattctcataaccaaaagggattcttggcaagcgtacaaggatggttcaacctacatcatacatcctatcaacagaatgaaggacaaaaactatatgatcattttacttgatgctgaaaaatcatttgctaaaattcaaacttgctgcatgataaaaatcctcaaaaaaactgggtgtagaaggaacatccttcaacataataagagctatatgcagcagacccacatctggtatcatagtgaaatgggaaaaactgaaagcatttcctctaagatctgcaacatgacaaagatgcctactgtcagcactattattcagcgtactactggaagtcccagctacagcagtcagagaagagaaagatataaagggcatccacattggaaaggaagaagtcaaattattcttgttttcagatgatatgatattatatctagaaaaaaactaaagactccaccaaacaactattagaactgagaagcaaattcagtaaagtggcaggttacaaaatcaacatacaaaaatcagtagcatttctatatgccaacagtgaacaatctgaaaaagaaaaaaaaaaaagtcccatttacaatagccacagagaaaattaaatacctaggaattaacttaaagaagtaaaagatctctataatgaaaactgtaaaactgatgaaagaaattgcagaggacaccaaaaactggaaagttattccatgttcatgggttggaaaaattaatattgttaaaatgttcatactacccaaagcaatctacagattcaatgcaatccctatcaaaacaccaatgacattcttcacagaaagagaaaaaaaatcataaaatttatcaggaaccgcaaaagacccagaataaccaaagctatcctaagcaaaaagaacaaaactggaggaatcatattacctgacttcaaagtatattatagagctatagtagctaatacagcatggtactggcataaaaacagacacatagaccaatggaacagaatagagaatctaaaaataaatttatacacctacagtgaactcatttttgacaaagatgtcaagaacatgcactcaggaaaagacagtctcttcaacaaatggtgctgggaaaactgaatatttatatgcagaagaatgaaactagacccctatctcttgccatacaaaaatcaaatcacagtagattaaaaacttaaatctaagacctcaaaactgtgaaaccattacatgaaaacattgaggaaactctcctggatattggtctgtgcaaaaatttcttgagtaatatctcataagcacaagcaaccaaagcaaaaatggacaaatgggattacaaatttaaaagcttctgcagagcaaaggaacaatcaacaaaatgaagagagaacccacagaataggagaaaatatttgcaaactacccacctgacgagggattaataaccagaatatgtaagaagctcaaacaactctataggaaaaagatctaataatccaattaaaaatgggcaaaagatctgaatagacatttctcaaaagaagatgtacaaatggcaaacaggactatgaaaagatactcagcatcattgattatcagagaactacaaatcaaaaccacaatgagatatcatttcaccccaattaaatggcttttatccgaaagacagggcataacaaatactggtgaggactagagaaaagggaacccttgtacaccattggtaggaatgttaagttagtacaaccaccatggagaacagtttggaggtttcttggaaaactaaaaatggagctaccatatgatccagcattcccactgctggttatgtacccaaaagaatggaaatcaaggccaggtgcggtggctcatgcctgtaatcccagcactttgggaggccaagacaggcagatcacctgaggtcaggagttcaagaccattctggccaacatggtaaaaccctgtttctactaaaaatataaaaattaaccgggcatggtggcacatgcttggaatcccagttactcgggaggctgagacaggagaatcactgaaacccagcgggtggagattgcagtgagccgagactgtgccactgcactcaagtctgggcaacagagcgagactctgtctcaaaaaaaaaaagtggaactcagtatttccaaggaatatctgcactcccatgtttctggcagcactgttcacaatagccaaggtgtggaatcaacctaagtgtccatcagcagatgaatggataaagaaaatgtacatctacacaatggaattctatttggccatataaagaataagaacctgttatttccaacaacatggatgaaactggaggtcattatgtttgtgaagccaggcacagaaagacaaacttcacatgttctcactcatttgtgtgagctaaaaatgaaaacaactgaacgcatggagatatatagtagaaggatgattaccagctgaggatggtagtggggaagtaaggggactaagtataaaaagtagttagaaaaaaatgagtaaaacctggtattggatagcacaacaggatgactgtagtcaataataatttaattatatatttttaaataaaaaatataattggattgactaacacaaaggataaatgcttgaggggatggatattccatataccatgatgtgattattatgcattgcatgcctttatcagagtgtctcatgtacttcccaaatttatgcagtacctactgcatacccaggaaaattaaaaatttttcaaattttttaaactaaattattcaaagaagattacaaaaagtctgatagtctctgggcaatttgtgttaatacaaaaaaaattaaaaccaggaaagaaaaccctgagagatcaggagataacatactcttcatagagatatgaagcatttctttgttttctgtgctttcttagaagcaaacctgattaggtacagaagaagcctatatatgtccttattacagtgttgagtaaaatgtcagtttccatctatcgcatttattgttcctgatttgaataccctcttctcttggatacttaatttttattctgtgaaaagaaatggaagagaggatctgagtttaggttattcataatcatctcaatataaaatagtattgcctgcttacaaaatctttcaagtttattttggaagcctaaatttttaaataatttttgttgattaattcttaagtttggcttggctcttttattacctgagacactcttaagtgtataactttgaaagcataacattgaacatcaaggtagcatcaaaggaggaaatgtataaatgtgcagtctcagtagtgtttttacgtatgtgtgtgttagtgggggtagtcatttctacccattctgaccaggtaattaagtgtggttggtgccagtagatacaaccagtttcttctaccccactcccaccagctgccctaataaagtcacttttcagttgcctgttgtccaaacctgaaaaacaatcccaatcctagggtgtatagtattattaactatagtcaccatattatgcattagatttcctgaacttttttcctccatatctacatatcaacttctgaagaacaggaatgagtaactcttttttttaacgtaggttgaaagacatacctagccaatattctaccattaacgaatacatacatattccatatataaaaatgttaacaatccataggaatatcaatattctttcatcttttcctggaatgagatacaaagtagtactgtttatataagtggaatatgaagatacgtattctcatgaaaatctcttataaaaagtgatttgttcacctgagtgcccaagttttatggttagataatttaattatcagattaatgtttagataaaagttattgaaaaataatatgtaaagagaaaagttgtgatgctaacgagtgttcactgctatgtacttgagttggttcttgaacaggggttgggatctaaatgttagcaaatacagtgagatttttcatagttaaagtgaaaaaaacttgaaaatctttcaaatacatattaatctcagtaagccaaacaaccagtttttaccccagcattgaaataaattctttggttgaattaggtaaattggttggcatgctttataaagaggaataattacctttaaacattagaaccttagctggcacagcaattcattaaccattggaactgaggtaaactgtgaaaactaccaactcagacaccatttcatgctcactgcaaagtatatgttcattgaatggaatggaaaacaaaatgcctgcagtatgtaaatttgtactcttttcttcctgtgtccttcctaccatggtactgtctcctttgacctttcatcacaaccagatcttatttaaatattgtacaatttgaactgaaaaaaaaaatggagcatcttctcttcacatgaaacgttatctgcttcttccaggaattgaagaagatgtaaatatttaagaatattaaaaccccaagaaaagatgttcattagcaataagataatatctctcaagtaaaagtgagatgccttttacaattaccttgatttccagattgcatcttctctgtgtagcagtagtctttgaccatttggttgtattattataagttgatgtggttatgattgtttgaaagttgtttgtaactaaaataaaaataaaatctgtaaatgaatggttttaattaattagactaaattcgagactgcttttacaataatgtgactcttacttccgttctgctctgtttcttgaatgagaaaaaaatagatttataacaagtactccttgaacatccttgggagtttgtcgtggatgtaacttttatccactacatgatgtcccaagaaaaatattttaaggatacctactctgtaccatagaatacttataggagcagcctcagaattgttagtttattataaccctttttaaaaatgtaaaatgaaattaatgtgtttgtcctttaataagcagaagtcaggaaaatgtaactggctggcattaaactgcctatttttacctaatttatctcctcactaaatctatattctgttctgatgaaggattctcacatttatgtcagtctacaaagttgaacataaagtgattataaagataagaccaaatggtacatattgtcattaatctacatcattccttccatcagcagtatgtttttcaaagtatggtcttctgaccagcatcagaagcgtcacctggaaacttgatagaaatgtaaattttcacctggaaacttgttagaaatgtaaattttgaggcacctagacattctgaatcagaatctctggaagtggggcccagcaatctgtattttaacaaggcttctagaagattctgatgcacactaaagtttgagaaacactgctctaactacatctcactttgataacttaacaaagttattattaatagtagtcattagctggtatttcaaagatagtctttgttatttatttaagattatttaatcagcagagggcactgcagtaattgttaaggaggaaattttattaaatctacctaatcaggttacaagcacatgagtactaatatataaatttgtctgctctgttaataaaatcatgtctataaaaataagtgaaagcactatactaagtgatttttcacagagtcactatgcatgtaaagtatttctgcacatttagatatatctattatatgttctttacgggtttttttaagacagagtctcactctgttgcccagactggagttcaatggcacgatttcggctcactgcagcctctgcaacccgggttcaagcgattctcctacctcaggctcttgagtagctggaactacaggggcatgccaccacgccgggctaatttttgtatttttagtagagacagggtttcaccatgttggccaggctggtctcaaactcctgacctcaagtgatccgcccaccttggcttcccaaggtgctggaattacaggcatgagccaccatgcccaaccatatgttctgtacatttttaaacatcattgtctgttagcaatatcttttttaaggtcatttttcctatgaagttaaaatatgaacaatttcatcaacaagatacctgaattactgaatcattgtttttgacactgtttttacagcttagcagtctttgaagcgtctttctgactttaatgttgtcctcaaagtatcaagaaaaaaaaaggaaaagatcacaattatgtgatttttcacagaagtttgcaactttcatattggaaaaatatttagacgtcaaagataaatattttatttaaaaagaatagctaagtccaattaaacctttatattttagaccgactagttcagaaatactgatacctgaagtaagactataaatttctaccatctttcaaggaataaaagaatctggtaatcaaattaataatgtataagagggaaacagaactttaagctagttaaggaaaaaatggtttcaagcttttaatggcatctttttgccattgataatgaacagtctgttaataatgaatacttgtgttatctattcattaacagatacagataacctttatttgtctgtattgtactagcatatgtgattgaaagtgataaagctacattcttcaaaccattcttctgttcagattttctaataaacaggtatctttctcttgttatatttgtaattaagttttattctcttattctttgttttctagttgcatctccccatttatagtttacaggtctttgtactcagctcttgctctcttgtccatcttccagtccccatctcattcgctgcctgctccctagtttagatccctaatttcagtattctacttcctacgtggcatttgccagtgctcttgcatctgggttcttgctctccattctctttttcctagtctttggttctctactactctttgcaggtagtttctggatttttgtattatttctgttctctaactgatatgtgcagaactgcaaggatgtaagaagaattggaaagtagaagcatagaaagagctaacatgtattgaatacctattctatgctaagtgatttatcatttagttctcagagccctcttataagatgtaggtatgttttattattacctccattatattcataagtactctggaaacttaggttaaatattttattctaattcacatagcaaaactacatagtaaagccaagtttcacatctagattggtttatttattccttcacttctttattcaacaaatatttgttgagcacatactatatgttgggctccgaactagatgctgaaatagatccagctcctattgttattgcccttaactgtgtaatgtcattttctgacttcatagatgatgatcttttactacaccaaacagcttaagaggaagagaaaataaaaggaaaatagaagggttctaatgttttatgtaaaatgtttgatacaaacgtgagaaagactgtgtttgtgcttgatttaagaataccctattgaaaagaacagtttgtatctagcatagagagtctgacatccacctaccccaaccaactcaccaccatcagcatcaatgcctttcagtggcatcaccatgatatattttttcttttatgttctaaaacatataaggtttgtgtctctatgcccaaattcttcagaagatcttcagaaagaattaactgtcctgcctgaattatgtttagagaaagatgaagaactttgtaaagaatacagtcagccctgcagaacccctaactactgtattttcgatcctcagttgattgaatccacagatgttgaaccagcaatatggagagcaactgtacctacactgtgatccatccatctatatatttttataccctgaaaaatattttagatggcttacccaaatacataaatacaacagaatttttaaaaatataaatgtgaagagtaggacagagaaaaatcagatgaaactaaagttgtgttcagtaagcctactgaaaggtattcacaaatttgttctcaaggataacttgattcacaagcattgtaatttaaaaacaaactggtaacatagaaaagtatccattcctagttatgatacttgaaaggaaatttctcctgtaggtcctcctaaagaccacagtgtaatacggtgaacaattcagatgcttcctaatgtaaataagagtttgagccattttattgattctgatttcataccacagaagcaaagcccaataaaccaattctataaaaagtgaaatgaggcattcaaagtagatcactctccagtggtctggcaaaatccagtggtatgttttagaggatttagaaaaattaatgaaccacatctcttttaggcaattctcacgtatcatttgtcaattgagtttttcatgtgctgggtgacagtgagcttacacgctctctgaggtttgttctactcactactgtaacatcaatacctcagatactacctagtacatagtagatgcttaataaatattcgttatttaaatggataaatgttgtgctttgaagtatcaattttaagtgaaatactccctttcagctatctgttgatatttcccttcatgtccctgaataaagtgtgctactatactttgggatatatcatctttatgtgaagccccgaattcatgaaatgtcaaccattgcttatataactttttcaagcaagtaatgaaataaatattaacactatccaagaagttcctttaatattgttaacagtgacatccccttgcttgatgtttagggctctgattttaacatccttgagaaggtgttaacctccataaagcaatttataacatagaagtagtgtttcgtcttggtaagtctcaaaatcataacagatagattggctttggaaaataagtaataaagattggataatgacatggatgaagctggaagccatcattctcagcaaactaacacaggaacagaaaatcaaacactgcatgttctcactcataactgggagttgaacaatgagaacacatggacacagggaggaaaacaacacacactggggcctgtcggcggggtgagggggaaggggagggagggtattgggacaaatacctaatacatgcagagcttaaaacctagatgacgggttgacaggtgcagcaaaccaccattgcacatatacctatgtaacaaacctgcacattctgcacatgtataccggagcttaaagtaaaatttaaaaaaaaatttaaatacgtaaaaaaagatgggataatgccagcaaagtccttacgtttttgttagtttttctttaaaatgtctcccattgttaaatatcctgttatgctaggattcactgtaccagtaaattgcatcaattctgctaatcctgtattctgtataattggaagggattaactaatttatatgcgttctaaactttatttataacatcaattagcatctaatacatacctgatgcattttaactgcttttgcccagagctacaatcttattgaagagtagcattctactttcaaagaaatattgaaatataaacctttctctctataccttcataatttactttttgtttgcctttctacttatttactgtaatacttcattttgcaaactttatttttgtattgcttccaactattataacttgcttaatttttggaaacagaggactggaaatggattaagtcatgtatttcaccctcaagttttagcctaaaatgtatcttgaccattatacagtaaaatatatacctattttgattgacccttcaaaaatgaaattttcttgtctttaggaaaatttaggagactttaggaaaatgaaattttcctttcattagtgtattccagatttaactgtacttatcttaagaatgccgtatcctccaggcatggtggcttatgcctgtaatcccagtactttgggaggatgaggtgggcagatcaccctgaggtcaggagttcgagaccagcttggccaacatggtgaaaccccatctctactaaaagtacaaaattagccaggcatggtggtgcgcacctgtaatcacagctactcggaaggctgaggtaggagaaacacttgaacccgggagacggagtttgcagtaagccgagatcgtgccactgcactccaggcaaaaagagcaaaactttgtcccaaaaaaaaaaaaaaaagggtgccctatcctaaaactcctagtatataggtaaaccccttcacatcattaattttttatttaaaaaagacggttgggcaagatggccaaataggaacagctccagtctgcaacgcccagcaagatcaacgcagtaggcaggtgattgctgcattttcaactaggtacacggctcatatcgttgggactggttagacagtgggtgcagcccatggagggtgagctgaagcagggtgaggcattgcctcacacaggaagcactagggatcagggaagtccctccccttgccaagggaagccatgaggaactgtgcattccggcccagatactatgcttttcccacagtctttgcaaaccgcagaccaggagattccctcgggtgcccacaccaccaggaccctgggtttgaagcacaaaactgggaggccatttgggcagacaccaagctagctgcaagagttttttttcataacccagtggcgcctggaatgccagtgagacaaactgttaactcccctggaaagggggctgaagccagggagcaaattggtctaactcagcagatcccacccacacagaacccagcaagctaagatccactggtgtgaaattctcattgccagcacagcagtctgaagtcgacctggggcactccagcttggtgtggggagggggcgtccaccattactgacgcttgagtgggcagttttcccctcacagcataaacaaagcagctggaagttcggactggacagagcccaccacagtgtggcaaagctgctgtagccagactgcctctctagattccttctctctgggcaggacatctctgaaagacaggagccccaggcaggggcttatagataaaactcccatctccctgggacagagcacctgtgggaaggggcggatgtgggcgcatacttaaacttagttccttcctgccagctcctaagagagcagcagatctcccagcacagggctcaagctctgctaagggacagactgcatcctcaagtgggtccctgacccccatgcctcctgactaggaaacacctcccagcaggggttgacagacatgtcatacaggagagctctggctggcatcaggtgaatgccgctctgggacgaagcttccagaggaaggaattggcagcaatctttgctgttctgcagcctttgctagtgatacccaggaaaacagggtctagagtggacatccagcaaactccagcagacctgcagcagagaggcctgactgttagaaggaaaactaatgaacagagaggaatagcatcaacatcaacaaaaaggatttccacacagaaaccccatccaaaggtcaccaacatcaaagagcaaaggtagataaatccacaaagatgaccaaaaaacagcacaagaaggctgaaaattccaaaaaccagaacacatcttctcttccaaaggatcacaactcctcgccagcaaggtatcaaaactggagggagaatgagtttgacaaattgacagaagtaggcttcagaaggtgggtaataaaaaactcctccgagctaaaggagcatgttctaacccaatgaaaggaagctaagaaccttgaaaaaaggttagaggaattggtaactagaataaccagtttagagaagaacataaatgacctgatgtagctgagaaacacaacacgaaaacttcatgaagcatacacaagtatcaatagccgaatcaatcaagccaaagaaagaatttcagagattgaagatcaaattaatgaaataaagcatgaagacaagattaaagaaaaaagaatgaaaaggaatgaacagagcctccaagaaatatgggactgtgtgaaaagaccaaacctacttctgattgctgtacttgaaagtgacagggagaacagaaccaagttggaaaacactcttcagggtattatccaagagaacttccccaacgtagcaagacaggccagcattcaaattcaggaaatacaaagaacaccacaaagatactctttgaggagagcaaccccaagacacataatcatcagattcaccaacgttggaatgaaggaataaatggtaagggcagccagagagaaaggtcaggttacccacaaggaagcccatcaagctaatggcagatctctcggcagaaacccaacaagccagaagagagtgggtggccaatattcaacattcttaaagaaaagaattttcaactcagaatttcatatctggccaaactaagcttcataaacaaaggagaagtaaaatcctttacagacaagcaaatgctgagacaatttgtcatcaccaggcctgccttacaagagctcctgaaggaagcactgaatattggaaggaacaactggtaccagctactgcaaaaacatagctaattgtaaagaccatcgacactgtgaagaaactgcatcaactaaggggcaaaataaccagctagcatcatgatgacaggatcaaattcacacataacaatgttaaccttaaatgtaaatgggctaaatgcccccaattaaaagacagactggcaaattggataaagaatcaagacccattgatgtgctgtattcaggagactgatctcacgtgcaaagacacacataggctcaaaataaagggatggaggaatatttagcaagcaaatggaaagcaaaaaaaagcaggggttgcaatcctagtctctgataaaacagactttaaaccaacaaagatcaaaaaagacaaagaagggcattacataatggtaaagggatcaacgcaacaagaagagctaacctaaatatatatgcacccaatacaggagcacccagattcataaatcaagttcttagagacctgcaaagagacttagactcccacacaataatagtgggagactttaacaccccactgtcaatgttagacagatcaacgagacagaaaattaacaaggatatttaggacttacactcagctctggaccaagcagacctaatagacatctacagaactctccaccccaaatcaacagaatgtacattcttctgagcaccacatcacacgtattctaaaattgagaacataattggaagtaaaacattcctcagcaaatgcaaaagaactgaaatcataacagtctctcagaccacagtgcaatcaaattagaactcaggattaagaaaatcacccaaaaccgcacaattatatggaaactgaaaaacctgctcctgaataactactgggtaaataacaaaattaaggcagaaataaataagttctttgaaaccaatgagaacaaagacacaataaaccagaatctctgggacacagctaaagcactctttacagggaaattcatagcactaaatgcccacaggggaaaatgggaaagatctaaaatcaacaccctaatatcacaattaaaagaactagagaagcaagagcaaacaaattcaaaagctagcagaagacgagaaataactaaaatcagagtaaaactgaaggagatagagacacaaaaaaccttcaaaaaatcagtgaatccaagagctggttttttgaaaagattaacaaaagagatagaacactagccagactaatgaagaaaagagtgaagaattaaatagatacaatacaaaatgataaatgggatatcacactgatcccaccaaaatacaaactaccatcagtgaatactataaatacctctatgcaaataaactagaaaatctagaagaaattgttaaattcctggacacatacacccccccaagactaaaccaggaagaagtcaaatccctgactagaccaataacaagttctgaagttgaggcagtaattaatagcataccaaccaaaaaaagcccagaaccagacagattcacagctgaattctaccagaagtacaaacaggagctggtaccatttgttctgaaactattccaaacaacagaaaaagagggaatcctccttaacttactctacgaggccagcatcatcctgataccgaaacctgagagagacacaacaaaaaaaatttcaggccaatatccccgaggaacatggatgcataaatcctcaataaaatactaaaccaaatccagcagcacatcaaaaagcttatacaccacaatcaagtcagcttcatccctgggatgcaaggctggttcacatatgcaaatcagtaaacataatcctcacataaactgaaccaatgacaaaaaacacatcattatctcaacagatacagaaaagtcctccgataaaattcagcggcacttcatgctaaaaactctcaataaactaggtattgatggaacgtatctcaaaataataagagctatttatgacaagcccacagccaatatcatactgattgggcaaaagctggaagcattctctttgaaaactggcactagacaaggatgccctctctcaccattcctattcaacatagtattggaagttctggccagagcaatcaggcaagagaaagaaataaagggtattcaaataagaagagaggaagtcaaattgtctgtttgcagatgacatgattgtatattttgaaaaccccattgtctcagcccaaaatctccttaagctggtaagaaacttcagcaaagtctcaggatacaaaatcaatgcacaaaaatcacaagaattcttatacaacaataatagaccaacagagagccaaatcatgagtgaactcccattcacaattgctacaaagagaataaaatgcctagaatatgactaacaagggatgtgaaggacctcttcaaggagaactacaaaccactgctcaaggaaataagagaggacacaaatggaaaaacattccatgctcatggataggaagaatcaatattgtgaaaatggccatactgcccaaaggaatttatagattcaatgctatccccatcaagctaccactgactttcttcacagaatcagaaaaaaactactttaatatggaaccaaaaagagcccttgtagccaagacaatcctaagcaaaaagaacaaagctggaggcatcacactacctgacttcaaactatactacaaggctgcagtaaccaaaacagcatggtactagtaccaaaacagatatatagaccaatggaacagaacagaggcctcagaaataacaccacacatctacaaccattttttctttgataaacctgataaaaacaagcaatggggaaagaattttctatttaataaatggtattgggaaaactggctagccatatgcagaaaactgaaactggatcccttccttacaccttatacaaaaattaactcaagatgaattaaagacttacatgtaagacctaaaactataaaaaccctagaagaaaacaggcaataccattcaaacatgggcaaagacttcatgactaaaacacaaaaagcaattgcaacaaaagccaaaattgacaaacgggatctaattaaactaaagagcttctgcacagcaaaagaaatgattatcagagtgaacagacaacctacagaatgggagaaaatttttgcaatgtctctgtctgacaaagggctaatatacagaatctataaagaacttaaacaaatttacaagaaaaaaacaacgccatcaaaaagtgggcaaaggatatgaacagacacttctcaaaacgaagacagttatgcagccaacaaacatatgtaaaaaagctaagggtcactggtcattagaaaaatgcaagtcaaaaaccacaatgagataccatctcatgccaattagaatggtgatcattaaaatgtcaggaaaccatagatgctggatagggatgtggaaaaataggaatgcttttatactgttggtgggagtgtaaattaattcaaccattgtggaagacagtgtggcgattcctcaaggatctagacccagaaataccatttgacccattactgggtatatacccaaaatattatatatcgtcctattctaaagacacatgcacacatatgtttattgcagcaatattcacaatagcgaagacttggaaccaacccaaatgtccatcagttatagactagataaagaaaatttggcacatatacaccatggaatgctatgcagccataaaaaaggatgagtttatgtcctttgcagggacatggatgaagctggaaaccatgattctcagcaaactaacacaggaacagaaaaccaaacactacatgttctcactcataagtgggatttgaacaatgagaacacatggacacacagagggaaacatcacacaccagggcctgtcaggggatggagggttaggggagagatggcattaggagaaatacctaatatagacgggttgatgggtgcagcaaaccaccatgccatgtgtacgcctatgtaacaaacctgcacgttctgcacatgtaccccagaactgaaagtatattaaaaaaaaaaaaagtggagaaatctgaaaaaaaaaagacagttaatttacactaaagattaggaagatggtaaatgtagaatttttcctctagccagtacatggggaaacctgacatgatgacttcttgagatccttttaattctattataaaagcatagagctaggagagatatggattatctcaggttttcagagactaattatttcaagagtaatagacaaaggaaaatacccagattacttacctggtgagaaatctactaagttgttatagcaatctgaggccacatttttagaatttaagttattagtgagatgagatttctatcaaatacttctgagctataagcaatatgaaaggactgctaatataaaaattttctttattttcttggtcctcagcttttattcagtggtccttgtgaattgagtctggatgcctcaaaaagataaatgtttcagaaactaaaagtatggttattgaaagcctggtttataatcatttttaagtgggttttactagtctgacttcattcttttttggcttatttcactcagtctgctatttaatctttaattacaggccacaaaagaagtaatagaacgggaagcaccagggatggccctggcaatgctgatgggatcacttaatgttacacctctgggcatgctctctaggtaagaaagtcaccaacatgttgcaaaccatttgctaggtgaactgtttccgtgatattaaaaaaaatctacactttggcattgttgtgaatattaaatgagctagtccacataaagttcttagcttatactaatcacttaataaatattacctactatcattgttaaaaaaaaaagttaattccataccactaatcaatacactatattgatgaacctaagaaactttagtcttaacacttaagtttgccccttttttttccagagttaagagctttagtattctgtcagccacaattttcccacttcacttctttttgttgttgttgttgttgttgttgttgttgcttgttaagttaaactttcagagactgtcatattactactggtaaaagttatcaattcctaacccagagaatccagtttattactatgtaaagttactgttttctgtgactgtttataatcatcagttgatatctattaattgtaggtaaatactgatttaataaaactaaactgccaagtttattaaaataacttgttctcacaagttaggagcttatattccaatttataaatagctatgttgatgtgttgttgtgaaaaaaaagaagctcaattcatattgttaatcttttaatgcttggcaactgggtatattttaattattatattacattaatgatatactattattatatgaaattagtctacctaaaactatgcctttgttgacatagatgttgatatccatcctcgatttaatggtacttatttgctactattttagcaactcttagatttagatcccctaaatgaggacaattacatcacttaagttaaagatagaagtgtcaacttagtcagaaactgttgaaggatttaatgaacgttaattaatagttgatctcagagcaacctaaaaataaatagcagctgtatagtttcagggtttcataatttatagccctttatgtatcctgtgtgtaatatgaatataaaattaaatgtgtccattgactattatggaatatgagttgtaatgttctttctgttacatagacaaagtttatatcccatcagtggcagccacttgaagcacagatacaggagattatgaatgggtcattagttactatgttctttttgctgtcacgtgtactgtaacatttaattttagtaaaagcaaataaagaattaaagtaccacgatagagactaaagctaaaattcatgctggcctttaaggaactccagttgattctttcatagtgttctttttttaaaccattacttatattacctacaccaatgaggtcaggggatcccgtttttcctatggaattaagtagtagttttcaaacataaaagaactctttcttgtatacaagcaataacatcaggaaagaattaaacttcattctcttgctaattcttttgtaataaaattttaattcggtaaacataataatatgcttatttgccaagtcccatattaagcattagggatcctaaggttagaaagaaaaataagaaatggtcctctccttaaggatcccacagtttaaatggagaaattatttcttgcaactgttaagataattcttcaaattgaatgtagctttcttgatccagtatagaaatatcactttttgttatatcaaaaggttttcctgaattaatttttttctcccttttgtatcctcataattacctagcactggactgctgagtgaatggaaaattaattagcaggagctgattctaattactttggaatgagttgttcatctttatcctgaaggctttgaaaattaatacatataagcagcatgggagcaccttctggcttttctgtctgtgcattgctgatttaaccaagaatatatttataaactttggaacagacatagtagtttacattagttacagaaaaggggatatttccctgaatgttcattttttgtgcttctcaaagcctttttaaaaattattatttttataatagccatcattagattggttcttcctttctacagcctttctattttgtatgcacttctggctttgtacatgcttctgctatggaacatgtcatagtatattgtaattaattatttgcttgtctgtattacctagttagtagaaacttcttaaagacaggagctttatcttattcttttttacatcctcagcccctaaaacaaattctgacacatagtaagtactcaaaaaatgtatattgttgcagttactatggataaatcagtgttttaccatagttctatagcatgtttttttcaggtaaattaatgcatcaagttggtgccttaccttcctatttttatgtctagagagcagcattagataaaaacaaatgtttaaaccattacgtctgtttgaaatggtttcctactatttggacaacttaatatcctccagattttttatataagtaagttgggagatattatgaagtaatggttaagaacatcatctctgaagacagattgcttgtgttctatgttaatgtcttttttgttttcattttctcatctatataataaagatgttaatagtaccaaatttcttggataaagtgaattaatctatgtaaagcacttagaaaactgactcgtagtaactcttaagtgatgaccatggttgtttcgttagagtttttgtttttagagtaggtctgctggtgaaaccttttcgtagcttttcttcattaggaaatgtctttatttccatattactcctgaaggatattttcactagatacagaaatctgggttgactgttcttttctttcagcattaaaaaaaaaaaagtaaaataaaatatgattccactctcttttgctccatggttcctgaaaagaaatgagcaatcaattcaaattgctgtttccttatgtgtaatggcaaatttctctggctgctttgaagatattttttctgcagctttagtttcagcaatttgattatgatgtatctgggtgtagttttcttttagattatccttctgggttcagtgaactttatgattctgtaaatttatgtctttaaccaaatttgggaaatttccttttttttgctgctcctatgacatgaattttagattttttggtaatgtctcacaaatccctgaggctctgttaatttttaaaatcttttttactctgtattaattttaggttatttctatgatctatcttcaaattagctgacttttcccctctttcatcttcattctgcctttgagaatatctagtggtttttatttcagatatattttcagttctaaattctccatttggtttttttgttaatggtttccatttctctactaagaacttgtatttttacatttatttcaaaagtattgccctttatgtcatggagaatagttataataactgcttaaaattattcttcggacaatttcaatatctggcttaccttggggttgacatcggttgatttcttttcccatgagaactggtcaaattttccttgttctatgttgagaaattttggattgtatcctggacattttgaacactgcattgtaagtaaattatttaactcctgttaaaatcctttggggaattttaattagttagttttagcaattgatctgattgggttcagattgtaaattctgtctcactttctgtgggtagtggctcagcctttgctatattgttagtgtctgcccagtacatgaatgatttaggagttagtttgagacttgggcagtagtatatactaggtttatgttttaaaatcttttcttgtacttattttatactgtcccacgtattcacagctcagggatgaccctggaacttgggtcaattcacatccaaaattagagaatccaccttctttagctctcttcttttcaagaattttcccctcactctccagcttccaggggaccccattcccagttactctggccagaagaggtttcttacagagtattaactccctttgcaattatgtagttgtacacaactgacctttgggacaaagagcaaaagaaaagaaaaaagagagaaagagattcctcttaccttagttctttagacaatatcggctccttttttttgtttccattagccaaagagataggtaggtcttctctctgagctttgggtgctaacactgtcattatggtattgcagctccacaattaggcctagccccattaagagctgttattcaagttctgacttcagtcccaaatctgcctgctattatttacattaaacgtcatcaggtaatcactgtgtactctataaacaatcggtaggagagagaagctatggttactttctccatcttggctgacaccaaagaacaagtgttcaaactttaataccagatccctgacttcatatttactagcatttactagcagtgttaccttggtactttacaaggtttagcacatcttgttccagtggttaactaaactgcccacaaaatagtagcatttaacctccctaaatttataatttattccctacttgtttttttttaaaagatcaaatactcttttttccccctaaatttcattaaaaacaacagactaaccactgtggttatacactgaagaatgatttgtcatggattttattctcagttttgtcattaatttgatttatgatctctacttagttttatagggatattacatagctgatagaaatgttatgaggtcctttaaagatttactcacacatatgtgtgtgtgtgtgtatgtgtgtgtgtatatatatatatatatataaaataagaaatatctaattcataaaaagagaaattgattgccagttttccattttagtatgaagagatttaccattgtaatcttcagtgactcatctttcaattctgtaactgtaataaacacatgcactgcttttagggaggagataatattttccatttgctgccaaaaatggttttataactgatattggttaaaagaaaaatttcaggaaataacaacacaaaacttattttttatagaaatgaatcaaattattcttagtattatttagataatattaaagtaacatgagtcatttaaagtaacagtactatcatcttaaagagtttctgtttttttaacccacaccaaatatacttagcttataaaagtctgtaggggagcataagatggcagagtagtatatataggaatctgtttctccacctggacaaccgtttgaactggcaggatctctctgatataactattttggaactttgtagtctattcaaaggcttatggcttactggaaaagacttgactagtagattttggttaatttgggtcaattttaacctagtgtgctactagccaaccattctccagtgctccagctagcaggtactagggtttataggacagcttgtagaagacagaatgggtaattaaggaccttatcttccaaatattggggatccaggttctattgtggattactgctttaggttgtagaagtgcagaggcaaagacaggctgccattgtttcaacccacactggctgaagtatcttcaagggatttataaggacagtacctacattttcccctacatttttcttcttctcttttgggacccagaaattacaggattagaaaattcaaaggcagctacatatatgggggaatttagaaagtcactatgcatgcccagaggaaaaggcaggctgagaaaaagagaaaggccttaagtttatacctcaggcttatttcttacacagaacactttataacaatttaaaaaaaaaaaaaagcaaaccctagggaagggagagaagctgatttctagaattaccatattataagattcaaatattcagagttcaacaaaaataaaatgacaaagcaaagaaaaagtatgatccattcaaatgaaaacaataaattgacaaaaatccatgaggaagatgaaatggagaacttactagacaaaggctttaaaacaactatcttaaagattctcaaagaactaaaggaatatattgataatgccaagataatgatgtgtaagcaaaagtaaatatcaataaatatattttaaaaacataaaaaaagaatcaatcaggcagctaaaatgacctatcagtttaatatcatcttttaaggccatgatgggactgtccataatcaggcttctctccactgtatgcaggaggaagtggccactattaacagccctccctttttgtagcattagacagcaacaggccaccctgagattatttacagagaacagctataaaaacacttgcaaatatattcagtccagactagaaaatacttttcccccatgagtgtgaagattcatattgtaggctagtaaatctctctgcacatgttcatcatgacaatgtactcaggagttctaagtcatgatgagcatcctgcagcagttccagtgaattatggatgaaaaacatgtatcctttaaaaaaataaagaagaaaaaaaaaagaataatgaagaaatgagttgacaagtacaatcgctgaaaaaaaatcattagtgggattcaaaagcagttttcagcaggcagaaaaaagaatcagcaaacttaaaggcaaaacaattgaaattaacaaatctgaggaacagaaacaaaaaagatggaagaaaactgaacagagcctaagggacctatggaacaacattaagcagaccagcatacacattatggggattcaagatggatgagtgagggagaaaggggcttaccagagcaaaaactcatgaacactaataagcgtgggaaactgtcaggtaggcaaacctaaactgtaattgacaaattgctagaggttcagtgcagacaactatgagagttaaaaacttcagggaaactcagtcgctacaattttgtgaaaactgaatggaacctaagggatctctggaacaagtcttcggaacaaccaggttctcacagtaaatattagaggaaaattccctcatgtttcagcagggaagaggaaagggaactattgtgaaatacaccagggtactctgttcttcttaatgagccctaacccgaggagaaactacttaacctgaacctaccctgctggagtataatcaaatactaacttacctaggggaagggaaatacccaacttcagctcactgtagccatcttctcccatgtaacaggggaggaaaaattgagaaaaactcgtgaagttcactaaaagcctcactaaaagactgagacctggccaggcatggtggctcacacctataatcccagtgctttgggaggccaaggcaggtggatcatgaagtcaggagattgagaccatcctggctaacacagtgaaacctcatctactgaaaatacaaaaaattagctgggcatggtgccacgtgcctatagtcccagctgaggcaggagaatcgcttgaacctaggaggtggaggttgcagtgagctgagatcgtgccactgcactccagcctggcgacagagcgagactccatctcaaaaaataaaaagaccaagacctaatgataggactatagaatacttccccacccccacacatccccaccacattactagaggcctgtctacagcagttccttttacctggtatatcatgtttggctatgaagaaaaattacaaggcatatcaaatggcaaaaaaatacaatttgaagagacaaagcaagcatcagaagtagacatggcaggaatgttggaattatcagtctgggaatttaaaaatcattgtgattaacatgctaagtgctccaatggatgaaacagataccatgcaagaacagatggataatgtaatcaaagacatgaaactcctaagaaccaaaaataaatgctagagatcaaaaacactataacagacataaacagtgcctttgatgggcttattagtagaatggacacagctgaggaaataaaaaactcttgagcatgaggatctctcactgcatacctccaaaactgaaaagcaaagagaacaagttctgagaaacgaaaaaacagaacagaatatcaaagaattttgagacaactctaaaacgtagaacatctacataatgcgaatacccaaaagagaagaacgagaaaaacagaagaaatatttgaaacaatgaccgagaatttccccaaattaatgtcagatgtcacaaaaacaactatacctagacataccatcttcaaactagagaaaatcgaaaataaaaaatcatgacagagtccagaggggaaaaaaactccctatctatagaggaagaaagataagaattacatttaacttgtcctcagacatgcatttaaaaaatcagtctatgatttggggcatacagtatgtaaagatgtaatttaagacatcaataactaaaaggggtgagggacagagtagtataagagcagaggttttgtatgctgttgaagataagctggtataaattcaaattattactttaggatgttaaatgtaatcttcatagtggccacaaggaaaataggtacaggatgtacattaaaaaaatgagaaaagaattaaaatatttcactaaaaaaaattaagaacaaatgaagatagtaatgtaggaaataaggagttaaaaagctataaggcatatggaaaacccttaacaaaatggtagaattccctttttgtcactaattactttaagtgtaaatggattaaactttccaatcaagagacagagattaatggactggataggaaagcatgatccagctatatgctgtctacatgagactcattttagatccaaagacataaataagttgaaagtgaaaggatagaaaaagatagtcaggcaaatagtaaccaaaagcgaaccatggtggctataataatatcaaataaattttaaatcaaaaatgtttaaatatcttaaatccaaaaagtttacaagagacaaaggatatatgttactagaaggtttaattctgcacagtaatattatacttataaacatttatgcacttaataatagactgtcaaaatagatgaagcaaaaatggacagaattgaagaggaaaatagacagctatgcaagaatagttgaggaattcaatatgccacattcaataatggatagaacagccacacaaaaggtaagtaaagaaatgtaagaacttaaacaacacaataaaccaactagatacaacccacatatataaaacacttcacccaacaacagtagcatacaccttctgaagtacacatgggacattctccaagatagagcacattaggctacaaaataagtttcaataggttttttaaaatagatgccataaaaagtatattgcaaaatagtatattcttcaaagcatattctccaaaaagaggatgaagttcgaaatcagtgacagaaggaaaaccggaaaatttacaaatatgtgaaaattaaacacactcaaatagccaataagttaaagaagaaatcataagggaaattagaaaatatttaaaagtgaattaaaacaaaaatgcaacataccaaaacttcatagcatgcagaaaaagcagcactgatattgctgtaagcatttaaaaaataattacatttttgaaaacctcaaaaacagcagtctcatgtataactataagttaagaaactagaaaaagaataacaacctaaacccaaagctagcagaaagaaggaaataataaaaattagagcagagataaatgaactagaaaatcaaaaaacaatagagaaaatcaactaagctaaagttggttcttcaaaaagatcaacaaaatcacaaaattttagctagatagactaagaaaaaaaaagaaactcaaattactaaaatcagtaatgaaaatggagtcattagtaccaattccacagaaataaaaaggactagaagagtacagcgtaacaattacatgccaacaagttgaataacccagacgaagtggacaaactcctagaaacacaaaacctactgagactgaatcacaaagaaatagaaaatctgaatagacctatacctaggaaggagaatgactcagaaattaacaacctctcagctgggtacggtggctcacacctgtaatcccaacactttgggaggccaaggtggatggatcacttgagcacagcaaaaccagcctgggcaacatggcaaaaccctatctctactaaaaattcaaaaaattagccaggtgtagtggcacacacctgtagtcccagctactcaggggtctgaggcaggaggatcacttgagcccaggaggtagaggccacacagtgagccctgatcatgcgcactgcgctccagcctgggcaacagagtgagaccctgtctcaaaaaaaaaaaaaaaaaaaaacctttctatctttctatttacaaaataccaggaccagttggcttcactgatgaattctaccaagtatttcaagaacaactgacactggttgtttccaaaatcttttccaaaaaattgaagagaagacaacacttcctaactcattttatgaatggcagcattggtctcataccaaagacaggaaaaacaaaacaaaactgcaggccaatatcccttaatgaatgttgatggaaaaatgctcaaaaaaaacccccagcaaactgattgcagcaacatattaaaaagaattatacaaggtgaccctagaatacaaggatggttcaacatatgaaaataaatcattgtaatataccacagtagcagaatggagggaaaaaaaaacccatgtgatcatttgatgatgggttttcagcatcaatgggtgctgaaaaaaaatttggaaaaattcaagtttcatgttaaaaacactcaacaaactaggaaaagaaggaaactaccttaatgtgaaaaaggccttatgtaaaaaacccacagctcacatcatattcagcggtgaaagactgaaagcttttcctttaaaatcaggaacaagatggggatgcccactttttccacttccattcaacatagtattggaacttctagccagaacacttaggcaataaacagaaatgaaaggtatccaaattggaaaggaagaagtaaacctatctttttttttttgacatgattatatatgtagaaaacccaagattccacacacaaaaccattagaactaataaatgaattcagcaaagttgcagaatacaaaatcaggctgcaaaaatcagtcttatttttatacaatgacaataaactatccaaaataaaatcaagaaaatggaatagaaacaagagcccagaaataagcccttgcatataggatgtaataattttcaacaagggtgtcaattcaatgggggagagaatagtcttttcaacgaatggtgttgggaaaattggatatccacttgccaaagaatgaagttggacctttgcctactgaatataaaaattaattcaaaatggatcaaagacctgtacacaagagctgaaactaaaaaactcttagaaaaaaacatagggggacagcttcatgacattagatttggcagtcatttcttggatatgacaccaaaagcataggcagcaaacaaaaaactagataatttggactttatcgatgttgaaaatctttgtacattgaacaaagtaaaagggcaacccatggaatcaagaaaatattcacaatcacatatctggcaaggtattaatattctatatatatatattttttttaattcctacaagtcaataaagaaaatgctatttaaaaacaggcagaagactcaaatagatatttctccaaagaagatacacaaatgactgataacatgaaaagatcctcagcatcaatagtcattagggaaatgcaaatcagaaccacagtgatatacaacttcacacccattacgttggctgttatcaaaaaaataataataaataagtggtggcagaatgtttagaaacattgtgtattgctggtgaggatgtaaaactgtgcaactgctatgggaaactatggcatatcctcaagaaattaagcatagaattatatgacccaggaactccacttccaagttacatatccaaaagaattgaaagcaggggctgggtgtggtggtttaaacctgtaatcccaacactttgggaggctgagacaacaggatcacttgaggccaagagtttgagaccagcctgagcaaaatagaccctgtctctacaaaacttgtttaaaaaaattagccagtcctggtgacacacacctataatcctagctactcaggaggatgagggaggagtatcacttgagccccggaattcgaggttacagtgagctgtgatcatgccactgcattccagtctgggcaacagagtgagactgtctcttaaagaattgaaagcagggactgtaatagatatttgcacgccaatattcataacatcattattcaccttacccaaaagttggaagcaacccagatgtccattgattgatgaatgcataaacaaaatgggttaaatacatggaatgaaatattattcagccttaaaaattattgttaattctaacacttgctacaacataaatgaatcttgaaaacattgtgctaaatgaaataagccagattatataaggacaaatgtgtgattccacttacatgaagtatctagaataaccaaatgcataaagaaaatagaacagtgcttatgagtggatagcgagaagagaatggagagtttttgtttgggatgatgaaaaagttctggagatggacagtggtgatggttgcacaataatgtgaatgtacttaatgccactgaattgtatacttaaaattagttagaatggtaaaggttatgttatgtatattttaccagagttccttttatagctataggacaggaaatgcaacatacataaaatgtacattttcttgaaacatttctgcagtgtttcaggcccaacttccagactccagtatgacaggaggtatactgggtttcaaaagacaagtgacacagatggtgtgaggaccacctcaacacaggagagctgacacctttctccttctctcacccaacttttatattttcctaaatatcatagcttcataacagatttgtgatagctggacttatttgttataactcataaaataggaactctgggcaataggaacagctccagtctacagctcccagcgtgagtaacgcagaagacaggtgatttctgcatttccaactgaggtaccgggttcatctcactggggctcatcggacagtgggggcaggacagtggttgcagcccactgagtgtgagctgaagcagggtgaggcattgctatttatgacaaacccacagccagtatcatactgaatgggcaaaaactggaagcattccctttgaaaactggcacaagacagggatgccctctctcaccactgctattcaacatagtgttggaaattctggccagggcaatcaggcaagagaaagaaataaagggtattcaattaggaaaagaggaagtcaaattgtccctgtttgcacatgacatgattgtatgtttagaaaaccccatcgtctcagcctaaaatctccttaagctaataagcaacttcagcaaagtcttaggatacaaaatcaatgtgcaaaaatcacaagcattcttatacaccaataacagacaaacagagagccaaatcatgagtgaactcccattcacaaatgcttcaaagagaataaaatacctaggaatccaacttacaagggatgtggaggacctcttcaaggagaactacaaattactgctcaacaaaataaaagaggatacaaacaaatggaagaacattccatgctcatggataggaagaatcaatatcgtgaaaatggccatactgcccaaggtaatttatagatttaatgccatccccatcaagctaccaatgactttcttcacagaattggaaaaaactactttaaggttcatatggaaccaaaaaacagcccacattgccaagacaatcctcagccaaatcctaagctggaggcctcacactaccagacttcaaactatactacaaggctacagtaaccaaaacagcatggtactggtaccaaaacagagatatagaccactggaacagaacacagccctcagaaataataccacacatctaccactatctgatcctgggcaaacctgacaaaaacaagcaatggggaaaggattccctatttaataaatggtgctgggaaaactggctagccatatgtagtaagctgaaactggatcccttccttacacattatacaaaaattaattcaagatggattaaagacttaaatgtaagacctaaaaccataaaaaccctagaagaaaacctaggcaataccattcaggacataggcatgggcaaagacttcatgtctaaaacaccaaaagcaatggcaacataagcaaaattgacaaatgggatctaattaaactaaagagcttctgcaaagcaaaagaaactaccatcagagtgaataggcagcctacagaatgggagaaaatttttgcaatctactcatctgacaaagggctaatatccagaatctacaaagcactcaaacaaatttgcaagaaaaaaacaaccccatcaacaagtgggcgaaggatatgaacagacacttctcaaaagaagacatttatgcagccaacagacacatgaaaaaatgctcgtcatcactggccatcagagaaatgcaaatcaaaaccacaatgagataccatctcacaccagttagaatggcgatcattaaaaagtcaggaaacaacaggtgctgaagaggacatggagaaataggaacacttttacactgttggtgggactgtaaactagttcaaccactgtggaagacagtgtgtcgattcctcaaggatctagaactagaaataccatttgacccagccatcccattactgggtatatacccaaaggattataaatcatgctgctataaaggcacatgcacacatatgtttattgcggcactattcacaatagcaaagacttggaaccaacccaaatgtccatcagtgatagactggattaagaaaatgtggcacatatacaccatggaataccatgcagccataagaaaggatgagttcatgtcctttgtagggacgtggatgaagctggaaaccaacattctcatcagactatcgcaaaaacaaaaaaccagacaccgcatgttctcactcataggtgggaattgaacagtgagaacacttggacacaggaaagggaacgtcacacaccggggcctgttgtgggatgcggggagcggggagggaaagcattaggagatatacctaatgtaaatgacgagttaatgggtgcagcaaaccaacatggcacatgtatacatatgtaacaaacctgcacattgtgcacatgtaccctagagcttaaagtataattttaaaaaatatgtttattttaaataaaaaatggaaataatatttttgaagtaaaatgatttattgatgaaaaatacttgaaacagaagatactagaataatactttcaatgtgctgaaagaaaataacatttaatcaagaattttacactcagcaaagttaccattcaagaatgggggaggatgaaatgtcattttcctacaaacagaaatgggaacattttatcaccaaaagaacctcacgtaaagaattttaaagatatactctggcagaagaaaaatcatctcagatggagagttgaggatacaggagggaaaagagagcaaagatattggtaaatatctgaacaaatcttttttaaaaaattgactattgtcctggtccattctgctgctgtaacaaaataccttagactgggtaatttataaacaacagaaatttattgcttacagttctgggggctgggaagtccacaatcaaggtgcccgcagattcagcgtctggtgaatgcttcaaagatggccctttcttgctgcatcttcacgtggtagaaggggcaaactagctcctgacggcttcttttataagggcactaataccactcatgaggacagagttaatcacctcccaaagtcctcaacactttatactattgcactggggattagatatcagcatatgaatttggggtaaacaaaaacatttagacaatggtaactatataaaacgataaaaataatgtctcaattatgggaagaaaaaatatgttagaattcttgaaaacagcatgtaatttgagatactgtgattatagttaagtattctaacaggccaggcacagtggctcacccctgtaatcccagcactttgggaggctgaggtgggctgatcacttgagtccagaagttcgagacaagcctgggcaatatggcaaaactctctttacaaaaagatacaaaaattagaccagcatgatagcacgtgcctgtagctactcgggaaactgaagtgaaagaatcacctgagcctaggaggtcaaggctgcagtgagccatggttgtgccactgcactcgcctggggtacagagtgagaccctctcttaaaaaaaatttagtcctattttctaggaagatattaaatattgattatagttttttaaagttaagtatgcatattaaacttattagggtaatcactaaaaggatggacggagtatacaacttccagaaatagagggaagaaattaatgaggaaaatacttaaagtaagataagaaagggagaaaaaaacaaacaaacaaaacaaaacaaaaaaaaacaaagacaagtagaaggcatatgtattggttaaaaaaagttataatacgaattcccagaacatcttccacttaaaattttcccatagaacactgcttagtttctcatattcaaacttgataaacatgtataccttcatgtttatctgaaaaacagcttcagctgatacatatgaaaattttatatttatatctgaaaaattcagtaaattttcaaaaaaattttattaaacttttaagatggtaatataattgtagattggcatgcagtataaggaatgatccagagaagtcctgtgtaccctttactagttttttccagtggtaacatcttacaaaactatagtacaaaattacagttggatgttgacattgataacatcatgacacaacaatttgttcattctttcatttgttcatgggtacttaggttgacttcatattttgcctgttgtgaatagtgctgcactaaatgtgggagtgcagatgtgtttttgatatactgatttcctttcttttagatatatacccagtagtgcaattgctggatcatatgataattctatttctagttttatgaggaaatttcatactgctctccatagtggctgtactattgcttttctattgtcattgcccttttattgccacaccacctctctgtcacccagcccccctttcctaaactctggcaaccactaatctattttctagttcaatattttgccatttcaagaatgaatataattagaaccatacagtatgtagccttttgggattggtttcttccattaagcataatttcctggagattcgactaaattgttacatggatcaataattccttacattttattgttgagtagtattccatactatatatgcactacagtttgttcaaccattttctgttgaaggacatctgggttgtttacagtttgtaattatgatgaacattacaccaaacgatgcggtatctaggttccatggcagttgcaggttttctgtttaaatgaactgtcaaattattatccagagcaactgtatcattttacaatcacaccaacaatatatgagtgtgtctccacaccttgccagtatttggagttgtcactatttttattttagccattttgatagttttgtaaatagttttaatttgcatttccctaatgactagtaattttgagcatctgttcaggtgttttgcctattgtctgactgtgttttttagtttttttatccctgatttttgagagtttttatgtgttctagaaacctgtccttcgtcagatatgtggattgcaattgttttctcccagtcaatacattgtcttttttcctcttcacagtgtcattcacagagcaaaactacttaatttccatgaggtccaatttatcatctttttcttttagcagttgtgtttttttgatgtaaagtctaagcacccttcacctaggcaaaggtccaaagactttctcctgtgtttttttctaaaacttttataattttacattttacctttaaatccatttgagttgatttttttctaaggtgtgagtttaggttgaggtgttttttcgtttggttggttggttggtttttgtgtatgaacgaccacttgctccagtgctacttgtttaaaaaaaaaaaaaaaaaaaaaaaaagctacctttcctctgttgaatggcttttgcacctttgttgaaaattaatctggcctattattagtttagttctagttctggtttctctgttctgttctatatgtctgtccctctgtcagtaccacataatctttatcattgtagctaaacaataagtcttgaaattgcatagacagattcctcccactttagttgtctttttcaaaatttttagctattttggtcccttttgttttccatgtaaattttagaataagtttgtctatatctacaaaaaaattgctcagatttttataggaattacattaaatctggatgtaaatttgggtggaagtgacatcttttccatgttgagcctccatgaacacattatgtctcttcctttagattgtctttgatttcttttattgcagttttcagtataaaaagtctgaacatgtttcgttagatttacacttaagtatttaattgtgttttcagttattgtaaatggtgttttattattaatttaggtgtccacctcatgttcattgctaatatatatagaaatacaattaattcttggatgttgattttatattctacagccttgcttaattgctagtactattaattctaggagggctttttcttttttttttttttgttttttgttttgtttgttgtttgttttgttttattctttgggattttctgtatagacaatcacatcatctgcaaataggggtagttttacttcattctttgtgatttatatgccttttattctttttctgcctgttgtcctagctaaaacttccagtgctattttgaatagccatggtgaaaatggatatccttgctcttttcctgatcttggggagaaagcactcaatgtttcactattaagtatgttagttgtacatttcttataaaagctctttttcaaattaaagaagtccatcccttaatttctacattttttgagagtttttatcatggatcagtgtttgattttgtccggtgaatttcctgtgttaattgatatgattgcatgatctactttttcttcttagattgttgatatgatgcatatgttgatttattttcaaatattgagctggtcttgaattcttggagtaaacccacttggtcctagtatatagttctttttacttattcctgacttctatttgctaatattttagtaaggatttttatatctatattcataagagatactggtctatatttttcttttttatactatcttcatctgattttggtatcaagttaatactggcttcataaaatgagttgtgatattccctccacttttactctctggaagagtttatgtaaaatgtatattaatttttctttaaacatttcagagaattcactagtggaaccatctgtcctagagctttatttttctagagtttttttactataaattgaattttcttaaaagttacagggctatttatctattttatatatggttaatgtagtattttatgctttttgagaaatttgtccatctcatctaagttgtctaatttatgtatatagatttgctcctagtattctcttattgttattttctcgtcttgagagtctgtattaatacgcctgtttcattcctgatattggtaatttccatctttttttcagtcttgcttaagatatttccattttatttatcttttcaaagaacaagctttttgtttcattgactatctctgtttttctgttttaaatttcactgttatctgctctttattatttcattccttctccttgtttggggttcattttgctctttatctagttcttgagctggaagcttgttattgatttgagacttttctaatgtaaactttaggagcactgatttaggtgcattccatgaatttgatatgttatatttgcatttttattcatcttaatgtatctttttattttttgagatttttttcttttttttttaatctatctaacactaggtcttatttcttctatcaaacttcatatgtgcccatcaatcaacttctcatctttccctcctccccactacccttcctggcccctggtaacaaccaatctactacctatcctcatgagattcacttttttagcccccacattatgagggagaacttgcgacattcttccttctgtgcttgccttgtttcatttaacataatgacttttagttccatccatgttcctgcaaatgataggatttcattttttaatcagtgaataatgttccattgtatatagatactgcattttctttatccatttgtatgttcactggtacttaggttgaatccatattttagccattatgaatagtgctgcagtaaatgtgagagtgcagatgtcttttcaatatgttgatttcccttcttttggatatatatccagcagtgcaattgctggatcgtatggtaattctatttctagttttatgaggaaattccatactgctctccatagtggctctactaatttacatttccaccaacagcgtacaaatgtttcctgttttccaaatccttaccagcatgtgttactgcctgtctttttgataaaaagccattttaactggagtaaaatgatatctaattgtagttttggtttgcatctatctgatgattagtggtgttggccatttgaatgccttctttgggaaatgtctattcatatagtttgctcattttttaattgaattatttgttgtttttgttgttgttgttttctgtcaagctatctgagctccttagatagtctagttattaatcctttgtcagacaggtagtttgaaatgttttcttccattctgtgggttgtctctttgctttcctgattgtgtcctttgctgtgcagaagctttttagttttgtataaccccatttgtctatttttgcttttgttgcttgtggttttgaagtcttagacaaaaatctttgcctggaaagatgtcctggagcatttcctcagtgttttcttctagtagtttcatgtttcaggtcttagatttaagtctttattttgatttgatttttgtgtatggtaaaatataggggtctaatttcatacctctgcaagtggatatccagttttctccacatcattaattgaaaagacaggtctttccccattgtttgtttttggcacctttgtgaaacatgacttggttataaatacatgaatttatatttgagttccttatcttccccattggtctcgcatatctgtttggtgtcagtaccatgttgatttggttactatagctttgtagtatattttggagtcaggtcatgtgatgtgatacctccagctttgatttttttgctcaagattgctttggatattaggctcttttgtggttccatatgaattttaggattgtttttatatttctgtggaaaatgtcattgatattttgatagagattccactgaatgtctagattacattgggtactatggtcattttaacaatattcttcctatcatgagcatagaatatatttccatttttttatgtgctcttcagtttctttcatcaatgttttatggttcttcttgtataggtctttcacttctttggttgaattgattcctagttattttatatctttggagatattataaatggggttgctttcttgatttcttttttggattgttcactattggtatatagaaatgctactgctttttgtatgttgattttgtgtcctgtaactatattgaatttgtttatcaattccaacagtgttttagtggagtctccagatttttctaactataaggtcatgtcatctgcaaacaagtctactttcacttcttctcttccagtttgaatgccctttgtttctttctcatgcctaattgctctggccaggacttccattttgaaaaaaagtagtgacagtgaagatccttgttttgttccagatcttagaggaaaggcgttcaatttttttccttttcagtatgctagtaactgtgggtttgtcatatatggtctttattatgttgaggtatgttccttctatactcagtttgaatgagggtttttatcataaaagcatgttgagcttcattaaatgtttttacagcatatattgaaataatcatagggtctttattcttggttctattaatgtagcatatcacatttattgatttgcatatgttgaaccatccttgggatgaatcccacctgatcatggagaatgatctgttcaatgtgttgttgaacttggtttactgacattttcttgagaatttttgcatttgtattcattggggagggtggcctgggtttctctttttgttttatcctttttggttttggtgtcagggtaatgctggccgcatagaatgactttgaaagtattccctcctcttcaattttttttagaaagtttgattagaattgctattatttccaaactaccatcagagatactataaatacctctacacaaataaactagaaaatctagaagaaatggataaattcctggacacatacaccctcccaagactaaaccaggaagaagaaaagaatgtgtattctgcagcagttgggtgaaatgatttgtaaatatcagttaggcatattaggtctggtgtatagtttaatttggatggttctttgttgattttctgtttagatgacctgttcactacagagagtggagtattacagtcccctactattattgtattgcagttatcccttaagatctattaatgtttgctttatatacttggcagctccagtggtgggtgcacagatatttataattgttatatcattttgctgaattgacctctttatcattatataatctcctcctttgtctatttttacagttgtttacagttatggctacagttgttacagttacagttgttacagttacagttgttgatttgtagtccattttatctaagtataactactcctgctctgttttggctcccagttgcatggaatatcacttttcaccccttcacttacagtctatatgtgtctttagagacgaagtggatttcctgtaggtaacacatagttgagtcttatttctttatccattcaggcactctatgtctttgccttggagaagtgagttaatttacattaaatgttattattgataagtaaggacttactcctgccatttgtcatttgttttctggttgttttataactcctttctcccttttttactttcttcatatgtggtttcagtgattttctctggtagtatcttttaatttgttgctttttatttttagttaatctgttgtaggtatttgcattgtggttaccatgacgcttataaaaaataccttataacaagttattttaaaaagatgacaacttatcttagatcacagaaatgggaacagaaactgaaaaaatgggaaaaatcttttacactttacttccatcttccccacatttagactcgtattgtctcaatttgcatattttatattacctatctcttaacaggttgttgtagctcctattgtttgtgatatatttatctattcgccttcatactggagttatgattgtgtgtccagagttggttccttccggtgggttcgtggtctcgctgacttcaagaatgaagccgcggacctttgcagtgagtgttacagctcttaaaggtggcgtggaccaaaagagtgagcagcagcaagatttattgtgaagagtataagaacaaaccttccacagggtggaaggggaatcaagcaggttgcccctgctgactagggttggccagcttttattcccttatttgtccccgcccatgtcctgctgattggtccattttacagtgtgctgatttgtccattttacagagggctgattggtccattttacaaatctctagctagccacagagcggtgattggtgcgtttttacagagcactgattggtgtattttacaaacctctagctagctgtagagcactgattggtacgttttacaattctagctacagagtactgactggtgcattttacaatcctcttgtaagacataaaagttctccaagtccctggttgacccaggaagtccagctggcttcacctctcaatgccccctttagacaggacaccccaactgctgttgggaattgggcgatgcttgctctagctacttcctgctggaaaggggcacagaaggggccctacagtggtagtgtcctccagaggggaactctctaggccagccaaagggtcagtgggttggtccaggggtcctcggtagaagttgttcattgagctcatttggggttccattggtaagacatcttactgcttttaggattctgtcttcattcatgacctctgattgattattgtatgccttggagtagtcttatttgggtcctatccatttggtgttctctgaccttcctgtacctgaatatttatatccttgtgaagatttggaaagttctattattatttctttgaataagctttctaccccttgatcttcctcaactccctcttgaacatcaataaaataatttctagatttgttgttttgatgtgattttctgtatcttaccggtgatcttcattgctcttcatgctttttgcttttttcttctctgtgtattttcaaatagcctatctttgagctcactgactctttcctctgcttgatccattctactgttgagagcttctaacgaacttttcagttgaacaaatatatatctcagttccaaggttaatgtttggtttttaattatttcaatctgttcattaaatttttatcataaattttgaattgcttttctgtgttaccttggagatcactgtgttttcttaaaactactattttgagctcttggttagggagctcacatattgctgtttcattagggccagttactgtttcattgctctgtccacttgggaagatcatggtttcctgtttactattgtttcttttggatgtatgtacatgtctttgcattggaggattagttatatttattccagtgttctgtctggcttgtttcgcttttttgtgtttgttttttataatctcaacttttagattcaggggtacatgtacaggtttgttacatgggtatatcacataatgctgaggtttgtggtacaaatgatcccatcacccaggtaatgagcgtagtatacaaaaggttgtttttcagcccttgccccgctccctctctcataccttggtagtccccagtgtctattgttcccatctttatgtccatgtgtaccaaatgtttagctcccacttacaagtgagaacattcagtatgtggttttctgttcctgcatgaatttgcttatgataatggcctccaggtacgtccatgttgctgcagaggacatgatttaattccttttatggctgtatagtattccatggtgtgtatgtatcatgttttctttattcaattcaggatatatttgattcgaggcttttttttttttttttaccacttccccattttcagtcctaggtgacacattatccccaggttcacctaagctctagtaaatgatcagaatgctacccttctcgggtgagggaggtgaaacatggtatatccttccagtgtaggaaagctaagccagtgtttcgtgcccagggaacctgtgggatgcacctcctacagcgtggtactgctgaacagccatcatgatttagcatctcctttggctgagtttatgagcagagtttccagggtcagagactataatcccacctcctccctttgtctctgcctatcctcaggtatatttgttccttcagacacttgtgatgcttcccatgggttaaggcagggacaggtctactgccagggcatgcaaaatgatggaaagctggctgttcaccttgatctcactttttccaatgttaaaacagtaagttagaggaaaattttctacatgcttcgtgcaaggcaggatggggaggaggaacatcatggatgtggaaatctgatattcttactgtctgttcagagttttttcacttctttctggccccagggccacatctcatcttcatatttgagttctgggatatttctagtgatattctctgtgctgttcatttgcttttggtttcctgttgagaggagtgaagtcagcctgctcgtacattgccattttgaaaccagaagtctctggtttcttgagatttcctctttgatccatagattattcagaagtttatggtttagtttccaagtgtataggaattttcctgttatctttctgttactgatttcaactttgcttccactgtggtcagagaagttactctataatttcaattcttttaaatttgtttaggtttatttttatggtcacagatatggtctatattggtaaaaacaatgtgtattattctgtcagctggagtgttctacaaatatcaattcgatcctgttgatttgtgttgctgagttcttctatatgcttgctagttgtctgtctagtcattctatcatataccattaaagtgacttgtatccaaaatatacagagaacttctagatatttaaccaatttatgtgaaaacttacatccacacaaaaatccacatgcaaatgtttttaacagccttattcgtaattgccaaaagttggaatcaaccaagatttacttcaataggtaaatggataagcaaattatgctgcatccatacaatggactcttattcaataataaaaggaaatgagccatcaagcaaccaaaaaagacatccttacatgcatattgctgagtaaaagaagccagtgtgaaaagaatacatattatatggttctaactttatgacattgtagtaaaagtaaaattataagaacagtaaaatgatcagtgtttgcccagagtttttgaaaagaaagatataggtgaatggataaagctgaacagattttttagagcagtaacactatttgatatgaagtagaaatacggaaacatgacattatacatttgtcaaaactcatagaactttatcacaaggaaggcttaatatatgcaaattgcatttgatggatcccagaaagcaatgaggactctgccaagagaatttaaatgcattacaaaataaataaaacaacctcatggaagcgggtggaggggaaaagtactgacctaaataactttggatatgagtggagtctgtaagactaaaggtaaaagcaactgcacataagcgctttagttgataaagttgtatcccatggaggtatgggttaacaattctaattttaatatatatgtatactggaattgaacagttaataaatggatggcaggtagtgagacaggtttctcactgtcacagtgggaaatcacatatgtacaagcaaggggaagaggctagaatgatccatgtgatcctaggtaatgaattagagttggagacatcagtatgaactcatatctagctttaacatagatacaaatggttacatacagaaatatttgttttatatatatatatatgcacacacaggttagtttacacacgtattcctttgctttgtcagcagagagggtctaaaataaatgacatatcaatatgaaatgatataattaatgctgaaatcttagtttttattaccatttggcaataaaaggagcctgggttccttggagaagtggctgattctgggaccaaggcaggaaatatacaagatgaacctggtatatctcgtagtgcttaaaagtaaggaagcactcaagaaaacaaactacaacaaaacacacattggcgggtatatattaaaggggcataggagtcaattgacatctcccgatgaccaaagatgtaaaaatgtgagcaacaaaataagcaacaagcagtatcttattataatccaaagtataaaataaacatccatgactccatgcttatacaaataactttttgcacaaattaattcatgagggagaagagacaaatgtcctgtgcatataatttccaaataatttatatagatgctccaccctcaaggaaggggcacataactcctcacttcttaggcatgggctacatacagtgacttccttccaaagagtacagaactggggtcaggttggggaagagtaactttgctatggggagcacctgacaaatacctcagctaagagatcaagatcagtatcaacattcattagtcagattgatagcatatacctgtgatatgatgtaataaaaatggctgtatatctctatagtcttcttccaaaaatcccataaccctaatcttatcatcagaaaatatcagacagacaccagaagtgggcattctgcaaaaaaaaaaaaaactgaccagcacttaccaaagctatcaaggtcatcaaaaacaaggaaagcctgagcatctatcactgccaagaaaagcataaggagacatgacagctaaatgtaatttggtaatctgaatgggatcctgaaacagaaaaagggtattaagtacaaagtaagaagcatgaataaactgtgggctttagttaataataatgtgtcaatattggctcattaattgccacaaaggttccataataatacaagatgttaaatgtaggggaaacatggtacagagaatatgggaactccctatactatcttctgcatttttctgtaaatccaaaactgttcttaaaaatgaagtcaatttaatcaaataataacgggatattctatacaactgtcaaggagcaaatgatttcaatattatttaaattgttcctgagtgtagtaaaacgtaaacatttctcaattcatgttatgagtctgggataatcttattacaaaactagaaaatgatagtagaaaaaagggaaaatgtaggtgaatattcattgtgaacatggatgtgaaaacttcaaaaataagatactaacatatcaaatctaaaagtatatttttaaaagatacatcaggataaagatggatttatttcaaggacacaaagatggttaactgattaacatgaatcactgcattaacagattaagggagaaaagtcatatgaccttctcaattgatgcagaaaaagcatttgataaaattccaaacctgtttatgaataacgactcttagcaagcaatgattcgaagggaacttccttaatttgacaaagcaaatatagttaataattagatattgttagtattctctttaaagttaggaataagacagagtccaagtatacttctgtccaatattgtacaaagtaaaaaaaaaatgatacaagcattgaaaaggacaagtaatctcccatgattactacatgggaattattaaaaaatcagtagtcttttagaagtaatggaagagttcatcaagtttgttggatagaagatcaggatacatcagttgctgtcctataaacccaaggtgtattttttaaagggaccaaatttcatatttactgtttatttcatgatgtagagattgtaactgtaacagtttctgagcattcctcatttcatcaaaatggatttaataaatgtctaactggtgaagatactgtattaggtgctatacaataggttctatgcagaatcgaccctctagaagtttataattttggggcaccctgcactaacagacggaaatacactaactgcagaacagaaataataagccagtacatatatgaacactaaaatgtttagatttaagtttaaaattacaaataaagagactttatctcaacctttttattgtgaaaaatttcaaacatataccaaattgaaagaattttacagtgaatacttaagattctactattaacattttattgtagttgctttatatctgtcatctattcggccaaaagaaattaaaaaagaaaaacactgacaacatctagcattgtcaggagaagcagcaacagtgtgttgataggaatgtaaattggtacaaacactatggaaaattacttttatacagtaaaactgcacatctgcttattcctgtgactcataaaatctgcttctagctatttaccctagaacattagctttcaaatgtttttgaccataagccacagtaagaaatgtacttaacattgtaattcagtacacacacacatatgtatatatatgtctctatgtatgtgggtatgcatatatgcatatatatctacataaacaatatgcacacacatacatatacaaaaggcacaaacttttctgagtcaatatttatcctaacttccaggaaagcattctgatattttctgttctgttcttttttaaaaaatgctagttatggcaactgaagtcagtttactgccctgttaattggtcgtgacctacaatttgaagaacactgtcctagagaaagctgtgcacatatgtaatattgtgcagcattgaaaatgaactatagctatgcatatcagcatggaggagtttcacaaacacagtgttgagtgagaaaaccaagttgtataagaatatgcacagtatgatttcatttgtatataaatttcaaaagcatgctaaaatgaaaatatatttagataaacatatgtggaaaagttttttttaagtgaatgatttatataagcaccacatggatgaaccttgaaaacatgttaagtaaaagaagcaagtcacaaaaggtgacatattatatgtttccctttatatgaaatgtctagaataggcaagtctgtatggacagaaaatagcttagtgaatgcctagggctgggagttgcaagaaaatgtggaatgactgctaatgggtatgggatttttttgtggagggtgatgaaaatgttctaaaatggattaccaggatgattgtacaactctgagaatatactttaaaaactattgaattgtatcctttaaatgggtaagttgtatggtatatgaattttatattgatagagctgttttacaaaaaagtaagaatgttttaaaattcaggataatagttatttggagaagaagggacttgagatcaagtcaaggcacgcagtactctttgaaagtatcagtgatagtctattgcttcacctaggtagtaggcacatcagtgggatttttattgttattgtctgttttatacacgtcataccttgttgtgtatttaatatttaacagaaattttaagagaagcaatatttttcatattcttctattctcatgcctgttgtgatcaagtttaacatagaatattgaacttctagtgtaaatctagattaggaccagttttcatccaaatatgtcctgtttttaaaaattactctttttgtattaaactttcaaaaaaattggaataaaaaggtaactatcccattatatagtctgtgggtcagaatattcttaactataacctgttcgcttttcttcatcacctttgcaaccaccctaattcacctgttacatttttcgacattctcttaactgtattccttgcttcctttcttgcacctctccaaacaactttctactttgcagccagaaatatcttttgaaaatacagatattagtatgttatttctctgctcaaaattttttagcaaaatctcactctccactgtagataaagactgaattctttaagattactttccagggcctatatataatttgtcactgctgctttttgcatcagcttccacccacacttgttgttgtttttaccacacatatcaggttctattgttagcttctgagtactttgtacatgcccttttctctgccttgaatgttcttccttctctctttacctctgtaacaactaccagttcttcaggcagaagcttagattttttccttccttatagaagccttctcttaactacccctacccttccttacctaagactaaaatgcccttcctattgttcccaaaggatttttgcttaatatacatttacatttatttaaaatatgctttatattttatatacataaacaaaaacaatgcgctatgtaacatgctgaatcagatacatgagagaaaataaactaagaatgagtcaactcgtatttagtgttttttgttatcagactttcttttctttatatcttctgtcatcccctttcagttcatcttagactattattcctgaaatagtgcttggtaatattagtaatagcagaatccatgtatcatctccaatgccttaagaatacattctagctctttacagtgaattcatgacttctactgtcttaattctaatgtactttttaaggaaagatggaccaaatatttatttaatgcctattatgtactagattatactgtaccttatatttcaaagattatgttaacccttttaacaactcaggttatggaaactaaggattaaagaagtttagtaatgaagacaggattacactaatagtaaatagtagtaccaaaactcaagcacagtttatcacagcagttctcaaacttttccatggatgagagtcaactagagaacttgttaagatacagattactggaccccaccctcatagttttttatccaatatatcagcaacagagaggaggggataagggtggtatgggacattttgcctttccaacaaattcctgtatgatgcatatgtttctggtccagagaccacaaattgaaaaatactaatctgtcagacagcaacatctttccactggtccttcttagcctcatattactcctctataagtaagcaagtggatgcttgctggtgagagacaatatactcaaaatgcacttggtgctttttttaactctatgcttttgcattatttttcccctcctcctaaactgcccttctttttgatttttgttttgttttgtttttttgagacgaagtcttactactgtcacccaggctggagtgcaatggcacaatctctgctcattgcaacctccgcctcccagattcaagcgattcttctgcctcaggctcctgagtagctaggattacaggaacctgctaccacacccggctaattttttgtatttttagtagagacagggtttcactatattggccaggctggtctcgaactctgaccttgtgatcctcccacctcggcttcccaaagtgctgggattacaggcatgagccaccacactggctacttttttttaacctatggtactttataccaatttgtgttactacttactatcttgtgttgtagttgtttatatgctttaatgttctacattttacaattataaacttcttaagcatttgggttgcatttattccataatacttagtacagatctttagctatttgataaatattggaatatgctaaaactttggtgcttatagtttttaaattattgaatgatataatgtttgtaaaaatactttattaatcctaaagcattatatagaggaggagtactttcttcttgcagtgactctggacattctatagatgaaaaagtatgtcttaaaattaatttttaaacacttcaaagagatcagggaaatgagaaagaatacataaatctctgatgtaatgttttgacaaaatagtaaaaaaaaaaattgatgggaaataacaaatgtaatctcctggctgtatagaaacctttaattatatcacatatgcatacatacacacacacagaaaaatagtggtctggatgtaactgttggttatattagcactgctactaaggtgtcaacctagagcaagtgaagtattattggagacataaaaagcctggatttgattaccaaaaattggaataaaaagaattaactaagttttcacttgccactaaccttctaatggagggagttacaacattcttggaaaataaaatccaacacatttcataacgtgataaaattgttacagtgatgtcagtaaggataagttaatggacattaataaacacaagatggaatgaacttactggataaaattacaaaaatcccagagctatgtattaatcaaattctttgtactccaaattatttttccatattttgtaggtaactatatttgtctttccttcatagaaatattgggaggataatatgcagtaattgttatggtaatatttctagtttttagaaggaaaggtgctacaaacttccggatgtagctaatactatattctacgagggattattgtgctcttagttaaaattctagatttattcaataaattgctagatttgcttacatgaaaatagagaacttaatattgatgacattccaatcatattactggtgatattataatcaattagctatcatattgacaaaaagctaaaatgtagcattttagtttggaaagaaaaacaaaattcctaagtaaacaggaacatattaagaactatataattacccagtgccattttgtcactaaagtactttatccaattctgactgccagaactaaaacagattttgaagaaatatcattaagattaaaggtcagaaaatagccttaaagtttttaatgaaataatgaatagtttttctagtaagaagaaggccagcaggtgattcagtaaacattttcagatatatggaaagttgtaaataaatggcaatcttctctttcagattgtaagtaggacaagaagaaaaagtaataaaatataggacagttttaggttatttcagagaataagagtggttaaagaaaaactcagtcaagacatttggggaagagtgttcttacattactttaaaaatactgtaaaattttaaaaatagcataatctctttgttttcaaattatgaaaatgagataatgttaccagatcagagtaacacaaccagtcaatgacagcataattccagctctcatatgaaaatctaggcctttgctccttgactccagtcttccactgcttttccatttttttatgtttcttaaccagttagtttaaatgtagcctggaaattgacaattatctctgaaagatgtttctagcttaaaatgcctgtgattatcagtgggtctattaatgaatgagctctccaacctcttcccttctgccattcacttgtgaaaaaccttgttttactttaaaacttatagacttcctgagaagcaagagctcaaatctaaatcttaagtgctttttgtgttagacttttgaacataaatatcactaggcatttttaatgcactatctcaaactcttaaacaattgtataaaatatgaagaagctgaagttagacaaaataggtaattagacttggtcagattgcttaaaagtaggtaaattattctgattccacattcagtacattttttccaatttgccatactaaccataatgtaaaaacttcaaccagaatgcctaatttgtatagcaagcagtgaatgtcttaagataacacttttattcctaaaacagttgttcacatgtaaagtaaaatgattgttatttgttcttaatgtatttaaaccgggcattcatagcaatttagtgttcatctactttctcttttctttcaggcctgtatgtggaatcagagggaaaacgctcataattaacctgccaggtagcaagaaaggatctcaggtaaatcacctggacatattaatggtttagtgtaagagcttttgaccagccgtgaaagttagccagccaaaaagttggagcactccacaagactgccctcacatctgataccaattgcaggattcccaaagtcactcttgggttcagtaattcaatggaaagacatagaactcactaaaaactgttacacttacagttatggtttattatggggaaaggatacagattaaaatcagccaagagaagaagtgcataagacaacgtccaggaatactaccaaacacagagagcttcccttgtcctctccttgtagagtcatcaatgctttactctcctggcattcgtgtatgataatatacttgtaatatttttaatcagagaagctcacctgagtttttgatgtccagagtttttttttttttttttggtttggtttttttttttgttttgttttgttttttttgcagttcattatattttgcccatgtgaatgacctttagtctttagcgcttcccagagattggattgatagcattagtctccagtatgttccagaactgacaccatgtggccaaaagtccccatcataagtcatattgttagattgtgtggtggccaaagccatcaggtaaacaaagacactgctgtcacacatgacattctgaacatctagagatctcctccaactagttaagggcaactacttttaccctcagactctctttgggtactgttaattctttgctgtacaagctaccccctggcctttggccaaggctttttttattgtatagcaacacagtcatgtttgtctgggcatctatatttactatggtatttatgtgacagacacagcagtagtatcagtgtgaatatgcctaagatttggccaaggcagtgtagggtgtggatatatttagagaaatagctaatccatccactaaagccattacatacattttcataattttgtattaagttactaatttctcacctttaatctaccactattgatatgtttgtacagaactatatatcatagaaattagctgatggttacctaagtgcatttcttcctcaggccagtcattttctattaacattatatcctgaggaggctttaactgaatttcccaatacacttagccataacctaaaaaataaaagtcaaaagatactggcacgttcttagagtccttctcagacattaacagaccagaatgtctcccagaatgatgctactcaggtttgcaggcttgttggattccaaaaataagagtggtctcagcaacatatgacttcactctttcaagcatctgttacagttgagctaagaaacaatgtcatctcttgttctgaacctctttggagataccaatgcagtattatttcccttactgcataacctatccattcattcctttaccctcagctaccattcttccttctctctatttatacccaaactttttcaccttttaaagagttgtaaggtttggccactgtgctgattcagattgccgttggtaatactagtttagcaagttcctcctgcacagtctattcctattcatttagagtaggattgtatcccttaccttcattttagctagcatagataacaataaccaagagattgtgtgtttaacttctttctttatattttgcatctccttatgcatccagtgagataactttttgggaattatctccattaactaatcacagtaaagaagcaattccatgctgtggttgacactgtcttcactcagggatcaaaggttcatcatcccacaccctctcttcacttcctaagccatgtatttcagtgagtcagggtctttctagaaaatcttatttttgacaccaactgtaaggagttttagccaactgcaaaaaatagccacctacaaatgtggagtactccacaaaattgctcatttctgaccctaattgcaaattcaggagatcctaaaatgaccttcaggtttaataatttactagcattcatggaactcacagaaagctgttatactcatgattattgttcattgcaaggaaagaatacggattaaagtcagccaagggagaaagtgcatagggcagagtctaacagaagtaacaaatgaggaacttctgttgtcctctctctttggagacatggacatgtcacccttctggcgtcaatctgtgataccacacatggagtaatgccagctggggatgctcacctgagcctttggtatccagagcttttattgggactcaaacacttactgccagtgtggctgacctgtaatctttaatcctaaagtagagagaagcaattgggggccttctatgtagaaagtggggtcagaaggccaagaaagggagtatgagtatatatccaagtcacttaggaacttttatgcaggtgcaaaaaaacttatgtcaaagtggccacaagattatttaatagacagatgaatgaaagtccatgtttactgctagacacgaaagctttgtgtgaaatcttgaattaatggggagagagggagggtagcctatacctgtctgttcttttcctgatccctttccctcattcctgaactgcagtctaacattgttagactgtctctggtgcccaaagtccatggacaacaaagacattcctattaggcgtgaaattccaaggacctagagatcactcccagaagctgagtgtaaagaccagacctctcctcggtcaaggttaaattctttaccacacaatctttaaagagtaaactgattgagccatacaaagataggtcgaaagattaaacatctttcccgatattatgtaaccctccaaaaatttttaagatttttttttttacatcttagattttaagctattacttcaaatgtgaaagagaaagacctccacctcttctgcagctatagctggccttatattctgatttttaggttcttacctattctcttttggtaatacgttatagataatagtgagcacctcagcagcagattatattaactttatgcagtgctctttgcaagcttattttatattttgcttgctgtacaatgttacctagctatactttatgatggtagttagaactttagctctctggacaaaataatctggttctcacctcggttgttagttctactgccctgctctaactaaaaatatgaaacctctttcctgcctttttttaaacaacttcagtaccaataaatctttattcattgtattttcccaagaaaaggagaagggataggaaaagagtcagcatgtgtgttaaaaaaatgattagaagatgggaaaagaagtagagaatacagcaaaatcaaccatcaaataaacataccccagtggtggggtcaccgaagcccaaacgggctcaatctcctgcagttcaagaatgaggggttgggattaggaaaataacagacaggtacaggctactctccctccccataaattcaagatttcacacaaaggtttggtgtctagcagtaaacacagagtttcatttgtctgtctcctattaaacaatcttgtggccactttgacataagtttcttgcatctgtgtaaaagttcctgagtgccttggatataaatattcatattcttttacttagcctcctgagcccactttctgcatggaaggcccccagttgcttctctctacttttggattaaagattaagtagatttggccaggcgttggggctcaggtctgtaatcccagcactttgggaggccgaggtgggccgatcacaaggtcaggagttcaagaccagcctggccaacatggtgaaaccccatctctactaaaaataaaaaaaaactagccaggcgtggtggcaggcacctgtaatcccagctactcaggacgctgaggcagagaattgcttgaacccaggaggcggaggttgcagtgagacaagatggcgccattgcactccagcctgggcgacagaatgagactccgtctcaaaacaaacaaacaaaaaaaaatggttaactagatttgacccatccaagatacagcagtgtcttaagtgtttggcatgaatcacatcaagaaatggtcttgactcaggaggttgggaacaagggatgaagggctcctagtttcttcaggatttttgcataaatcatttaagagttgtagaaataacgcaagaattaaatgtgtgtatgtgagtatgtaagttttctcttggggaggaggggatggaaaagagggtagtatacaagtttttagaatgtatttatttatttatttttagagacagagtctcactgtgtcaccctggctggaatgcagttacacaatcatagctcactgcagcctcaaactcttgggcttctttcctatctttcctgtctttctcataatgcatctttcaactaccaagttgtatatagaaattttactttttttaaaatgcagtgcatgctttttttttttttagagaatgaatctgattctgaccatccatgcctgtcctcagtcttatttttttttatttttccataagttattggggtacaggtggtatttgcttacatgagtaagttctttagtggtgatttgtgagatcctggtgcacccttcaccgagaggtatacactgcaccatatttgttgtcttacccctcaccccccacactctttcccataaattcccataagtccccaaagttcattgtgtcattcctatgcctttgcgtcctcatagcttagctcccacatatcagtgaaaacatacgatgtttggttttccatttctgagttacttcacttagaataatagtctgtaatctcatccaggtcattgcaagtggtgttaattcattactttttatggctgagtaatataccatcatatatatataaaatagtttctttatccactcattgattgatgggcatttgggttggttccacgattttgcaattatgaattatgctgctataaacatgtgtgtgcaagtgtcttttttgaataatgacttcttttcctctgggtagatacccagtagtgggattgctggatcaaatggtagttctacttttagttctttaaggaatctccacagttttccttagtggtttcactagtttacattcccaccagcagtgtagaagtgttccctgtttaccgcatccatgccaacatctactgttttttgattatttgattatggccattcttgcaggagtaaggtggtattgtattgcagttttgatttgcatttccctgatcattagtgatgttgaacattttttcatatgtttgttggccgtttgtatatcttattttgagaattgtctgttcatgtcattagcccactttttgatgggattgtttttttttttttttcttactgatttgtttgagttcgttgtagattctggatattagccctttgtcagatgagtagattgtgaagattacaaaacactgctgaaagcaatcatagacgacacaaacaaatgtaaacatatcccatgctcacggattagtagaatcaataatgtgaaaatgaccatactgccaaatgcaattttcaaattctatgccattcccatcaaaataccaccatcattcttcacagagttaagaaaaacaattctgaaattcatatggcaccaaaaaagagcccgcatagccaaagcaagactaagcaaaaagaacaaatctggaggcatcacattacgtgatttcaaactacactataaggccatagtcaccaaaacagcatggtactggtataaaaataggcacatagatcaatggaacagaatagagaacctagaaataaaatcaaaaacttagagccaactgatcttcgacaaagcaaacaaaaacataaagtaggaaaaggacacccttttcaacaaagggcgctgggataattggctagccctatgtaggagaatgaaactttatcctcaactctcaccttatacaaaaatcaactcaagatgaattaaggacttaaacctaagacctaaaactataaaaattatagaagataacattggaaaaacccttctagacattggcttagacaaggatttcatgaccaaaaacccgaaagcaattgcaataaaaacaaagataaatagctgggacctaatttaaactaaggagcttttgcatagcaaaaggaatagtcagcagagtgtatgttttttttttttttgtcactgtaactatttttattacatcacaataattaggagtagtacagttcatgacaaaaatattacaaattttagatcatttcacagcacatactcctataaacatttaaaagttaatttcaattaaaagagtggtcatttttaatgtttcatatgaccaacattgtagcactgtagttccttagcttatggagaatgctataacatattttatgcttacttcatggcatattgctaagacaatgttttacatatgattgattctgagattgatggaggaaaatgcaaatccaaaatcacgaaacagtttgattgccaccatcttatataattacaaaagtgcttcatcttaatttttttttctttctcttgcatacaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaaggtaagcctgatgagagttactcagaggcctaaaggacccacaggtaaatgtactggtttcatctgttttgcatcgcatccctccctacatttaatacttcttcagagaaccctaaaaaaataagtgggatgtccatgacactccactactatgtttccttcttgatatagattccttgaagtcactgaagttaattctgagttctgaggcattactgatgagctgttgcctattgaagtaatagctacaatgataaacaacgtgacattttagaactctttggagatgtcatttttgtggacatattaaatatataatgtttatatattcaaagtatcaaaatgtcacaaattcttaaaggaacagcaaactgaaggtaaaagaccttagatgattcaagaaatgagttgggaaagattaataaagatttttaaagggacaaagcttttcagcgattgttgaatttttcttaactaataacttattcaaacattgcttgacacaaattaccctagtggtaaagataggaaatggatatatttgcatttctactttaagaaatattattaggacaatatcaaagtattacaaattctctttgggcaactccatgggtaaatatactaccatgagttacttgagtaaatttaactgtcttaaagttatagaacatggtttattcttcatacctactaaagtcaacctagtatgccttaatatctacagaaagtagcatatcaattctggaaattatgatttttcattaagagcataaagattgaaaatttaattgctatatgacataattatcagattttatggattatccagttattttggctacgagcattgtgaggttttttttttaataatatatagattagaatcatcgagaaatccttttgaagtgtccattcagtgatccagtgagtgcttactaaaggctagtaagtatttaagttttgtgtgattttttttttatgaaaccaattggtgaaacaggcatttttaaatcattatatgttccttttcctttactctgaattaaaagagtaagaagtgccataaatttcaatcttaggagagaagcttatggcatttaaaatctaagctgattctgtcattctacatttggaaaatgttagcatttcatttttccatttgtttttaccttttttcctttttagtcattttgcttgtatagtttcatgttttcctgtcactatattcatagttgttatgtgttgtgcattagaagcatccattctacaccagtcctgctgttgtcatggcacacggtgaacagcccatccctggtctcatcaattattcccatcattcaacagatgaacgggtaagacaagaggcttttgcattaatggttttccaaatatgtattctacttcctctccttggagataggctgtaacatatggaagatgtgttgttttattctgatggattttcagccttgctttcttgtgaaagtgtgagtgccattgagtatatccatcaaggaatttaatagagtttctcctgtgactaaagtactctgctatcattaagattctgtcatttgtgacaatgaacttttatcaaatgacttgcaagaaagtcattgctcagaagttatttttgtcttaccaatttcatcagatatctttaaataaattgcctggcttaaaattacctcttaagagaatcactttgagtcttaaaatctagacagattggtcaagcaaatagttgatttgtattaaccttcctgttttgtcttatgattttgcatctcatttttttttcattcattgagctctcattacaaccattgcagagttgaattttgatataaattctgtgattcctcatcataagtaaactttttaggtgcatatttgtttattcagtcagtggctgaatgatagcttgcaaaaaaatgccaggttgtaaaagattaaactgatacataaaaatcattaaacagtgataatttagacattggatgaaaaaaaaacgatctaagtccctaatatggatgtaaaatgagaggggcagagaagaaaaagaaataataaagtgaaatttggttttaaatacttaggaagcaaaacacccaaaattaggagagaaaaaaaccaacaacttagcatccatagtctcttagaagatactaccaagtgaagactttttaaaaattttaattttgtggggtacatagtagtggatatatttatggggcatgtgagatattttgatacaggcatacaatgggtaataatcacatcagggtaaatgggtatccatcacttcaagcattcatcatttctttgtgttacagacattccaattgtattccctaatttattctaaaatgtacaacaaattattgctgattgtaatcaccctgttgtgctatctagatcttatccattgtatctaactatattttggggtacccattaaccatccctatttcccactccccctacccaccctctccaccctctggtaaccatcattctaccatctttatctccgtgagttcaattgttttaatttttagctcccacaaataagtgagaacatgcaaagtttgtctttttgtgcctggcttatttcatttaacagtgtcttccagttccatccatgttgttgcaaatgacaggatctcattcttttttatagctgatcagtactccattgtatatatgtaccccattttctttattcatctgctgatggacactcaggttgataatgctgcaatacacatggaagtgcagatatctcttcaatatactgatttcctttcttttggatatacacctagtagaggcattgctggatcatacgtagttctgtctttagttttttgaagaacctccatactattctgcatagtggctatgccaatttacattcccaccaatagcgaacaagtgttcccctttctccacatcctcaccagcattcattattgcctgtcttttggataaaagccgtattaactgggaagagatgatatctcattatagttttgatttgcatttatctgatgatcaataatgatgagcaccttttcacatacttgtttaccatttgtatgtcttcccttgagacacatctattcagatcttttacccatttttaaattagattgttttatgttttttcctatagagttgtttatatagtctggttattaatcccttctcagatgcatagtttgcaaatattttctcccataccttggattctcttcattttcttgattgtttcctttgttaggcgaagctttttaacttgatatgatcccatttgtttactttttcattggttgcctgtgtttgtggagtattactcaagaaatctttgcccagtccaatgtcctggagagttttcccaatgtttccttttagtggtttcatagtttcaagtcttagatttaagtatgtaagtctttaatccattttgatttgattttttatatatggcaagagataggtgtctagttttaataatctgcatatggatatccagttttcccagcaccatttattgaagagactgtcctttccccaatgtatgttcttgacccctttgtcaaaatgagcttactgtacttatatggatttgtttctaggttctctattctattccattggtctatgtatctgtttttatgccagtaccatgatgtattagctactatagctctgtagtataatttgaagtcaggtagtgtgattcttccagttttgtttttatttttgcttaggatagctttggttattctaggtcttttgtggttccatataaatgttatgattattttttctgtttctgtgaaggtattttgatagggattgcattgagtccatagattgctttgggaagtatggacattttaacgatattgattcttccaatccatgaatacggaatgtctttcctttttgtgtgtgtccacttcaatttcttgcaaaaatgttttatacttcatcatagaaatcttttacttctttggttaaatttattcctatgtgttttctttgtagctattgtaaatgggattactttcttaatttctttttcatattgttcactgttggcatatagaaatgctgctaattggccaggcgtggtggcttacacatgtaagcactttgggaggctgaggtggttggatcacctaaggtcaagagttcgagaccagcctaaccgacaaggtgaaaccccgtctctactaaaaatacaaaaattagcctggtgtggtggcaggcccctgtagtcccagctactcaggaggctgagacaggagaattgcttgaacctgggaggtggaggttgcagtgagctaagatcgtgccactgcacttcagcctgcgtgatggagcaagactccatctcaaaaaaaaaaaaaaaagatatgctactaatttttgtttgttgattttgtatcctgccactttactgaatttgcttattagttctaatggttttttgttggagtcttaggtttttccaaatattgtatcatcagcaaaccaggataatttgatctcttcctttccaatttgggtgctgtttatatctttctgttgtctgactgctctagctagcacttccaatgctatgttgaataacagtggtaaaagtgagcatctttgtcatgttccagatcttagaggaaatgctttcagtttttccccattcagtatgatactagatgtgggtctgttgcatatagcttttattatgttgaggaacgttccttctatacccagtttttttagggtttttatcatgaagcaattgaatttcgtcaaatgctttttcagcatcaagtgaagtgatcatacggtttttgtcattcattctgtagatatgatgtatcacattgattgatttgcctatgttgaaccatccttccatccctgggatgaatcgcacttggtcatgatgaatgatgtttttaatgtgtttctgaatttggtgtactagcattttgttgaggatttttacatcaatgttaatcagatattggcctgtagttttctttttatgatgtgtctttgtctggttttagtatcagggtaatactgaccttgtagaatgagtatagaagtattccttccttctctatttttcagaatagtttgagtaggattggtatcggttcttctttaaatattttgtagacttcagcagtgaaggtattggttcttttctttgctgggagactttttattatggcttcaatctcattacttattgctgtattcaggttttggatttcttcatggttcaatcttggtaggttgtatgcatctaggaatttatccactacttctaggttttccaacttattggcatatagttgctcatagtagtctgtaatgatactttgaatttttgtggtataatcatgatgtctcctttttcatctctgattttatttatttgggtattctctcttttcttctttggctaaagatttggcaattttgtttatctttcttagaaaaacaacttttcattttgttgatcttttgtactgttttttgtttgtcttaatttcatttattgctgctctgatctttatttctgttcttctactaatttgggcttgattttctctagcttttctagttctttatcatgtgtcattaggttgtttatttgtagtttttctacttttttgatgtaggtgcttattggtataaactttcctcttagtactgttttgcctatcccataggttttggtgttttgtgtttccatattcatttgcttcaagacattattaatttgcttcttaatgtcttcagtgacccactggtctttcaggagcatattgtttaatttccgtatgtttgtatcatttccaaagttttttttattgatttctagttttatgctgttgtgggttagataagatacatatgatttcagtttttttaaagacttgttttgtggcctaacatatcgtctgtccttgagaatgattcgtgtgctgaggagaagaatgtgtattctgcagccattggatgaaatattccataagtatctattagatctatttgatctgtaatagagattaagtccaatgtttctttttttttttttttttttaagatagagtcttgctttgttgcccaagctagagtacagtggggcattctcagctcactgcaacctctacctccaaggttcaagcgattctcctgcttcagcttcccgagtagctgggattacaggcacgcgccaccgtgcccagctaatttttgtgtttagtagagagggggtttcaccatgttggccaggctgatctcgaactcctggacctcaagcgatccgcctcccaaagtgctggaattacaggcctgagctaccacgcccagcctcaatgtttctttattaattttctgtctggagaatctgtccaatgtttaaagtggggtgttgaagtctccagctattggcatattagggtctgtctctctctttagttctaataatataataatatttgttttatatgtctggatgctctggtgttggttgcatatatgtttacaattgtcatatcctcttgctgaattgattcctttatcattataaaatgaccttccttgtctctttttatagtgtttgtcttaaaatctattttttctgatctaagtatagctactgctactctttttgggtttccacttgcatggtatatctttttccatccctttattctcagtctgtgtgtgctttttttttttctttttttcttttttgagatggagtgtcactctttcgcccaggccggactgcagtggcgctatcttggctcactgcagtctctgcctcccgggttcacgccattctcctgcctcagcctcctgagtagctgggattacaggcgcccgccaccacgcccggctaattttttgtatttttagtagagacggggtttcaccgtgttagccaagatggtctcgatctcctgaccacatgatccgcccgcctcggcctcccaaagtcctgggattacaggcgtgagccaccgcgcccggccgtctgtgtgtgtttttataagtgaagtgtgtttcttgtgaccaacagattgttaggtcttgttttctaatccattcagccattctgtgtcttttgattggagagttaagttcatttacattcagtgttattattgataagtaaggacttactattgccattttattatttgttttgttttgtttttttctagttctttgtggtcttctctttcttccttccttcctgtctttctttttgtgaaagtgtttttctctggttatatgttttaatttcttactttatattttttgtggaactattgttagttttttggtttgaggttaccatgagccttgcaaatactatcttataacccattattttaaaccaatgacaacttaactttgattgctaggagttaagagcaaagagacaactgataaaaactctacactttaaattcatccccccagttttaaacattttattttttctatctatattttataatagtatgtctcaaaaagttgtaggttttttttttttttttttgagacagggtctcactgtgttgcccaggctggagtgtaatggtataatcacggctcagtgtagccttggcctcttgggctaaatcagtcctcacatctcagtctcccaagtagctgggactacaggcacgcaacaccatgaccaactaatttttgtattttttgtaaagacagggtttcactattttgcccaggcttgtctcaaactcctgggctcaagcgatccacccaccttgccctgtctaggtgctagatcacaggcatgagctaccatgcctatagttattattttttagatcatctcttagttgtcctactcaagatatgagatgagtaatttatacatcacacttaacagtgtataatattctgtgtttgtctgtgtatttattgttaccagagagtttggggccttcagatgatttcttatttctctttaatattcttttatttcagagtgaagaacttcctttagcatttcttgtaaaataggtctggtgttgatgaaacccctcagcttttgtttatctgggaaggtctttatttctccttcatgtttgaaggacattttcacaggatataattttgtaggataaaagtttttttccttcagcagtttaaaatttgccattctctcccagcctgtaaggtttccactgagaaatctgctgccagacatattggacctcctttatatgttatctgttatttttctcttgatgcttttaggatcctttctttatccttgatctttgggagcttgattattaagtgtcttgaggtggtcttctttggggtaaatctgcttagtgttctgtagccttcgtgtacttgaatattgatatctttctctatgttttgaaagatctttgttaatatctctttgaataacctttctaccctgatctcagtctctctctctctctctaccttttctttaaggccaatacctcttactgccctttgaggctattttctagatcctataggtgtgcttcattattttttattcttttttcttttgactattctgactgtattttcaaatagcctgtcttcaagcttactaatttttttctgcttaatcagttatgctgttgaaagactctggtatattcttcagtttgtcaattcagttttcagctccagaatttctgcttgattgattttaattatttcagtctcttagttaaatttatctgatatgattctgagttcattctctgtgttatctttcattttgttgagcttcctcaaaacaactatttctaattctctgtctaaaaggtcacatatctctgttactacagacttggtcactggtgccttatttagttcatttagcaaagccatgcttttgtggatggtcttcatgcttgtggctgttcatcagtatctgaatatttattctaatctttgaagtctaggcttgtttgtacccatccttcttgggaaggctttccaaatactcaaagggaattaaatgttgtgatctaagtctggtcactgaggccatatgtgcattagggggcaccccaactctagtaatgctgtgagtcttgcagaggtactctgactcttatagaggtactgccgtggtggtcttaaataagatccaggagaattccctagattaccaggcagagtcttgttcttttcccttacttttccccaaacaaacttaatctccctcttcatgctgaactgcctggagttggggaagggttaatggaagcactcttgtggccaccaccactggtactgtgttgggtcactcctaaaaccagcccagtactgggtcttgcccaaggcctgtggcaactattttctggctgctgcttgtgtttactgaaagaccaagggatctttagtcagcaggtggggaatcctgccaagaccaggttttttttttttttttttttttttttttttttttttcagtgcagcaggtccccttctggcccaaggtgggtttagaaatgccgtccaagagctagggcctgggatgggaggctttaggaatcttcttggtgtttattttaccaggttgcaagacaaagtcctctttacttttccttctcctttcctcaagcagaagtctctccctatggccattatcactctaggctcagggcagctaccgcttggctgccactgatgtttattcaaggcccaagggctttttagtcaccactggtgagtcctgcgaggcctgtatctctcccttcaggacagtgaatgcctttctggcccaaggcaagtctagacatgccctccaggagctaaggttaagattagtacatcaaaaattatttgagtgacccatttttcagttctcccaaggattgtacacaactaataccattctagatgcataggagataagttaattattagggtttaattctttggaggaactagttgagaatgattgtaaaactgttctaactggatgttctcatatagcatcagtgaagactttctcattgattaactatttattagctggtatttaacagtcctttgtaaatagtaattggtcttttgacagatgttcagttttataagtagactcacatgtttatgtttcctgtgacaaatgacagttaacaacatatcaaagagtataatgttgttcttcagactgggcatctatctatacagtagaatgaaaaggaagaaataggtaacagaaaataatgaaaagaaggccttgatgcttctgaagaagttatgttaactttgaatgcttctctagcactaactttattaatgagtcccactggttctgaatgacctggtgtgttgtcagtgtgtcagaagacctctatgtgagaacagtcatttggaatatctatatatactatttggcttacttttacaagttttacctatgtaaaattaatattgaaagggagcacctgattacctattagaaagaaaaattacaatttccctcagctggtcacaatctgaggcatgtgaagcaatgtggaataatgttaaaatcttgtatttagagacggaaaacctggatataagcccttacctcaccacttaataattcggacaagttacttaaaatttaagcttcagttctcatctataaaatggaaataataattatcctgtatctcacaacagattattatttttagtacaggagatgacatatatgaggaaatttttataaactttgtaaattaagaattaagtatttgcagaattctttcaaggtaccaaacactatcctcactgctcagaatacaaatataaacaggttgttccagcccataaaaagttcacagtctagggcctgggtgcagtttctcatgcctgtaataccagcactttgggaggctgaggtgggcagatgtcttaaacccaggagtttgagaccaacccgggcaacatggcaaaaccccatctctactgaaaaataaaaaattagccagacgttgtggcacatgcctgtagtcccagctacttgggaggctgaggtggaagaatcacttgagcccaggaggttgaggttgcagtgagctgtgatcatactactgcacttcaacccaggtgacagagcaagactctgtctcaaaaaaaaaaaaaaaaaaagagttcacagcctagctgaagagttgcttttttaaattacttctttaccttcctaactcagttatctacttctagtaatcaaaaagtgaaacttggtcaatgtactgactgttcagtagttactaatgagctcattgctacttattgcaaaattaatcagcttgctatttcaggagatagagacttaagaaattcctcttgtaattgacatttgttcgttgtctgtccagcagtcattttccattccctcttcctagcactgtaccacatttcccagtcatgtagtttgggtggaattgattaaacctccagtgtaggttgtcttaatactgtataatcaacatacccatttcacctagccacagtcattagttaaaggatcatgtaattcaaagcagtcagagccagtggatttcatctcttatattttaatttaactactgggggacacagattctctgtttcctgctgaacatgaatgaggaaatatacaaccccaagaattacgtcttgggaccgtgaatggaatgcctgctatgatggaactagcataagaaacaatcctgagaaacagaagtttaaaagagatactgggtcccagtaacattttgtgaaccactcattcaagcccttcttgaactatacagactgcttgactttttggttacatgagccaataagctaatagagataactgttgtccataactaaaaagtatcttaactattataatatacctgaataagtactgtatcatcaaagaaataagacattttcctaataatgactaaaatgtatcaaataggaatccctgaagtttcatatttcagtaaaaaaacctgattcaagaggatagagggttggaaaatgtgacttaaaggaggaagaggatgaaaataaatcctgctcctctgtatttataaaataaatgaagatattttcagagagactggatccaaatctgaaggtgacaacttatgctttgcagcctcaaggcaactgataggttcaaaactcaaagtaataatattaacaacaggcaaagaaagaatttaagacaaagagggaagctatccttggagatttgtaataggaaatctcatttcactgacagaaattaaatcttctggagaaatccaaaacaataatgatgctccctaagctgtattgtatgaaagaacatctactgattgccctgggaagaaaaagagttggtgacttcttcttggtaaatgatacggaaaaaacaatatttttatccatatcatttgtatatatattatatatatatgtgtgtgtgtgaatatatatatgtgtatatgtatatatatgtatatgtgtgtgtttttatatatatataaaacaaacatgctgtatgttatgtttatcaaacatgtacatatacatgtatacaccaccgcatggtggctggcacctataatcccagctacttgggaggctgaggcaggagaatcacttaacatatatgtgtatacgtgtgtttatgtatacgtatacatgtgtttatatgtatacatgtatacgtatacatgtgtttatgtgcacgtatacatgtgtttatgtatacatatatattaaaactatatatatacagttttattgtttccttttatccatgaggattttgagatattaaaataattatattaattgaataccaatcattctctaagcattttatatatatcagctctttacgtaaatcctcattttgcttgtaagaaatctgaagctcatggtagttaagaacatggaactacttagtggctgaactggtattcaagtctaggcagtctgattctaagatgggaattcttgactactctgctatagcacctttcataaaagaaaaagtaaaagaagacattttgggaggtgacaaactaattataaactctcctcaaaaatgagaattggggtccaggtgcggtggctcacgcctgtaatcccagcactttggaaggctgaggtgggcggatcacctgaggtcaggagtttgagtccagcctagccaacatagtgaaatctcgtctctactaaaagtacaaaaattagccaggcgtggtggcgggcacctgtaatcccagctactcgggaggctgaggcaggagaatcacttaaaccccggaggcagaggttacagtgagcagagattgtgccattgcactctatcctgggtgacgagaaactccatctcaaaaaaaaaaagaaagagaaagaaatgggattttttaccatggtttgaaatacttaagtgataagatgcactgcccaatctaagaattgtaaacaatcgaatgtcgaatgtgtttactctggaagtttactgatccaagcaaaaaagctttaagctataaacatctgtggagtaagaagaatatatagataaatcaatataatgaaatactttggagaatacagtatgatacatgttaaaagatagttttataaaggttgagttataacacttagaagtataaaataaatatgtgccaaagattttatttaacttattaaataatgagagaactagtaagctgttacaccaattcaaacaagaatggaaaggacacagacatatgtcaacagtcatgaagactggaatgaatttataaatagaaaatttgtgcaagatatacaggccaatgagtagttgctcctgatcaggactaaacttatttgcatttctatggacaggaatcattacttacattattattagttttcttcaacttgcaaagttgtaaaatcgtgtaaaacaatgaaaagtacagataactcagaaggatatacaagtcagggcattctagtaatcttagtaatcgtgaagataatttttttttccagacaggagcttgctgtcacccatgtcggagtgcagtggcacaatcacagcttactgcagcctctaccttctaggctcaaacaattatcctgcttcagctgcccaagtagctggggactacaggcacacagcaccatgcccagctaatttttgtattttttgtaaagacagggtttcatcatgttgcccaggctagtctcaaactcctggattcaagcaatccaccctcctcaacctcccaaagtgttagcattacaggcatgagccacagagcctggcctctaagatagtttttatttaccacaaaaaaatgtgtttgatctcattaggtttgggctgattcgttacataactggagcaatttttttttttttttgagactgagtctccttctgtcgccaggctggagcgcagtggcacaatctcagctcactgcaacctccacttcccgggttcaagtgattcctctgcctcagcctcccaagtagtgggattacaggcatgtgccaccacacccagctaatttttgtatttttagtacagacagggtttcaccatgttggccaggatggtttccatctcttgaccttgtgatccggctgcttcggcctcccaaagtgctggattacaggcatgagccaccgcacctggccgcaagattattaattaaccagatatcctccttaagtttgttttacaaataagaagaccacaaaattaatttttgtctggaaattttcttagggaatctcagattctattaggttgttaaaaaagtaattgcggtttttgccattacttaatacttttaaaggtctctatttttgccaacccaagattagtaaactatgcccaagaaacttcaccatcatcatcattttggtaagttcctctcttctccaggtcaccaaaattttattcccacatgtaagtgatcttccttaccacataaaaggctgaaaccttctgctccaggtactaggttggtttctctgggagggcattgtcaccattggcttcaggagtacagccaatatttttttcttcaaagtggtagtgatatttgattagatgaccatcattctcaaatatatctccaggtaaggccttggttgcacaatcagtttgtacaattatatcctgtttaaaaggaagacattcttattaggattgcaaataactatactgtcaagaaaagttaggaaattactaagagtttctgaatttggaggaagtcagaatcaaatattattttgaaatgtttcatattagtttaagaaatcagggtctactaaattgtgtgggttacatatagcttaaaaagaagaaaaagagcttcctcatgtatccagaaaatagaacatttaaaacaaccagtgtcaatactactccaaacaaataggaaaagaaatttccttctgtattcctttttcattctgtgttgattcagtcctgtgataattaattattattcaaataagccttggcttagcagtctgctttcatgaaactttctgcttctggcctgagagagttttagaaattctaactcagtccactgtttaggtccaaaagttgtccaagcagaagtctactcatgagtctattctttcaagtattagtactttgaagtatttggtacaattctttccatgaagcttttgaaactatctctgttgaacacacaaactctggcctatagcttaataagcataatcttcaggtaaacatcaaaatttgttcatagatgacagactattgttaattgtaaccaataatatcaaaatgcaagaggttaaaattctttccactgggggataactatttcaaaagagttttgatcagtatccccttaaactaaaaactcttgcaaatatggtcaaatgatttttgaccagggaaccaagaccattcagtggggaagacagtcttttcaaaaaatggtcctgggaaaactggatattcacatgcaaaagaattaatttgaacttttatctaacaccatatacaaaaattaattcaaaatggatcagagacctaaagctaagacccacaatacaactcttggagtcaaaactttatgacattggatttggcagtgattttcttggacatgacaccaaaggcactggcaacaacagcaaaaagtacacaaattagactgcatgggaattttaaatctttgcacatccaaagattctatgaacagagaaaaaggcagtccacagaatgggagaaaatatttgcaaattatatacctgataagagattaatatccagaatatacagagaactcctaaaactcaacagaaaaacaacctgattcaaaaatgagcaaagattgttgtagaaaaaaaacaggttcttgtcacaagaccagaataatttaggcatgtggacacattgtagggtgagtagggcaggatttattggatgaaaaggaaaaaaaaagggaaattggaactcctggcaaagcaagagagaatcctgctagcaggtttcctgcctcacagatttaattgcaggccaccccacacgcaagctgaagaccccaggctcctcccctctgcaaatggtgtgggattccaaacttcccgtaactccaccccatcctccccgtgccagtcagagattctccagggatcctctgccttatctgcctcctgcatctatcattccccctctgaagacatacatttaactgccgttaaaataaggataaggatgaataccaatcttaactgcttcctgctggtaaggggcactgttttggtaaacagcagtcacatctccttcagaggcctatctaagggtccccaacaaaagggaccatcggccaagcctccagttgcatgaccgtttggaggttgatggcctgaaggtgacaagagagaaaccaggttattagaaaacttgtatcaaaatgaaacaaggggcaggtgaggacagctcaaaaatctcgtgtcctttgaccagtctgtacagggagaagggggaccaaaagcttgaccggtaagaaaaacttttacccttttgctagcatttcagacttctgggttcctgtcccctgagctcaatcctaagccaatcagtttaaggtttgggaaattaactcttctcagtttggaagatgtatccaaagggagtgtcccatagtatggagacacagttacctatctgtgaagagaggacagggaaggaaaaaggaaaaaaaaaaaagaaggcgttttgttgttgttttttttcagaggagtcccagtggttcaggatgcaattgaaagggatacagactgaagattaatgactactcatgtagaaagaggggagcaggtgtccctggttcctttttcttcctagcatatacccgaggtatgtgagggagggaaagtgaggtgttcctctttctttcctccatccttgtatcccagtgactgcaacagggtgccacccataggttttaaagtggctttcacccatgttaacagggggagctaaggggtgggaggtatcagcttttaaccacatatgccctatctccactgctgtcagtagccttgaattccccagaccccatttatgcgatggatactagcataacctttattcatgaaacaagaagcttggcttaactggcaggaatcagtcatgctcacctgcattgtgccttttaacttccattaccgtctgcctctggattcctcagatctagtgttctttcctagggcgttgacccatagcttggagttgagtttgagacaaaaatgtgtcttggggtggggaggagttgcatggactccttatcataagctgaatgctaaggtgaagctgtggaattgagtcctcctccaacaagggagagaaaaggatgtctcatgacatgcccaaataactgttggctatattcatgcttgctaagatttgggtgcatggtgcttggctttggttagctcccttggtcttactttcccaaaaaggaaacctggatgggcatcctatttattgccatcacctggcaggatttgcaggttaattgctcagaactagaatattgatccagatttctacatcacctgtcccttttgttctttctgagctacagctggagattgctggaacatgcagggttagtctaaaatgtaggttacaacttaaaaacaactaggagtttagaatgtaatgacaaatgtataaattgtgaaacataatttctctctctccagtccttattttcattaaaaaaaaaatcatgataggactgagttgtttgcaaaatagacttagtcttatatttagcctgattatttgcataaagtacagcaagaataactatttgtaaataggccttttagactggctttgatggaactctattccacaaggaatctcagataagaccttttaaagtgaagcccagccatgggtttgtagcctcaaatacctgtgagttaggtgatcctctcctcttaaggtcccaggataaacttggagatcctgggcctgttagaaagagacattctttactgaccacagatcaggaaccctatacagggactgggtagacaagggtatgaggccagttttctcaattggcttttatgagctctgcaagtcaagcttgactcctgaaagggaaacacacccttccagtcaaagccttggtaaaaaaaaaaaaaacttgtttctccaattgcatcctgttgcaaaagaaaatggacttttattgcactgatccaaacaactatattgccagaagttaagaatactcacagatactttccaaattctagagaaaccaggcagagagaaacacacgttctccaaattttgttcacagtataccttacttgattattaagggctgtaaatagttcaaaatcagtttccatgaatctgaaaaataaaacaaggatcagcaatattccaaaaaactcaaaaagattgcttcagttttctgcatttagtccatttagttaagtctttgtgttgttgtttacttgtttgttttgagacagagttttgctcttctcacccaagctggagtgcaatggcatgatcttggctcactgcaacctccacctcccaagttcaagtgattctcccgcctcagcctcccaagtacctgagattacaggtgcctgccaccacacccagctaatttttgtatttttagtagagacagtgtttcagcaggttggccaggctggtctcaaactccatacctcaggtgatccacacacctcagcttcccaaagtgctgggattacaggcgtgagccaccacgcctggccccatttagttaacttttgtgttgcttaatattgatgaacattttatttctttatgagtcctgtacgtttttcctttattccaatgtcactatctccaaagttattagaaacctgcatttgagagcacctgttagagtcctataggtgattataaaccatcttttgaaaaggatcaaaacaaaacaaaaattgtctgaataacaaaatgtccagggtagttacagttagaatcaccattgacagagaagtttggttatctttgtggtttataataacttgacataacaaccttaattatgattgatagcatatactttagacattagaatttttgaaatttcctacaattttgggacatatattagtattattccccaaaatatatcctaaagtagattaaacaccgtttggcaatcccatgtaactaaatatgccaaataatcctgtttacttcttttctagatgccccaggggacctctgtagcactcaaaaagccaggtatcaggaaaaacaattttgaaactgaagtttgattttgggaagcctattaaatatattagaggtttaaaacaactattgttatgaaatagaattccagattaccatgaattatttattttgccaaaatgatgactcagatactttaaaaaagcaaaaacttattatgaccctttacaaattttgcaaaagagcagattagtgccttaagagtatcttgtgctttcatttcaatgctcagttcactgaaaaaccatataatacctttttgaatttagtcaatatgtttacacatggaatttttttcaagatttttacagtccttctaccacttgtttgaactttgagctttattttatctaattcaaaacaaccctttaacactaggcaagaatttacatttttatgccttttttataatcttttactaaaaacacatcttattagtcttacatgcctcacatgtaaatttatttccagtagtttgagttatatgttataatggtaactccttgaaattttttactttaatgtaaaacctgataagttgttttcattatgtgctaggtgctgccaaggcttaactccttccagcttaattaaagatgcggttagtactacatgtccctagccttaccatttatggagcaggcaagtcaaatagttctttaaacccaaaaagcagtttataaacttaaaacatttagcaaacctagcacctgacctgcatagtttagtccacctgtttatattttaatgacatctgctttttaccaatattctttaagggttgtttttatttctcaaagattaaagtcacatgaactgaaaggcaccacaacttttatcatccctttaaaaatttttttgatccaagcactatcttcctttaagccagttaattagagctctttttataggcatcacacacacaacacatatataactaaacagacaggcaaaagaaaacccagtcaccataagatcttttgcttaccaatctcctaattggattattggatatagccctttaagagacagggctaggaaaacatgcagcttctaaaacctaataaacaggcatagatggggcaaaaacagattttcagagggatctatccacttttaattcttggggttccatgaagaaaatagaggtctttccccttcatgtgtgcattgagggtggcaagacaaacggagaaaaataattcagtcaactgagaaaaaaaccctttttccagaaaaacaagatccaagaaaagaaaaacataaaggccatttaaatatacctataatttgaatatccacttttaattaagccgagcactctttttaagaatttccttttaactcccttactacccgactttagcgatgccaagtggccaatatttctggctttcaaactttactaaagactcagagaaaggaaaatccaaggcggttcatggaggggaagagaatcaataattagcaaaggtcacacaaatatcaaactggaaaggactcattgaatcccaggccaccattgtaaaatggcagaggctagaacaaaacattgccacatggttacaggctttgctcccaaggacataaaacaagatggaggcctgcagcaaagtttgctactgaccatatggaaagtcatgcaaatcacaccagattggttacagcttaaggccaaaataacaaatcctttttcacaagtaaaactctacagagaatataaacagtgatccccattattcctggtccagcaaaatctcttccaaaaggaaaaaaagaaaaacaaaccctcacttaaaaataaattcctgaccctgtggagaaaaggaaaagacagcttaaatgcagggctgtattaactgctaatagggtggagaaaagaaaaagatgcctggggaagaacttcgtattcttatgcaaataagttcttccaccagtgagaaaaacttaatcactttcccacagagtgaaacccctttccctggggaggggaaggctccacagatgcaatgcagagagcattggccagcctgccattaggcacccttgggccatgcatcccagccctggcagggagaggagtgcaggagctgccattctgtggtccatcttgcgcatgcctgcagctgttgggatgaggtggtgcacagtttcctctaccctccaaagaggtctgaggagaaagagacatagaagtgaaaggaaaaaagatttttagacttgcttggtacttaccttttctcaagccccatgttgggcgccaaaaatgttgtagaaaaaaaacacgttcttgttacacaacagggataatttagttgcatggacacattataggatgagtagaacgggatttattgtgtgaaaaaaaaagggaaacaggaaacctcagcaaagtgagagagattcctgctagcaggtttcccgcctcacagattgaattgcaggccaccacacatgcgagctgaagagcccaggctcctccccactgcaaatggtgcgaacttctaaacttcccatagctccaccccatcctcccagtgtgcaggccagttggagattctccagggaacctccaccttatctacctcctgcatctatcagtatgaggatacaaaggcataagaattatacagtggactttggggactgggggaagaaagtgtgggagggggttgagtgataaaagactacacactgtgtacaatgtacactgctcaggtgatgggtacaccggaatctcagaaatcactactaaagaaagtattcatgtaatcaaacaccacctgcttcccccaaaaaacctattgaaattaaaaataaataaataaaaacaaaagtgagcaaaagattcgaatagacatttctcaaagaagatttgtaaacggcaaatcttgaataccacagttttaaaaaggtaaaagaaagcagtgtggacagggagagcattaacagttctctggggactttatacaaagcatacaatttttaatatgtttacattaataaaattttccctatagacatataacctagggaagactgggcttctcttttgatattgtaactctttatctgtgcttaaagaacaaacttttgtgatttctattggctttctgggaaatgtcaaagatagttttatttctttttctttttttctgggcctgtggactttgtagataagtacaaaatagttttacattccctgaaatttttttttaatttattttatgtttgggatcaaattttgagttatcagaggaaacttagacatgtaatttaaataggaccatggatacttgagaaataatttttgattgtctaatcaaaatgataatgaaatattttttttaaaagcatgaaaggtaatacagttgttaagaagtgaggaacttttgttctttggggttttttccttaaatacccaaatacgtaataaagttaacatataggagagaaaattaatctggtaagacacagaatctctgctatctaggcagatgatgtagatcctaggtaaaggcattaatcaccaaaccagccaagaaagccatcaaaattaagtgaactttgttgatatgttaacacatttattttttctttttttgacacagagtctcactctttttgcccaggctggagtgcaggacacaatctcggctcgctgcaaactccacctccggggttcaagtgattctcctgcctcagcctcctgagtagctgggattacaagcacgcactaccacacctggcagatttttgtattattagtagagacggggtttcatatgttggccaggctggtctcgaactcctgacctcatgatctgaccacctgggcctcccaaagtgctcggattacagacgtgagccactgtgcccagctgagaaaatatattcttaagtgaaccagttttataagtatattataactgttagtattttcatagataaaaaactagtctgctactctaaatgccattttaagaaatcctgtgagacttattggtgactcttctagattcacttggcattataaattcccagggaacaacttggtctaatcaactatcatctatcatctttcaccttaattatttcagtggctggtctcatcatttccacccttgcctcccttcaattcagtcttcaacccatagccagagtcgactttttaaaataaagtaaataatgtcacttctctacttgaacccttcaatggattcttatcacattcattgttaccaaaactccttgacatgttctgctaaattctgtataatctggctcctccctgatttctaggctcttctcttaccatttctctcttgtgctttattgcttactaagctccatatagctttttctttcctcagggaatttgctgtccccattacttaaaatgttcttaaacctactctttacctggctaactcctgtgcattctttctgttctggtttatctctttctcacagaaggaattctgtgatccacactgcccacctaaattatgcctgcagttattctctatcattgcaccttgttattttcctttatagcacttatagttacaattatatacttattcatgtgtttacttaatttatctctagaactgtaggtgggaagatccatgaggacatgagtcacatctcttttattcatatggtctatccagcacctagcacaggttggcacatagtatggactatataaattttggtaaatatatcccatgaaaacatatgatgcatcattcgtcttgatggaatcaatgtctattaattaaattcttaagactgacattttaaaaagggatatatttcgccatacccatgatgtataagaattgttccatggccaggcacagtggcttacacctgtaatctcagccactcgggaggctgaggtggagggattgcttgaggccaagagttcaagaccagcctgggcaacatagtgaaaccctgtctctacaaaaagtaaatttagctggatgtggtggtgtgcacctgttgtcctagctatttgggaggctgaggtgggagaattgtgtgagcccaggagtttgagactacagtgagctgtgatcacaccaatggatctccaatctggatgacagagcaaggcctatctcacagaaaggaaaaaagaaactttcatgaaatagacaagtagtcaccatattctgttcctatattaagtaaatatattaaatgaatataataatgataatagagaatcatttttgaatgctaaccataaaacattcttctatgcattttataagtgccataagaaattaatactggcatgcagatttcagcaagagtatacctttttgttttcctaaaaggcaattacacgggaaaccaaataataataaggatggattactaccattgagagcaacaaaaattctgaaatttttaaagcaatgagagaataactttagtaagtataaatattccttgtaaaaaaaaacaagcttatatgaatatttaaatttttaagtttataaaaaagatctcttgatagtcatacttcatatgtttgccatctaagtggtttttcattataaatatgaatcatgaatttttgtagatttttgtattatgaatttttatctaaatttaggtattcacattttttgttaaatttcattttgttggattcagcccatcagtctactaagaggtctttttaaaatttatatcagctgtctagtatattacttgtcttttgtagtttctgtcaccagcaaatatgttaagcatgctttcattcaagtcactgataaaacttttttttaggctaggccatttcacatactaccagaaaccctgctggttgtaattgcttaactagcatatttctatttcaacacatcaaaacctacagacctactttctctatcgacaaggcatttatgcgtgacttatcaaataccttaatgaactcaagatacattgcattgacaagttttgggaggttgtttgtttgtttagatggggtctcactctattgctcaggcaggagtgcaacagcacagtcactgtatcctccacctcctgggctcaagcaatcctcccgcctcagcctcctaagtagctgggagcacagggacagttttttctttaataaaactttgtaacatttaattataacctctgaaggatcagtattagaagctctgagaagacatgtgatatatattttctgatataacccatttaggtattatatgtaatcaatcttttttgttcttgtttttgtttttctttctaagacagagtttttctctctggctcaggctggagtgcagtggcacaatctcacctcacgcaactttcacctcctgggttcaagcgattctcttgcctcagcctcccaagtagttgggattacaggcacatgcaatcacacgcagctgatttttgtatttttagtagagacagggtctcaccatgttagccaggctggtctcgaactggctggtctcaaactcctgacctcatgatctgcctgccttgacctcccaaagtactgggattataggtatgagtcactgcacccagcctgtaatcaatcattattgttagttcaggtgctgtatcacacacctggatctcaaataggatttatagaaaatgcagcctaccttaatgatctctaaaaagagaagttggaaagaaagggtgcacattttggacttggccaccaagctggtcaagggatccaaaaacctccaccatagagactgataaattgtagctattgaagctgtacttctttgtacataggtgctttgggagactcactctgattattgtaaatttgctcactagctacccaacattaaattcaaataacagagaatttctattgtacagccttgcaactttgctttaagtttaaacttttctttaaaataaaattttaagtggcaaaaataattattagaagagaaaatgtgtgctcatttttgaatattcttggcatcaaatataaatttgtatgtttactttattggcattcatactgccatttcaaaggactgcagcattcaaaaggggaaacaatattttgactgtgtattctgatttttataatgtaactctccatttcttcttttaaaagtgcctgcccaaccagtgaaattagctttaggacaggaaaaaaaaaaaaaaaaaaaaaaaaagcatagataaagaatcagcacagttcctaggaaaattatgtgttcccattacagttttccttaatgaggaaaattctgttatttaataattcacagtcaaaattacattgcatatctaaagaaagtttgagattatctgggacaaattgtttcctccatgctatgagttgcataagatagtagaaatagattacttctctaaaagtaggaatgttatttcttttgtgatttggcatttttccttctcatttgttctgatttaactcactacaaattctacttgctcaaggtagatcctcactactccatggcaagcctttggttcatctctcttactgacaaccttatatacattgccaaattgcaattttcagacctttgctcttgactcaatttcccctattttctcctcttcttattatattaaaggccatcagagctaaattatttgttctttctatttaaaacaattttcctgaattaatactttgctctattccttctatctcaaagaactgcttgtaattctcagttagtggctgcttctacttccttattattagatatcatctatgtacgagacactgtattcattccttgtttctccctagttgttgagtatgttggccacttattttctgaaacagtcccccaccatgttttcattactgaaatgttttaattaggcaagaacacatgagcacacactcactaaaaaaagaaaatgaaacatagataagattaatatcctttttgaaccaccctctcattcatttttatttaccctcacactcccccaaaagtaaacatttttatcattttgaagggtatccttcaaaagttttctgtacttttctgtaaaaacataggaaataaaatcctaaggtttttgtttgtttgtttgttgttgttttgtttgttttgagacggagtttcactcttgttgcccaggctagagtgcagtggcacagtcttggctaactgcaacctccccctctcaggatcaagcgattctcctgcctcagcctactgagtagctggcattacaggcacctgccaccatgcccagctaattttttgtatttttagtagaaacgggatttcatcatgttggtcaggctggtctcgaattcctgacctcaggtgatccacccacctcggcctcccaaagtacagtttttaagtggtgtgcgtgtgtttaattaagaaagggataaagggccaggcacagtggctaacacctgtaaacccagcactttgggggccgaggcaggcagatcacaaggtcaggacatcaagaccatcctggccaacatggtgaaaccccgtctctactaaaatacaaaaattagctgggcatggtggtgcatgcctgtagtcccagctactcagaagactgaagcaggggaatcacttgaacctggaaggcggaagttgcagtaagccaagatcgcaccactgcactccagcctggcaacagaacaaaacttcatctcaaaaaaaaaaaaaaaaaggaagggataaagaaacttgcaagctgcttctaaaatttatatagatagaattgcaaagggcaaaaaaacaaccaaaatagtgttgaacaagaaaaagatcaaagtgggaagacctgctctaccaaatatcaagatttagtataatgatacgattaaagtaacttcttaatggtgccagaattaatatttagaccaatggaacagaatttaaagcccaaaacacaccaacacacatatggtcacttattgtatgataatttatagtgcagaattatagagaagttattttttcaataaatgatgctgggacaacaggctatttatatgaaaataaatgaaattggaccccctatctcacagtatacaaaaatcaactccaggtgtattagagatccaaacaggaaggaggaaactataaagcttttatagatttttacagaacaatgtttttattatgctggattaagaaaggatttcttttttaattgaattgaagtaaaattcacataacataaaattcaccattctaatcattttaaagtgtgtgattcagtgacttttactacattcacagtgttgtacaactattttatccaattccagaaaattttatcaccaccgctcccaaaaaaacaccttactcattaaacagtctattctccattccctctgcccccagcccctgacaaccattaattggctgtctctgtaggtttacttattttggacataacatataaatgcaatcatacaatatgtaactctttatgtctagcttctatcactaaataaacaacattttcaaggttatccatgttgtagcatgtatcagtactcctttttatggctgcacaatattccattgtaaggtatactgcatttagtttatccatttattagctgatggtcatttgggttgtgtgtactttttgattattaaaataatggtgttatgcacattcatgtatgtttttatttgaacacctgttttcagttctcttgaatatacacctaggagtggaatttgttgtaatatgataattctatgttaacttttaaggaagtgccaaactattatccatagagctgcatcattttacatacccaacagcaatgtatgagggttccagtttctctatatccctgccagcatttgctttttttcttcttttttgcttttgagacagagtctcgcactatcgcccaggctggtgtgcagtggcccaatctcggctcactgcaacctcagcctcccgggttcaagtgattctcctgcctcagcctctcaagtagctaggattacaggtgcccggcaccacgcctgactaattttttgtatttttagtagagaaggggtttcactatgtttgccaggccggtctcaaactcctgacctcatgatcttccagcctcggccccctaaagtgctgggattacaggtgtgagccactgcaccgggccttctttttttcttaattcttatcatctgaatgggtgtgaaatggcatctcattgtggttttgatttgcatttccctaatgactaaggatgctgaacatctcttcatatacttgttgatgatttgtgtagcttctttggaaaaatgtttattcacaccttttgcccattttcaagcgggttgttggtctttttattattcagttgttagagttctttacatattatctggatgctggactctatcagagatatgatttgcaaatatttcctccctttctgtattttgtcttttcactgtcttgataatgtcctttgcacaaaagtttttaagtttaatgaagtccagttaatctaatttttctgttgttgcttgtacttttggtgtcatatctaaaaatccatcaccaaagtcgtgaagatttacctttatgttttcttcttagaatttgatagttgagctcttataatacaattaggtatttgatccattttgacttaatttttgtgtatggtgtaaggcaaggcttcaacttcattcttttgcatatggatatgcagttgttctagcataatttattgaaagaatgtcctttccagttaattgccttggcactcttgtctcaaatcaattaagtataaagttaggagtgcttatttctggaccctcaattctattccattaacctatgtttgccttatcccagtaccacactgttttgattacatagctttgaagtaagtttagaaagcaggaattagcctgacacggtggctcacacctgtaatcccagtattttgggaggccgaggtgggcagatcacttgaggtcaggcgtttgagaccactctggccaaaatggtgaaaccccgtccctactaaaaatacaaaaaaattagctgggcatagtggtgggtgcctgtaatcccagctacttgggaggctgagacaggagaatcacttgaacccaggaggcggaggttgcagtgagccaagacggtgcgattgcacgcgagcctgggcaacaagagcaaaactcggtctcaaaaaaaaaaaaaaaaaggaagaaagcaggaattatgaatcctctaactttctttgtctttttcaagattgttttagctattaggttccttgagattccatatgaatttcaggataggtttttctgtttctgcaaaacacaccagtgggatttgacagtgattgcattgaatctgtagatagctttgggcagtattaccatcttaacaatattaagtattgcattccattaacacatatgtctttctatttatttgcctttaatttctttcagcaatgttttgtaatttttgatatacaggttttataatttcttggttaaatttactctgcatattttattctctttgatgctattgtaaatggacttgttttcttaattttatttttgaacatttcagtattggtatatagaaatacaactgatttttgtgtgttcttcatgtattctacaacttcgctaaatttgtttattagctctacttgttctttttgtggatgtttcaggaatatgtatatatataaaaccatgtcatctgtgaatatagttctacgtcctttccaatttgaagccttttatttctatttcttgccgaatttccctggctagaactttgagtacaatgttaagtagaattggcctgagtagacatcctttttcctgaatttaggggaagttttcagtctcattattaaggaggatgttagctgtgggttttgtctagatgcctctatcaaattcaggaagttgccttatattcctagttttccaagtgttttatcctgaaagcatattgcatcaaatgtttgttctacattaacggagatgatcatttgtgaagtttttttccccttcattctgttaacatggtgtatttcactgacttcttatcttatggtgagccactcttacatttttggaataaatctcatttggtcttgatgtataattgttttagtataatatttgttgtttcctagtattttgttaaggatacttgcatctatatttataaaggatattagcctgtagtttttttgttcttatgatgtcattgtctttagtgtcagggtaatactggccacttaaaatgagctaggaaatgttccctcctcatattttgtagaagagttggtaaataatttttgttaattcttctataaacatttaatagaattccctagtgaggccatctggtcctgggcttttccttgttgaaagtatttttatgtactgattcaacctttttagtggttctattcagattttctatttcttcttgagttggttttggtagtgtctgtgtttctaaatatttatctgttttatctaggtcatgcaacttgttggcatacagttgttcctagtatttaattattatgaaataatcatctggtagtcatttcatttcggtaagctcaacagcaatgttcctactttcattcctgattttagtaatttgaatctttttctctttttgtcagcctacttaaagatttgttcgttttgttattacttttatttttttattatactttaagttctagggtacatgtgcacaacatgcaggtttgttacatatgtatacatgtgccatgttggtgtgctgcacccattaactcgtcatttacattaggtatatatatctcctaatgctatccctcccccctcctcccaccccacgacaggccatggtatgtgatgttccccttcctgtgtccaagtgttctcattgttcagttcccacctatgagtgagaacatgcggtgtttggatttttgtccctgcaatagtttgctgagaatgatggtttccatcttcatccatgtccctacaaaggacatgaactcatcctttttttatggctgcatagtattccatggtgtatatgtgccacattttcttaatccagtctatcattgatggacatttgggttggttccaagtctttgctattgtgaatagtgccacagtaattttgttgatacttttaaaggaccaactttgattttgttgattctttcaatgtttttgtgttctctatttcatttatctccactataattcttattattttcttttgtttgctttgggtttagtttatactttattttatagtttcttagggtggaagattagtgtattgatatgaaatctttcttctttttaaaagtagatgtttacagctataagtttccctctgaacactgtttctctgcatcacttgaattttcatatgttatgttttcatttttatttgtctcaaattattttcttatttcctttatgattttctctttcaccattggttatttaaaaatgtgtttatagcagcatgatttatagtcctttgggtatacacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgacctttgcccactttttgatggggttgtttgttttttagaaaatgtggcacatatacaccatggaatactatgcagccataaaaaatgatgagttcatgtcctttgtagggatatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagatagagggtgcagcgcaccagcatggcacatgtatacatatgtaactaacctgcacaatgtgcacatgtaccctaaaacttaaagtataataataataaaaaaaaaagaaaaaaaaagtgtttaatttccacatacttgtaaatttctcaaatttctttctttcttttttttttttttttttttttttttgagatggggtctcgctctgtctcctaggctgaagtgcagtggcacaatctcggctcactgaaacctccacctcctgagttcaagcaattctcctacctcagcctcccaggtagctgggattacaggcgtgtgtcaccacacccagttaatttttgtatttttagtagagatggggttttgccgtgttgaccaggctggtcttgagcagctgacctcaggtgatccacccacctcggcctcccaaattgttgggattacaggcatgagccaccgcacctggtcccaaatttctttctgttactgatttttaatttccttccattatggtcagaaaaaatacactgtaaggtttcaatctttttaaattttgtgagacctattttgtggcctaatatatatggtatatcctcatgttcacttcagaaaaatgtgtattctgctggtatcagatacagtgttcctatatggctgctaggtctagttggtttatagtgttgttcaggtcttctattgaaggggtccccaagccccaggccaaggactgataccagtccatgacctgttaggaagcggtccgcacagtgggaggtgagcagcagcgggcaagcaagcattactgctgagctctacctcctctcagatcagtggcaacattagattctcataggagcatgaatgcaagggatctaagttgtgtgctccttatgagaatttaactaatccctgatgatctgaggtggaacagttttatccaaaccatccccaccaacccccagtccgtagaaaaattgtcttccataaaaacactccttggtgcccaaaacattgaggaccgctgttctattgtacttgttgatctaactagttattctaactattattaaaagtggaatattgcagtctccaactcttatttttgaagtttttctctcttcattattatcagtttttgctttatgtatttttttaataattgttatgtcttcttgattaactgacctttttatcattatataatgtcttttttgtctcttataacagttttggcttcaaagttgattttgtctgatattactgtagcttctctagctgtcttttggctacagctcccatagaatatctttttccattccttcaccttcaatttatttgcgtctttggatctaatttgaatctcttgtagatagcatagacaatcatactccacttaacaacagagatatgttctgagaaatgcattgttcagtgattttgtttttatgcaaatgtcacagagtgagtataattacacaaacctagatggtataaccaactacacacctaagccaaatggtatagcctgttgttcctagtcctaggctgcaaacctgtacagcatgttactgtaatgaatactgtaagcaactgtaacataatggtaagtatttgtgttttgaaacatatctaaacatagaaaaggtaccagaaaaatatagtattataatattatgggaccactgttgtatgtgtcatctgttgtctatcaaaatgccattatgcaatgcatgattctagttggattatagtatttttaattcattctgccagtttccatctttgaattggatagtttatgtacatttaatgcaattactataaagaagggtttcttccattttgctatttttatataatatcatttttgttttttatctcctctattacttccttttttctgtatagatattttctggtgtaccattttgattctccttgctacttttactaactattatttagttattgtgttagtggtttccctgggaattacaattaacatcttagctcataacaatgtagtttgaattaataccaacttagtttcaatattatacaacaacttcataccttgtccactacttacgttattattttcataaattacctatcaatatattgtatgcctgtcaacatagatctataatcattgctttatgtagtttttttaattatatggggcagaaaagaggattcacaaacaaaaatatacgtgagatacgactgacctttgtgtttacctatgtagagttctgtatttcttcatgtcagaggattcacaaacaaaaatatacgtgagatactgacctttgtgtttacctatgtagagttctgtatttcttcatgtcagtcacaattactatctagtttctttttatttcagcctgaagacctccctttagaatttttttgtagggcagatttatgagcaatgaactcactcagtttttgtttatctgggaatattgtaatttttcttcgtttttgaagtttagttttatcagatatagaattattggttgacagatttttcatctttcaacattttgaccatatcattccactgctttctgactgtcatggtttcttttgaaaatcagctgtaaatcttattgaggatcagaattctctcttcatctttgtcactttcaacaatttgattataatgtatcttcgtgtcagtcttttttagtttatcctgcttgggattgttgaacttcttgtgtgcattcatgtctttcatcaaatttgggaagtttttaggcattgtttcctcaaataatctctttgcttctttctctcctctccttctgggaccaccattaatcatatctcagtgtgtttgatggtattccacaggttgcttaagccatgttgttattttcctttatttaagccatgttgttattttcctttattttttttctttctgatcctcagactagataatgttaatcaccttattttcagctcacatctgctgttgagtcccactagtgaatttttcatttccgttgtaattttcggtgttagaatttgtatttggtttctttttatgatatttgtctttttattgagattcccagttggtgaggcatcattcttgttcttgcctttagttctttgtttatagtttcctttagctctttcagctaaactttattaaaataattaatttaaaatctttgtctagtcagctcagtgtctgagctttctcagagacagtttccgttcatttcttttttcttttctttttttttttccctgtgtacaggttatactttcttatttctttgcatgcttcataattttttgttgaaaacttgacatttaaatattataagtggcaactctggaaattagattctcccctctccctggggctttttgttgctgctttttcagcagtagtagttatttgtttgttattcattttttgaaatacttttttcaagcttgtatttctttgttgtgcataacctctgatgtttctgttgtttgcttagtggtcagctagtgatttgacaggtatttccttaaatacctagaaccaaaaaattaataataaaaacaaaacaaacaaatcagagaaaatctcccagtttttgcagatgagctctttgtatatgttaggtcacacttcaacactcagccaggcaatttacagctcttcattagttttcacttcctgctggtatagagtctcaaatttatccacaagtgagagaatagaaccttctcaggtcttttctgagggtgtgcccagccctgggcataaacctgaccttttagagtccaaaggatacatgggagcttttcagagtccttatgccttaaagtacctcattccataaccctcactcccaggtttttcactttatctattgtttgtcctgtttttccatgcccagatgacagtggctaatacatttgcctttaaatatttgaacaaacattacccaatgaatagctgcctcaaccctgggaatattctgagttaagtgaaataaaggcaggccctttgagtgtgtccttcaataagccataagatatttcaacacaaaaaaaccacaattctttcagaataaggtttgttttccttctggtactacagacctgtattggaaatgtggactgttgtcttcaaggccaccttttttgtctatttttcttgattacccatttacctggttgtaaacattttattcattttcagagttctggtaaagtttattctgcctgtttttgccaatttattttctgctttagtagagtgatggaattttggatttctctactctgctgttttcactgatgtcacccaggaaggattccttttaagacacaaaaaccactaaccataaaggaaaatattgatatatttagcaacattaaaattaaaagatttcgttcatcaatagacatgataaagtaaggtaaaagacaagctacagagtaggaatagatattcacactagatacaactgctaaaagactagttatccagaataaatactaaaatctaacaatttaataagaaaagaacaaccaaataagggaaaaaatgggcaaggatttgaacggggacttcacgagaaaaaatctaaatgactgaggaatgtatgaaaaagtgctcactctcactaagaatcagagaaagggaaaataaaaccataatgcaatattgttacacaccaaccaaatttttttaaatgaataataccaacaatgctgggtggaactgagttgtagaataagagaaactgttactattctttgtggacagatgtatagattggcttaaccaacttagaaattttttaaagaaggtattcataccctataaccaaccattctatccctgaatgtgtatatatatatatatatatatatatatatatatatatatatatatatacacatatctcccagaaatttactcacatgggtatcataacacccatgggttcacagtggcatttttcataatgtcctcaaaatgaaaacaatgcagttgtctatcaacagagtaatctatattcactgactccttttccttacctccagtttttttcttgaccccttgtaatcaggttctgtcttcatcaaataatgaaattttctttcaggtaactaattactaccatcctgttcttcataatctaattcttcaccctttttctagtatctgtgttgacatattcttctatgttcttcatctttagaatctcatttatttctgtaacttcaacaactgtatatctgcaataatttctaagtctgtatctccagcataggcagtttttgtttttttttttaagattggggcaaagatttgttctagactatgtaatgaaattgtaaatttatgtttactgatattaactggatccacaatggtaattgaaaattcttttgccttacccatcattttcattcatcaatgcattttttgagaattttaccactctcctaaagtcatctttatcacttttacttccccttattctcatcaataaggcctctcctgcaagcaccaaaaaaatagtagtaataaatatctgtgtcttttacccacaatttactttgctttatcatgcctactcaattcctccatttgtatctactctttttacttaactggtaatttctttaataactggatgtaatggcttcttttcagctctctctctctattcctattctctcccatatttgcttttttttaatcttgcaactttcttcttttttccattgccttgatactcacccatctcgatttgcctcttttttctctaataatttcttatgataagaacaccaaataatttatcttccaaaccagaatgcttttgaaaatgaaaagaggtgctgtttgataattaagccagcataataggtataatcctagattgttcaaggaaaaatcagatgtatggttaccccatacatccttatcttagagatcttatctcccttcagtttgttttcttttgttaacttttaatatgaatgttacctcaaattgtcagccatcgtcttttgttctttcacatattctctgcaggtgatctgacacatttgaatgactcaaattactacctccattgataattcccaaattatatgtcctaactttttcctgagttccagactcatatacctcatcaaatagctccagattagtagcccgaaagtacctagccacaaaatttaaacttatcttctctctcgagtatcctgatttttaatttacattgaggcatatatacacacagagatatgtagtgtatatatgcagttatgtgtataagtctggagatatatatcacacacacagagacattattcgtgcagttgcttcattagatattggacataaaatagtagcaaaacagttccatcatgacagtgcattctcatatgggagacagacattgatcaaagtatcacacgtataaatgttgtgatactttctgtaagtatggtcattgctatgaaggagagggatgtgatgtcatatgaagtataaaatgggtatttgaccttcttttaaatacatggcctttttaattggataagtggcaacaaatagctcttcaaaattagactttatttcttggaaatatttatgacaattcagtactcaaatatgttagcaaatggagtcgtcttgcttctcaaaattcctactgcttttcatactatttatgactatattgtttataaaccatataaaatttcaaacactgaaatggtggcaatatctttggaattaaggatgttggtatagaaactaaataaaggagcttctatagaaatagcattagttttgtgaggcagaaatgatgcataatattaggaataccttgtagtcacaaagtctggctgtttcttcttttcacatagtaagtgatatttgttgattaaatgttaattgcttgtctttttatcatatgtttcaagtcttgcgtgcaaaatttgaaagtcctcatgttcccattcttagaagacgtatgcccgttactggtagcccagaacatgaactaaattatgcaaggcctaaagtaataaatttataatcaacatatattaataatgttaaaaataatctacagtattagtctttatgtttgtatatttttagaataatgataattacattagtctttactatgttgataagtataataataacagtaataataaccaacacattaaatatttaccacttgaaagtgctaaataatctacacacattattttacttaacccttgcagtattccagtgaagcagattctattgttgtcctcaattttcagataaaggaagtagcaattcaaaaggtatatccatcaggatcctagcagacgtcagatagcatgcttaaataggtaattgaggagagttcaataagaacctataggatgtacaaaggtttggacagaatttagggaaaaccacaagacatcatggaatgcctgggattagtaacagtgggaaccattaatgcttctacctaatggggcaaagggaaggagtgctattagaatctagagaaagagctataagccagaagggcagtctgacatgagctatgatcttgagttgagtgacacagccaacctttgatgatctggtagagagggagctaggagaataaatgccagatcttaccctatcccaactcagtcttctgccagtgcctttcactgactgaacccagctggaagccagggcagaaaataatttgttgatggtgtgcatacaggtcagcttagagaagagagggtgaaaatggttggagactgatctgaaaaggaaatggaaaatatataggaattaaatagcttgctcaagatttcaaactattaaatggcatagcaagtatatgaatgaccaatcctttattcctaaccacaatactatactgcctctcatattaaaaagttttatgaaatggtacttgccagggaaaatactttaaatctgaaagtttctattctatctcaagttgttggatgcatttatacctaacagtaagtgacaccaaatatgtcagagctgagcagcaaagaatgctaaaacaaagggggtcttgattctacatgttattgacattttcagaatattaaaccatagttgttccccttgttcagattccagactccatcatttctcgtggtgttcaggtgctcccacgagacacagcctccctcagcactactccttcagaatcgcctcgtgctcaggctacatctcgcctctctacagcttcctgcccaacaccaaaagtaagtatggttccttcgcatcttacacctgctcttctatagtaatctgggaaaactaaccaatatttcctcctgcttgtcaaggttggattgcatgcaagattacactgtgaaaaatgaataaagtgtaagatagttcccacccattgtgtcacaaattgtcatattaggccactagtaggacaatacagatttcattcaaaatgtcttactcctacatcatagctaagggtattactttctgtagctcctgtttctttgttgtagatttgttattttttagtatacttaacattatagatgtaaagttatttgtttatgccgaggataaatgtacttttggccagtaaacagcaagattaacaaaattgtgtcaccaaagggatttctttaaacttgtccgggctggggtagctccctgctctagtatcattccaaattttttcaaacattcatcttggaatgttgctgcctaatatttgcaaacaaatctaaatttattagaaagaaagttttaatgccaacctttgggaagagggtagaagtttcttagtctttttttttataatctgtcactgaattgtatagggtgaggaaaggatgagacacttatatgctgttcacatctttgtatacatgataaattaactagcagacattattactgctgtgactactttctcctggaatgctccttgcctgattaagttagtcatttgtgctttcaagttctctatgtgatggatgcaatattggtatcaaaagattaacagtaacattccttattatttaataagacatgatgttagacactaaatttgttttaggattctgacagttaatttttcaaattatagttttttctctgtcatcaaatttaaggacctgtatagctgtcttcctcaattccatcttttctatcagttttgtgaatgttataatttaatttgactagaagggatctcagtttctgatgtgaatagtgcagtttgttttacattacttgttacaatcttctcagcaatgtttccagtgttactgttgtatatcattatttttagatatatgtcaaaaaaactgatattaattttatcatttaaaaaactgaggtcctgaatcttcaataaagataaactataagaacattgtagacattaaatgtatgccagtgccatttgggtgccagtaagctacattttcaaatgcataaaagcaaggaattcttaaaacctgaattagatggaagaatctcatctatatcttttatattattaaaacaaagtaacttacagtttgactgcattaaaatccagttgtaccagctaaactcacttgtaaagtctagaaaatatttaaaactaaaagttaagttcactataagatgttttgttcactgaatattaagacctaaaagttgggaattcagaactattcaaggcatagttgcttttccttaataatatgctgaaatcataaatattttttgaaaatattttatgctaaatttaattatacatagtagttcttgagtatttttataactttgtaattatattttagttacaaagaggatattaaataaaatttgaaaaatcacttggtacttccaaattcaccaaagtaaaattctgaaaaataataatgttaatattcgtcaaattaatttgcttattgcagaactttaggagagcaagtggcttgtcttgatattttttccttagttaacacttagatgttcaaattgacagtgaattcataaaagcattatatctttttctaggaataagattatatttcttttgaataattttgatcagcactagaatgtatacctcaaagataaagttatcactctggtgtaatttttaatatacacttgaaatgctgaattagaatattaatataataaaagaaactagtttgaatgttgatattttaaaaggagttagtctattccaattaggcatctggaaataacgtttaaaaaataaattaaaggacagaaggaagtgaaatttgtctttctagtaagaaaggtctcataaatcataagactgcttaagagaatctaaactaggtgcttttataagtgctttaatatcagtgacaaatatactccttgtcttcatggagtttacaatttagtcatatattacaggttgagtatccctaatccaaatgcttgggaccagaagtgtttcagatttcagattttttcagattttggaatatttgcagatacttaaaccagttgaacatccctaatcagaaatccaaaatactccagtgaacatttcctttgtgctaaaaaagtctcagatttcagattttcagatagggatgctcaacatgtaaaataaacaggtagataataactttaataattataatttcatattaatttaataattataatttaaatacaatgcatgctaagaagaaatgaaaatgttatggtagtagaaaataatagcaggggaacttcatttagatagggtgagtagagaagacctaacatttcaccaggggcgtgaagaatgaatgaaaaccaaatgtgagcttttgtgctatgtggaggttttaggaattatattgatcaataatgaccactttaaaggcaggtgtcaccaatcaagaactcttacactaaaacttcattagtatgtgaatagtctaattcagtgatgtcaacagccaatttcaaatatctgttcttttttatttaaaataatgaatctttttgcctttccccactgagtcaaatatcaagaccatagattttagcaccgagctctgtttaataaaaaattaaaatttattttaattttttagcataaaaatttggggccgagaagtccaaaagcaatttcggggtttcaaatttgagatactgggtagacaataatgttattaactataccaaggaataaaagagaagtaccaagtcttgagggtaaaagaaaagagtttaatgcatcttgattgggaatgtgtttaatctgaggcatatgtgagacaaccaaggagtgatatccagcacaaaattggaaatacaatttgagtttgaaattcttatttttactgcatcttggttatgatatttataacttagtacatattagtgttagccaaatcccatagaaatcctttctacatttcaaattcggcatgcacagattttcatgcacagaaatgtatgtgcaaacgtattttgtctacatcagaaatacaatatagttttgaatgatcggtactagaaagagcacttgacttgataatagaagatctggatggaaatgcttttttctctacctcataaccacagtaaattaagcaagttacttaactttactgagttttgtgtctattatttgactgaccatccttacctctacaacagtgtttattaactcattaaataagtctttgcctggtagtagaatagcaacagtgagcaagtagacattgttccaacttctacaaatagatcagacaactaaaaattaaaataaagcataataaattctagaattgattatcaagaatacataatattatggaaatagctaccagaagcacttaaccaatatatagatatattgcagtataacatcctaaattatatattgaccgtttaagattctccagctatagtgagaacaaaatctataaaactataccaggtcttgatttctttttgttttttttggtaccctcattacaacctaatgaagataaccatgtattatcttttcttaacaattcttcatagattatattttctccagcaaatttgtttgctgaaattatatcgtatatagggaaaagtcatttctcttttatatcatatattttcttttaatgaaatctgactgaaatgaggaataattttcactcctcttgctttatgacagtgaagtatctttcaagaacaaagttgggatatttgactttcattgtcctgagtaaaatagtgcctaagtcaaatagtacataaattatatttaaagaagtatagacaatatctagactcaagttctaaaataatgatagtcttctaaaaatgatttgctggaagaataattctgtaattgataaattctcttttaaagtgagcatgattcatagcttagatgagtgctgattttcaattatgaaggacagcagcatctctatttagaaataaaatcaaggccgggcacagtggctcacgcctgtaatcccagcactttggaaggctaaggccagtggattgcttgaggacaggagttcgagacctgcctggccatcatggcaaaaccccatctctactaaaaatacaaaaaattagccgggtgtggtggcacatgcctgtaatcccagcttcttgggaggctgaggtgtgagaattgcttgaagctgggaggcagaggttgcagtgaaatgagatcaagccactgcagtccatcctgggcaacagaacaaaactctctctccaggaaaaaaaaaaaaaaagaaagaaaggaaaagaaatcaagaagcttaaggcagaaaataatgattacagcaaaaaataaaaatttttcaaactttcaatttaccattcattttagatgttattaaaatgaagaatatttttaaacactaattttattatcgttttattccctaaacatctgaagtttgattttgagtaagtaaatatagtctatagtcacatatgttcctgtaccttaaaagttagcaaagaattttgtgcttagaataaccagcaagttgtgttttttttttttttttttgctcttaggaagaaaatataaatactatcaatatctaattgaagttatcaatatctaaagtttatacaacaattaaaatgtagatgtattgaaatatctttatatgagggatatatacctttaatccactaatgtctaatactatattcaaacaaaatatgtaattattacttctttgtaggtttctcttactgtcctttgagcaaaagaatttagattgctctggttaagttatattcttaactcagggtttttaatgtatgagtctgaaaggcagtgtgaattcctttacctataaaaatggcactgctgattctatatcagcataatattttctctgggatgttttcctagtagtgttagtttttacaaagtattgaatattgtcactattttcctttgtgaacaccagggtgattatgtgatatggctaggtcattggctaaacctgggttcccaagtctctggagaagctcataaaatggccatacttccagcctaaatcaagtcactaactggtgacggcaaattatttttttcctatttttaagagcctaaccaaaatcaataagactatactagacatcaagcttctttgcttttgctgaaattatatcaacattggtatgacaatatgttcagctattaatgacattatagaaatagattctacacataccgtcaacacacaacaaaaaggttggaaaccagtgaattagtgagatcaaaaatacattctctgaacaaaaatatgttttcttttgtgaacatttacctcatctggggggtgttgagcaataatattctctgcattattggttagatccagcatttctcaaacatactggtctccagaccccttcatgcttttaacaattattaaggaccccaaattacttctgtttatgtgggttatatctaacaatatttgttgtactaggaattctgagggccaggcatggtggctgtaatcccatcactttgggaggccaaggcaggtggatcatctgaggtagggagttcaagaccagcctgaccaatgtggaaaaaccctgtctctaccaaaaatacagaattagccaggcgcgttggcacatgcctgtaatcccaggtactcaggaggctgaggcaggagattcgcttgaacacgggaggcggagattgctgtgagccaagatcatgccattacactccagcctgggcaacgagaacgaaactccatctagctagaaataaaaatagtaaagcctttacatgttaacataaacaacatattttatgaaaaaataagtatattttccacaaccaaagaaaatctgaaaataatggcattgttttacattttttcaaatatatgttaatatctcgcttaatagaaaatagctggattctcacatttgcttctgtattaagtcttgtaatatgttgttctgattgaagaataaacaaattgagcctcatatagatatatagttagaaaaggaaggactatattgttcacatttttttataattgtggatgttctttgataccataccaaaaatttacaatttttagtttagtaaaggttagttgaaatgttgaatctaaaaccctggctaggaccattccatactcacaccttaaaatccattggtctgtcttgcacttcaaatggatcttttacccaggcatgattttggaacacatatattggtcatttggaaaatataaattcttccaaaagttgacatattttgttatattatatcaaaaagtcaccttcattaatataatcaccaagctcatctaaaaagtctggaatgtactggaagctcttaagctcatagtggcacatagacattttctaagttctaatttatgctttgaagctagaaattgggctgggcgtggtggctcacatctgtaatcgtagcactttgggaggctgaggcaggcgggtcacttgaggtcaggagttcgagaccagcctggccaacatggtaaaaccctgtctgtactgaaaacacaaaaattagccaggtgtggtggtacatgcctgtagtcccagctgcttgggaggctgaggcaggagaatcacttgaacccaagaggtggaggctgcagtgagccgagattgcaccattgcactccagccggggcaaaagagcaagagtctgtctcaaaaaaaaaaaaaaaaagaaagaaaaaaaagaaaaaagctagaaatagtattactggcaaaaaagcaacaaatagttttttcttaaattgacagactttgtttatttttgagaaaatgtataccaaacatctaagtctgaataataataatttattagttatttcattctttcaagtaaaaatggtattctgtattaaaaactagctattcagcttacaactcaaacaattgcataaataagtgattttccttgagacaaccaccatcctttggtatgcagaagtattttgttcatacgccccattttgtcacattcaaggctcaagttttaattaatttaattttcccattttgtcacattcaagggccaagttttaattaattttaattaattaaatttaatttaactaatattaaatagtaaatttaatgtgtattaatattgtcatataatattgtaattactcatgtaaatgtaaatattacattgaggatatagtaaatattaaatttactatgtcattgaggacagtatttcaaactagcttttttaaaaagaaaaacagaagatggcagtgaatagaacagtgattgttcatactacttggatctactgccttaatttatactaggatgtcaatccaccattgattttgtaccatcagtgcaaatgtcaacgtagccaaaaaggcaaataatgtctgagtactattactaaaataattttgactttgtcaagccctgaaagggtctccaggaccctcatgggtttgtggatcaacttaaagaaccattgataaaatcaaatgagcaaactggcttatgtttcttgaaaatattctggatgaaaatgatggctattgaatcctttatatatatattttttttccatagaagcagtattatagtggtatactcagtccaagagatctgatccaatgactaccggtaccatggttaagcattataaatagtttacctgtcctctgtgatccaggttaatcctagggcagggaacacctacacctctctgattccaatgacagacttcattaaatttttgaagatataagaccagaagttataattcccagctaactccattcattttcaatgtggtattacttctgcacttggataataactaattttccccaggatattctgtctactaatagataacatacaaagccctcttttaagaaataggccagacgtggtggctcacacctgtaattccagcactttggaacgccaaggcgggtggatcacctgatgtcaggatttaagaccagcttggtcaacatgctgaaaccctgtctctactaaaaatacaaaaatttagctgggcgtggtggtgggcgcctgtaatcccagctactcgggaggctgaggcaggagaatcgcttgaacccgagaggcggaggttgcagtgagctgagctcacgccactgccgtctagactggtgacagagcaagactctgtctcaaaaaacaaaaaaagaaaagaaaaaaagaaataacctggttgttggcagataattctattgagtatataactggggatagctcatttttgaaatcagtttagaacatttaaaatgtgggaaattcaaataaaaatgcaaattttcactgttttctaaaaagtcagatcaacattgctggcccaccactgatataatactctatatcaatactcagctaatattctttagaccctccagactattttactcacttacattaaatgcctgactcctatggacatttaagtaactgatttctgccctaattctctgttatctaatttctcctcccttataacatgtttgtttggggatttattctcatttgttagcgaagcagaattttgagacttcaaataaaagacaattcctttacacccttttctaatgagaaaggcactacctagtatgggaaagaatttaatattttgatgaaactaaaattacacaataaagcattttaactatttttggtctataacttattttcaatagttttcctctgatgttctgctgggtatgtaggattttacctcgatttttcttttttcgttcatgcaagtgtcccctttgtttttcattataattatcattataatgataattgaaaatgaaacttccccatctatttctaattatttaatggtcacagagctatgtttattactgaagctaaatgtaacaactatgaaatgtataattgccactctgaagtctaaacttgcaaatgaaatttgatatctgagaagatatagcaaaccaaaaattgctaactgtagaattaacattttatagctaagacagactgtaagtggtatagtttctgtatagtttcttttttgtttaaaaaaaatgtacttactcatttggaaaaaatttttaaaattcacataaaaaagttcttataaaatacccttcataaataaccactgttaaaattttgctatgtatcattctcttatgtttttctatgcatttaaattcttatcataccaagaaggcagtgattaagagctcagtttctggagtctgacaggcctgatgatgaatcacttaatacatgtgtggctttcaaaaagttacttcacctctataaccttaattatctcatctgtaaaatgaaaaataatgatactatttgcttcatagggttgtcttaagaatttaagttaaaaatgtatataaatcacagcacaatgattaaaatataagtactcattaaacagtagccattattattaaattgtctatagcttttaacctatcttgcttacttagtaatatgagcatctttctatgtcatgaacatctttatatgttgtaaattaccttctacaatattacttggatttttgatattctaattgatagatgtgacatagttttttcaccaacccgtattttggatatttttgttgtgtcttattttctagttttaaaaacaatgctgtagataatctttcagaagttaaaggttttggagtcatctcttaatcaaactcagtaacttctgttatttctacttttattgaaagtatatgcagaacttttaggtctaagatttctatattttacattgacagcaggaatagatcatttttatgtcttcatgagtttaatgatatattggaagaagcagtttttagcatttgcatttgactgatttactggcagacatttaaaaactataaacccaaagtcgtctgaaaagctaacaagcttgagtgtgtaaaaatattatactgcgaggcacagcatattgagtaccagccctaggctaccatattataactttatgagggctgggcacagtggctcatgcctataatcccagcactttgggaggccaaggagggaggatcactgaagcccaggagttcaggaccagcctgggcaacatagtgagaccctgtctctacaaaaaaaaaaaaaatttaattagctgggcatggtggtaagtgcctatagtgccagctactcaggagaatcacttgaacccaggcggttaaggctgcagtgagctgtgatgatgccactgcactcccagcctgggtgacaaagcaaggctctgtctcaaaaaataataaataaataaaactatgaggactagttgacctcagtttctgttatttgtaacaccaagatattaaataacctctaaagtcccttgtaggcttataattcttttcttttgaaatagttccagtatcaactaaaaaatatttttaagcccttctctctctgatattttattaatctccaattaatacagaataatttacatgtgtttatcttttgcattctgttctagtacataaagtactagagacagagattattaacagaaaatgttctaacttcacttaagatcttttacatttaggtaaagcttgtctctgttaaatgaaatattgatttctctcgatatccactctagttttgttcaagttatgagaagatagggaagtgaactgttgaaatacaagaaattgtgaaattaagaatactagcattcagtataattaaatagctttgattcatttcaactgtttttaattgtttgggacatattttgtataaaacagcccaacaaatataagtggtccgtcctatcattatttcagcaacaaaatttgttagatattggcatgatttagagctatttaatatcccattttgactttaatatagagtacatcccatagtaaactatcctctggatcttcatatcttacaaggatacatattctaaaattaggtattttctggcccaaaatttcaggattatctccctactcattctacttttgttaaagagaaaacacagagtaattcagaaattcattgaatatttcagtgaatatttttaaatgcatattatatgtcaaatactgtattagctattggggatacagcaatgaatagacattttaaccctgttcttaaggagcttatagtggtaatatgtgaaaataaaatatttacaagaaatctaccatatacagggttgacaacctcaaagagctcttctaatccagtaggaaaaagtaaaaaaaggatgagtaaaaggtaagcatagtcatttaataaaataaatacatgcagcacagaaatatgtggggggggggggagtacactctcactagaaatctactaaaaatttaaaacaacacaaattttgcaatcaaattgatgactatttaaaaactataatcatcagtactgtaatgagcaatgacatgagtatttcttttcagactaataggaatataacctttcaagcaataaattcgtataacctttcatacacatgtgttgtatacctgtgttctctacttaaaaagtatatacaggccgggcgcggtggctcatgcctgtaatcccagtactttgggaggccgaggcggatggatcacgaggccaggagatcgagaccatcctgactaacacggagaaaccctgtctctgctaaaaatacaaaaaattagctgggcatggtggtgggcgcctgtagtcccagctacttggaaggctgaggcaggagaatcacttgaacccgggaggcggaggttgcagtgagccaagatcgcgccattgcactccagcctgggtgacagagcgagaccccatctcaaaaaaaaaaaattatgttttaatcagtcattttgtctctagaaatgtatccaaaataaattattaaagaggccatctcaaactatgtacaggaatttttatcacagcattatttatatttgtgaaaaattagaaataattttaatgtgtatggaaaataacttgtattaatagtacacacatatataagttattctataaccttaaaaatcatctcattaagaatatttaatgacatgagaaaatgctgaaactacaatgtatagtttaaaaattagtaaacaatactgtgtaggaatagaatagcaaattatttcacaatatacattatttttaaaaccaggaaaatatacatatctgtttggtttttgtttgtgtattttttagataggatctggtaattacacggatgtcctttggcctatttttcagatttgtagccaaacttaataaagccaactagagttatttatacctatatttacaggcataccttggagatattgtaggttcagttgcagaccactgcaataaagcaaaaattgcaataaagtgagtcacacaaatttttcggtatcccagtacctgtaaaaattatgtttatactctcctgtagtctattaagtgtgaaaaggattatgtctaaaaaaacacactgtgcataccttaattaaaaaatacgttagtcctaaaccgttattacaatcatctgagccatcagcaggtcataatctttttgctggtagagggtcttgcctcaatgctgatggctgctgactgatcagggtagtggctgctgaaggctggtgtggctgtggcaatttcttaaaatcagacaagtttgccagatcgattgacccttcctttcacaagagattttgctgtagaatgcaatgttgtttgaatgcattttttctacagtgaaacttccttcaaaattggagtcaatcctctcaaaccctgctgctgcttaatcaagtttatttatgtaaaatcatttgttgtaattccaacaaagttcacagcatctttaccaggagtagatttcatctcaaggaactcctttctttgttccttcataagaagaaacttgtcatctgtgaaagttttatcatgagtatcacagtaattcagtcgcaacttcaggctccccttctaattgtagttcttttgctatttctaccacatctgcagttctttctcctccaccgaagtcttcaactcctaaacatccatatggttggaatcaacttcttccaactcctattaatgttgatattctgggctcccatgaaccaaaaatgttctgaatggcatctaaaataatgaattatttctggatggttttcaatttactttgctcagatcaattataggaattactatatggcaactgtatagccttacgaaatctatttttaaaataataacatttgaatgttgaaattacttcttgatctgtagggtgaagagtggatgttgtattagcaggcatgaaaacattatctccttgtatatcccaatcagagctcttggatgactaggtacaatgtcaatgaatacttatattttgaaaggaatctttttgtctaagcagtggatttaacatatttagtaaaccatgctgcaaaaagatgtgctgtcatctaggctttcttgttccatttgtagagcacaggcagggtagattttgcataattcttaaaggccatagtacttccagaatggtcactaatcatcggcttccacttaaagtcagcagctgcattattccctaccaagatagtcatccagtccttttaagttttaaagccaggctttaacttcacctctctagcaatgaaagtcctagatgacatctgcttccatttatataaggctgttttatctacactgaaaatctgttgtttagtatagctgccttcatcaaggattttagctagattttctgggtaacttgctgcagcttctacagcagcacttgctgcttcacattgctcttatgttatagagacatcttctttccttagacctcatgagccaacctcagctagctttcaacttttcttctgcagtttcctcaccttactcagcattcatagacttgaagaaagttacagccttggtctggatttggctttggctttaaggactgttgtgactggtttggtcttctatccagatcactcagactttctccatattagcaataaggctgtttcactttcttctcattcatatgttcactggcgtaccactttaaatttccttccagaacttttcctttgcatttacaactcagctgtttgacacaagtagcctagctttctggctgtgtcagcgttcagcatgccttcctcactaaacttagtcatttctagcttttgatttaaagtggtagacatgcaactattccttctacttgaactcttagaggccactgtaggtttattaattggcctaatttcaatattattatgtctcagggaatagagaggccagcccacagagaggtagaaagacaaggaatggtcagtctgtgtagcagtcagggcacacacagcatttatcagttcagttcactatcttacatgggcaccatttgtggtacctcaaaacaattgcaaaagtagcatcaaagatcgctgatcatagacaaccataacagatataatcatagtaaaaagtttgaaatattgtaagaattatcaaaatgtgacacagagacaggaagtgagcacttgctgttggaaaattggtgacgatagattcgcttaacacagggtagccacagacaaaccttgaacttgtaaaaaatgcaattatccatgaagcacggtaaaacgaggtatgcctgtataccacagcatttttacatccaggctaagccagtctcttcttaatcctgctggatagaaaattttatcatatttcagtgaaagttcaaagataaacttttttttggtctcatgtgcaaataataaaaaaaattaagaacatataatgtgctgcctaaaggttatttattttaacccacataataactcttttattaaagatgggttttataatttctttttagacagataagaaatttggaaaaaataatttcagtttaattattctctagttagtgaacaggaaataatttatataaaggtctaattttatatagattagatttaaaggtctaattttgtatagattatactgtcttggaattaaaactatatagaactttaagatcaaaattataaatgtgtaataaaatataaataaataaatgcaaatgttaatatatcattagacatcagaacctttaaaaaagatgatttcctggctgggtgcagtggcttacacctgtaatctcagcactttgggaggccaaggcaggagtatcacctgaggtcgggagtttgagaccagcctgaccaacatggagaaaccttgtctctattaaaaacacaaaattagctgggtgtgtggtgcatgcctgtaatcccagctactcgggaggctgaggcaggagaatcacttgaacccgggaggcagaggttgcggtgagccgagattgcgccattacattccagcctgggcaacaagagtgaaactccgtctcaaaagaaaaagatttcctaaggataaaaatatggcagaggggtttagaggatctgtaacttgccaccatgattctaacttttgacttctcacttcttactctttgcaactttccttgaccttttttatccttttattagtttagttttataattgtatttcctttcctccagaaacacattagcaattatttttccttgacacatttgtatattaatcacctctctttcatttctttcttccttcctttatacttatcttaataaatcacaaattaaaatgttctatgatgaggcaccagctttactgaaagggctgaataatataatattatagtgaagtgaaatattaacttaattccaaaagtactttgttatttataggaatttgtttaaatgttgagctcttaagcaaaactttaaaaaaaaaatctctttctccaaatcatagctaccagaaacgatctatagctgccccaatatatactgagtgatactggttggaaaataatttctaagaaaaaagttttatttcttttcattgataatcataatttttttaaaaagccatgatatggtataataaggttaaaaatattagtctcagaatagttctgaaggtaaactagatctaaaaataaaatggccaactccttagcacaaacaaacagaaagaaatgttggtttaatctatgtaattttattctaaactgatacaaaatgtattatggagagaaggggagaaggtctacattcgttattccataggtaagagactaaatttaattaaacaacctgagagtcagaaggtaatatcagctgtactttcatattatttattgatgcattcagaaagccactgaacttctccagaccttggttcccttatcagtaaaagaaacacacaaaatatacaacattttctaaaacattttcactaaacattttgtaactaaagaaaaatatgaatgtatatacccagtgatatgtgagtgtaccttaatgcagttatcataagcctgaaatttctttgaagttttgtattttattttaaaaattaatatcaagttgatttttaagctatgaaatatatgtttggtttaattaaaatactacatttacaattatttttggcaagagaagtgagggtggggctagatagttttctaccttgttaatggtagaaatcgttttcagtgagctcagttttgggaaactgagctaaatcaaagggaatcaacatcacatattagtttaggatccaggcaatttcttttgttgcataatattactagaatccaaattcttggaaaaaaaagtaaatagaaatgtcaaagtcattttactacaggccagatcctggtaattaatcactgaggatagtttccccagtaattaatccctgaggaaagattcccagaatgttgcaaaagaggtaatacagtgcaacattttcagaatatttctaaggaatactttgttaaatatattctagttgagagactgaatagaagattgaagtattttggatcccatggataatatcttttaacatcttggtaaaatacttgtcaaaagatttcttcatgattaatgatgacattttttgttttgctcctaaattttgattatcaatatatataagtaaactagtaatctcaatttactccacaatcctcacaattatttacattcaattctcagactttgtttataatgccgtgatagtacaatataaacatttacagtttaacctctcttagctactgatagtgttttgcctttagaaaagtatgaataaaaatagctaatgatgtgaagctcttattattaagaatagtaaagtcattcatcttatctgaatgctaatcttttgtgatttcttttaaattcttatctaaaatgtaataatcaagcatttggccgggcacggtggctcacgcctgtaatcctggcacttttgggaggccgaggcaggcggatcacataaggtcaggagttcaagagcagcctggccaacatggtgaaaccctgtctctactaaaaatataaaaattagccaggtgcagtggtgtgcacctgtaatctcagctattcaggaggctgaggccggagaattgcttgaacccaggaggcagaggttgcggtgagctgagatcatgccactgcactccagcctggatgacagagccagactccatctcaaaaaaataataataataatcaagcatttggattagctgtgaatttcttttatgtatactaccccactataactgatgattaatggaggactaaaataaataaggacattacattttaaatctactgatttcacttttctctatttctcaaattctagtttatatagacatccttttcaaattctttctgaagtttttcagtattaggtattattgttacctgtttcagaagctgcaaaaaaatcacatgaaacttgaattgtagccagatgaaacttgaattgtagccatttctggctttgaaaaacaccttggctttctaaggttttcctcttatgatggtttcaaagacaggcttgtttatagaaatttgaaatcaagcattgatgagtggtttgctcccaaagtctctatataaatcagtcttataatctagtttttacattcagagtttagtggtaactgtctttttttcttcttataattcattgtttaagtttctatacttgcatttggaactgaaatggtacaggaaaaatgtcttccatatatatagtaacgtaaaatttcttccacagatggagagagacagacagacatagtacatatacatacacattctgttataagcattaatttttttccatcccatatattttcaggcctgctaagggaatgctactttaaactagaaattagggactgttgatttcgttcttagatttgtcatcaacttccagtgtaaccttgaaaaagatacctaatgttgctgagcttaatgtaattttaagccttctggaaataaaagacaacatagaaaatggtgttcacttattactgtgtaagttcagaacatcttcacagtttctgaaaattttcagaaagcctcatgaggcatcagactcttatatttttataggaatctaccaactctacctttataatctagatattgtgaatctgcatttaagatggaaaacagcttttgatataaagacctcagaaatcaaagaaaacagcacaagaggatgagcagatattatgaactcactctgaattcactccatagggagcccctctcttataggtgctgatgttctagttagtatccattgtttctaaatttgacaattctgttccactaagaatagtaagaattggtgattatcttttggccataacatttagttaatgctgaaaaattagtaaaacttgtttatatccagtagagccaaaagttgatgcaactcttatatagcaatatgcttttattcaaaacgaaaattccattttctcaatatgattattcctcagcaatttccatatgctatcagagatcttctaaaagggataagacaatatatatcctgcttccaggaaataaaattttataggatgttcaggtttctattatttcttgaagactttaactgggaacttttggcatcacactgatatttctgctatctcctaatataagcaggaacatcacagctaacttgacctatgctggtctgaattgagacctcattctggaatccatagtgtaaaaccacttagtctgaagcttcctatcccctttgctcttcaccctgccgttttttttttattgcctccctctttatccaaaacattagttctcattagagctctatttaaaaagtacctcctctaataaaacattttgtgttgagaaacttcccttgctcatttatgcagtaatgtgaaatgagttattttaaaaaaaaagttttacttttcatttcccgtcttacccaagatagcaaattttccaagaggaaaattcagctaaaataactgaaagctttgaggcagtaaatatatctaacattggtctggcattaaaattttctggttgggcagcacaattgtttaattgggaatctcagtgacagctgaacaacctcaatgcttgggtcagcaagcagaggagcttcactctgtcacctatcaagaatgatgcttgtcaggactgatctttccacctacagagcattcatgtttctagtcataccatttatgttttctaatattacaatggaatagacactaaaacactaagagagaaaagtacataggtatatttgtaattctttgttttttgtaagccaaatgcaaatgtaacactactccagatactgcttcatcagaagtccccaagataaccaaaagtaagtgccaatttcctcatctcagggatagtgccataacaaagactgaattctagggaccagcctatttgcagagcatgtcatacagcctctgggttagttaactccttggcctcctaagagctaccacagagagtcaattgatgtttttgcatgtattacttactaatgtatagaaaaatttttaagttcactttttctttattctgtctttcttacccatcttccctcattgtagcaaattagacggccggatgaaagcaaaggagttgctagtagagttggatccctcaaagtaaatatgtttctaacattttttggcaagatttcgtctatagcctacacttcttcctttttggagggtggtgggaggaagggggctttttccatttttcaccatcccattttttttattttaatatttttattggctgttgggtcatattactttttttttgtttcagctacacatagagcaaccagctgaaggcaagctgccaaataactagctttgaatggcaccacaaacaacagaaagggcaactgcctcattacaggtgcctataatttggggttctagaataaaccgttcctctgattgatgtcactgtgtgttaagttcctgttacacagagaactaacatttattttcagaatattatctccccttttagcttttttttgtaaaaaaaataattttaatgttattttggtatcatcaccatttatagttcatttcagagaaaagttattatgagttaacaatatgtattcaatacacataatcttaagaaattgaaagaaagaaattttatgtcatgtagtataatgggcccacatatagctgatagtagttatgccctcttaatcccctctgttttattttttaaatttcaaaaaactgatacaacaatcaacagaaccagatacatacctaaatgtttgtccatttgtgtatataacctgctaatatacaattgaaagatttctaatttgatcatcttgtttgctagttgctaaatatttatttgctcaatatgccttgggcactcagtactcaaacatttaatcataatgaaaaggtaaataagttatcactcttatgaaacacagaccaatcacatttaatgctgccaccttaaatgcaagttagaaaatttgctgaattctaaaaatatgcagaagaattacctcacaaaagtaattattttcttatatctcaatctcatttgccctaacagcaatagtaactgttaaattaatcaaaatgctagaaaattcagtgcactgggatgtcctaaaatttaatgactaccttgaggcctaatattcaatcatttcaaaattttgcacacctccaatttatttccattttacaatttatgaaatactaatttctgcactctttcctctccttgcctcttctgccttcttagctttacttttttgttattgtttatttgtttgtgtgtgcgcacgcacatgagtgcacatggatgaaggtgtgtttgtatgtttgtgtcctttatttcagaaaagccatcctctctgttctctaacactgctttatagtggatagctattttattaaaatgttatttcaccaaggataagaagaggggatgggaagtgttaatagtgtgcctatttcaaaaactaggcaatttaagattattcagtcagaaaaatgtgagtttgtgtatcctgatgatatatcagtagcattcctcactgtctatctgtgaggtatcatattttatctttgtctttaaaggaagataaatccattaatggtttaaactatggattatgactcaaattcaggtgagaaggtacagaacgacatgactttttgaaaattactgaaggtgaaataaagataaaaatggcatccataactgtagcaccatgtactgtaaactggattgtatgtgcgagtgcgcgtgcgtgcagttatctccgagttcaacttctggatgtatagaacttcaagttataaatgtatgtttattgtttttaagtgtatatacaatatgagtatgtatatacacatatatatgtttaagaacaaaagatacgttttataattaaatcagtttatattaatatggatgcagtcttgaatcaaaaagtgtgtttgggaaagaaagtcaaatttcataatatttaaatatctttactccatgtttctacaaaatagaaaatgtcaaagtgaatctctaggggatttataaggatggttatagtatttattttctctaatgctttggggagaaaagatgctgtaattaatcaaaataaaatgttgacttcctagtcacgggtttgttgagcatgcattcttacgttatagaaagacctttgatgtttgaaatgtttgccaaaggcagtgagaaatgtataatgctatgatcttatttttaaaaggaaaaaggaaaaccgaaaagagaacaagttgctttttcaattcattttctgatgtttacatgtagctccatcgaaagctggaggagctcagagatcacctagaaggcaatgtgaaaggatactctctcagagtaaatgtacgatttcacttggtgatttttttttccctaaacttctgctgactggtaactccaaatctgattggtttgtcctctcatctccatctttttcctttctgtctcttttccccctctttctttcttttctagctgcggcttcatgctcccatttatgaaataaagattaaattagcagggtagaggaccctaaagccacactgactaacattgctgttgacttaataatattttggccccagtgcaaaataaaatctttcttttcaaaaatcactatttcttatacaattgtatacttttttgaggatcttgtcatgagacttcatttggagatttttctattggtcatgtcttctaccccttgttagttatgtcagcagaataataaattatgagctggatgtgaggggtatatccttgatggtacaatttcaattttcaaggaaaataatcagtgttagggtatcataggtaatctggcaagtagacacatttgttctgagttaatagacttaactcagactcttttagaataaatgtatgtcattttgtttaaaaataagaaaattagcagtaagtaccttcaccaggaacaccttcacgtagcatcttacaaatacttgagctaaagtctaatatacccaagacaaccattgaaggaggacagtacctcgtatccactcaatcctgtacattcatcatatagtcagaattcatgatagtattttttgtgacagatagttcagactatcaagattttcaagaaaaatctctaaattggttttggtataaatgtagcagaagaaaaactaaattactacagtaatttatggctttcatttctggggtttccaagaaagttcctgtgaatcctggtatccgatttacttctcacaaggttattaccattcatttaattcacacagctgtaatagttttgttataaaaactagaattaaagttagggatatgataattatcttatttctcagcttgtttttaattgtataccacacatagtcatgtgtatctctacgctaaatttctgattattgaaatacaaagtgatttttattaataagttgttaattctaataactaaacagaaggaattaatacacgtgtctcatatctctacttcttcctttgagctactctttgttttctgcacatattcttatagaattttgaaaaccatccataatcactccccaaaacctattttgtcattttttttaaaaaaaagattagtatggattttatgattaaatcagtctggacatacctaattattctagaaacccataaaaatattttaatatgtgtattttagtcttgtgctctttcctaatcagtcatgagaagtaatttttcttttcaatgaaactgagaccaaaaagttgagacttgctgatttctgtatggtaataagttagtaagagaccaacatcaaatttaaaatttgatgccttaaaaattaggttatctcatgccattatttaatttcttttttcaacacctgtactactatataatgattaatctcattttatttcactgagaaacactttgttctgattaccttgtttctaaaaatattaaatataaggtgtatctgtctaaggatcctgttaactgtccaatatagaaaaaaaaaaaaaaaaaacctatccaaaggcaagtagtatcttctctagagagttcagctaaggaaacatgcaaatcaattgcttagctgaattttcagtttctctccttaccctttaattcctactacccaagtataccttaaagtgccttgaatattaaaaattgatgctaaaaagaaaaagttattctcagaaccatagactatattagacaggttttgtttctaaaatgaagtaaattggcattcggtgatgattttgtttcatgaaaatttattgtaggtgtacacacacaagaacaagtgtattagtccatttccacattgccataaagatactacctgagactgggtaatttataaagaaaaaaggtccaattgactcacagttccacatggtttgagaggcctcaggaaacttacaatcatggcggaaggtgaaggggaaacaaggtacgttgtatatggcggcaggaggggagagagcacagggaaaactgccacttttaaaaccatcagatctagtgagaactccctcactatttacaagaacagcatggagaaaaccacctccatgatcctatcaccttccaccaggttcctcccttgacatgtggagattacaattcgagatgagatttgggtggagacacagagccaaaccatatcaacaagtatatgaggtgtcttttacttcattaaaatgctggtgaagatttcaattagatgaaagagtcagaaccatgttccttatacaattgtataattttctgaggatcttctcatgagacttcatttggagatttttctgttggtcgcgtcttctacccttagttatgtcagcatgattacagattatgagctggatctgagggttacagccttgatgattcaatttcaattttcaaggaaaataattactattagagtatcatcataggtaatctggcaactaagcacatttgttctgaattaacagacttaactcagactcttatgtacataacctacagttacttttacataacagcagagttgaatagatgaaacacagattatgtggcccataaagtctaatattttatttaatagttaaattttaaaaaattcaattaaatattttattttatggagaatttaagatatcattcagaagtgcaggatgaagatttaatttgctaatagtttaatttgctaataaataaaaattaaaatattttaaaattaaatatttaatatagaaggtttgacatcattcagaagtgtgagataaggatttaattaaatcattaatgcttgaattggatgatgtagacaatatgttattttgtagaaagggaagagccctgtaccactattgattaaggataatgtaatcaacaatataaaatagaatattctaagatacaatgttttgaataatgtttatttctcatattaaaatgtattatttattcaacattgattcataaaatgggatgtattagattattgatttttaacttaaaaatgcatcatctttttctctatatcattcaaagcagaagtattttgaactttaagtgcgtttttagtaattttagtaataataaaatcatcatcttgtacctaagcagaattttactaccttaatgactacaaaaattactacaaatccttagattggtgatgtgctgatagtaactgaagaataaaaccacatagaggaaaaattaattttccatttagtcaaatggatgaatctattaagaagaatattaaaagtaatgcacaggcttgaaggccagtgaagacaatgttgagaattgaaaaacacaggataaggcaggggacggtggctcatgcctgtaacccagcactttgggaagcctcactgagaaacactttgttccgattaccttgtttctaaaaatattaaatatgaagtatatcagtctaaggatcctattaactgtccaatatagcaaaaaaaaaaaaaaatttaaaggcaagtagtatcctccctacttgcgggctgatcacttgagaccaagggaaaaacctcctgtctactaaaaatacaaaaaattagccaggcatggtggcatatgcctataatcccagctacttgggaggctgaggcacaagaatgatttgaacccaggaagtggaggttgcagtgagccaggatcgctctgctgcactccagcctgggcaacagagtgagaccctgtctaaaaaaaaaaaaaaaaagaaaagaaaagaaaaacatagaataagataatccaaagtaatactttctttacagaatataaatcaaggtaaatttacaaagaatttgattagttgacgagcagtggggccaaagagagcctaaatattaagatattcaggaaaaaagtagataaatgttcatgaaataaagatagttaaaagaaaagaaaggaaaggaatgaaaatactcatatgccacaattttgtattttcatctgaatactcagtttatgtattatgatattaaatttctattcagctacaaatatgtgtagataggttttggctgaccaagtgtgatttttttaagggctatgataaacaaaaaggaatatggttcatgaagacagattactggcatataagtgaaactaagatggaaagtgatgaaatggaaggaatatgacaattatctataagtacttaactatactaacacaaattaaaggatggtatttaaagtgaaaaaagtcaagggaggagttgtcacccaaaataagactacctttttaataagtgttaagaaaaatacctgaatcaagttagaaagtaatgatcttttgaaccatgatttttaaatgtttaacaattaatttcctgaatgccaatatgggatagtatgaaatagtgctaatataaataatgaattgggtaactgtgattttatagatctttaaagatgagtattttcattgcagccttagctctgaactactttcttatatttttgataaatagatacctattgtctttaggggggttttgtacttttatttttattgagttaatgcgataactcagagatcagcaaatcctgtttttttataggcccacaagctaagaatgagttttgcatttataaattgtggagaaacataaaaagaagaacattttatggcatgtgaaaattatatgagattcaaatttcagtgtttaaaaataatgttttattaaattataaccatgctcattcatttgcacataacctgcagttacttacacaacagcagagttgaatagttgaaacacagattatatgtctcatacagtctaaaatatttactctctatttaaacagaaatgtttgctgagtcctgctgtaactggttagtgtgtcaaaataacgttgacgtaggaatggttataatggagtttgtgaaatttcttcattttaaagcttgagaaaagaagcctgctcatttttctgaggatggtttcagattattctacaaggaagcatatgtttggaaaggttgatctcctcaaattgtctacctttacatttttattttcttcttttttattgtcttctctagctattctctctctctcttcacatagatttccccctctacacacacacatacacacaaagtcttcaaatatggaactctaatgtggatagaatatagattataaatttctcttttattggaggctcatttctgggttttcagagtacaaagataaatctcattattgctgtcttaaatgttatataaaatatgttattagagtattttcatttaacacattgcatttttctatttattacttcattacgtcttaacaaagatatttcccctgaagaccatgatgaacttttgatttttgctaaatgccctgtttggcctcacctaaaatcatataccttctatgggaaattttatacaactggaaaagatacactgacatgatcaagtaatatatcataccttaaaaatctaaatggtatttgaatcgaatcagctaactttgagtggggaagaacagatgaaacattagtccctagataagtaaatatttaatagtccttaggtgagcaaacagtttgtaaactctacttactttaagcaaatttgagtgtctcttgattcttttatgtagaacattgtttgagccttccttgtttggcattttggcatttacttatattaataatattcatttatttactatttcatttataataattatgtaacatctgagtatcttggtagatgatgtcttataaatatgaccagactacaataatgatgaagataacagtaagtcaattttaggattatgtctttggactaattttgagtaattttgctacttttcactttattattattctcttaatgtagttagtccaattctaaggtttcagttataaaaataagaaaaaatggccaagcgcagtggctcacgcctgtaattccagcactttgggaggccgaggcgagtgggtcacctgaggtcaggagttcaagaccagcctggccaacatggtgaaaccccatctctactaaaaatacaaaaattagccgggcatgatggtgggtgccagtattcccacttactcggaaggctgaagcgagagaattgcttgaacccaggaggcggaagttgcagtgagccgagatcacgccattgcactccagcctgggcaactgagtaaaactgtctcaaaaaaaagaaaaaagaaaaagaaaaatctatcttatcctgtgctttaaacaaaaaaaaaatctcatgatattaataaaatcacctgcagtggcctaagacattatttagaatggaagtgacccatttctgagatgtttaatgtgcaccatagaattgccctcctcggaactgactttaattcaaagataaagtactaataaaatatctcaagtaaattttcctagcaatagaaaatagagaactgagtaaattttaacaatgacaacactctcaaactgttttgaaagataaagtatttcagttttatgggcatagatatagacacagaacaaacatacacagcaagattttcttagaactagcattttgctaaagaaattcagatatgtgtatggctgaaaaatgtgtaatttctgaacatgtatagaatttaccatattttcaaaagtacctctaagcaataagtggctatgatactttttagcacaaatctttgtgatagttttaaaaattctgagcattatttcatcagttcagttttttaagatagaagaaaaagggtttgtatattcatttattaaataaacatatattgagcacctactacattctgctatgcttggcactggaaatacagttaaagaacaaatcttagataataagtgcatttgtgattcttctactgtcaccttctccagtaccttcatttccccaccgtacctttgtgttttgatacttcctgcagtatttgtaaatagagaatacatacttaacaacttcatcttacatggcattgtgagacaacctaacgagaaaagagtacacagaattgaacatggcagtgtgacaacgtagaaaataagaacagggaagaacattatcagttcagcatcataaaggttaaacattgttgtaagtataaaatagctatttttaaaaatcagtgataaaatagctgttccaaaaattctgtgaatcattctgataaaggttaagtctgttgaagagttgtgtgtttaagtttttatatttttatagtgttgctattgccattatattgtagaaagtgcctcaaagcaataagtggcaatgatactttttcgcacaactctttctgattgtaagctttaaaattcctgaatgttatttcataagttcagttttctaagaatagaagaaaagggatttgtattttcattcattaaataagcatttattgagcacctactacattctgctgtgcttggcactggaaatacagttaaagaacaaatctgataataagtgcatttctgattcttctactgtcatctttcttcagtggagaaagagaggttcagtaataccaaaaatggaatagttgaaacaggaaaaaagaatcagaatactggctttggtgccctctttaatgaatactgtgaacgtgtatggtagagttattctataaacaacctcccatgtagttcactagtgttaagccagtgaagatcagtgcagtaccgtaagaaaaattgtccagcgttctgctttctttcttaaatgaggatcttctcagcaagatcataccagattctgaacagagggagtcatctccatcatggatttttttttagcaaggtattttttgtcacaaagttttccttcaaataacttgagtcttgacatgttttcaaactcaagtgtctgcttataaagctgttttattatctggccaagtgtgttggtgatggagccatctaaaccctctgtgacccttactatgctatcctttcctctttaacagtgttttcttttccccactgcaaaaccaggctcggcttccctcgtgctcatctacctatagtgtatctgaggtatattttgcacgtgttttcttacatggtcaataacatgctcgccctcaccatttttctcattttattttcctttcgccttaatttattttgccttgcactttgcacttgcctgaaagggatgaggataccaaagggggaaaattcacctgttttagggggaaatttctctatttttatgaatgatgcactgttgtctgaataacttttttttggcagtcactacatcacattgaaataactaaaacccagatagccaacttgattgctgtgactacctttattccataatgactcttttgaattaggtaatttattattaaactcaaattggctaaaggcaagattccagtttgtatatctatatatgtctgtgtctgatagctgaagatttgtattcaattagtgattgttgtgtctcattaaccacagacataggaaaacatccaaaattgattattaaatagaaaataaatatacatctattttatataaaataaaagatgtatcccttttttaaaatctcattagatgactttaataattttttgctacttatattttcctaagattcttgtaatctagaagagattaacagtaaagagattcatgttcttttagtaaaatattttacatgaaatttggcctattttccttgtcttttaggaggtttaattttttatccttactgtgttaaactatagaataaatgagttttcttgttttcaaaaagcagatttattgaaatattattaacagactttgaatatccattaagtctcctttcaaagcaggggcactgtttgagtagctaagaagaaagagtatgtaccttgaaatatgacaggtaaataaaagaacttcaggccaggtgcagtggctcacacctgtaatcccagcactttgtgaggccgagatgggtggatcacttgaggtcaggagtttgagaccagcctggccaacatggtgaaaccccgtctctactaaaaatataaaaaattagccagacgtggtggcgcacacctgtaatcccagctactcgagaggctgaggcaggagaatcacttgaacccgggaggcagaggttgcagtgagccaagatcgtgcaattgcactctagcctgggcgatagagtgagacttcgtcttaaaaaaaaaaaaaaaaaaaaaggacttcagtagcctatgaattttaagaccttcattctttttttacaacataatttctacatgtatttactttgtataggccactgtagctaccatattaaagccagtattatcagcttaattctgattgcagaaatattatctcagaatgtcatcccaaagaaaacccttgaaagatagtactgtttaaaatacgaggtagtatatgcagaaccagaggcagaataccatctgcagatctcaaattttaagaaaaaaccaaaagaaatagcatgacaaacccatagcctcacaaagttgaatttattgagtcaatagaattgcagctatcttcttcaatttttaactttgcaagttataactgtgagatttttttctcttaaaactgatttcctggggagttaacttcttgaaacataccactagggagaagcaaagaaaagaaagccaaatgagctatttttagtatcaacaaagacatttgaaagagaaggttggtatcatctcatcaccacattttctataggtcttttcttaattcccaaagattatgagtgctagtgtaaaaaatatataacccatttctttttgccacttcatccaggcaattctccatttcccatgagagtgtgtaagaagtctaccattggcatcatctccaatcacagcctacagcatccatcagggtattactttctctatgacagcatgtgtgcaggagggctctcacgttggaatgtggaactggcttcttgggggcattatgtatgctgtggcatttgcaccatggcactcagctcttaactctggcttcatctagatttgtttctttcattgtgacacatgggctttctttatttgtcatgaagtgtgtttctctttctgtcactcgtggtagggtttctctctttcactcaatgccacatctctgtggtctccataggtgctgtttatgtttaatttatgatgctataaagaccaataaaatgaagaactccttaagtaatattcgtgataatcctctgcctagaaataattgtttctttttagtcttaaattggtaaatatttcacagaattttagactgtaaaccttaataattaaaatttcaaggaatattcttcttagctttcaatttttcatttggaaacctcttgacaggatcattggtacaaagtacagtatttattttatagcatcactatggaggtagccaaaccttccatggctcgatctcttctttcccttacatttacatcatcatcttcatttaccttcactattgtagaaattaagtctccaatccctaatgtagcacattggtttaccaattgcatatcactatcttctgtgtcattcattagatgaaaaaaataagccttgctcaaaaatgaacctatccatgagttgtataggaacaagatttataacctcagctggctgatactatttagcaaaaacatttctccacgtagttatggtccctttgtaaaaaaaaaaaatatatatatatatatacacatatatatatatacacacaattattttacttgtgataagctttgtttttgatatctcattatcaattaaccttcataacagccttgtttggggtaaatattaatgtcatcctcattttaaagatgaggaaattgagacgcagagaggttaactatcttgccgatcataaagctagcaagtgagtggcagaaaattgtcttttcttaaataccatgctttctcctgttaagaagttgttaaaagtcattagctctgtgactagcatgtagtagtcttgtattttcacttcatccatttactttgttcaggttgattatatagtttggggtatatattttgagaagatgcacctataagatacaaaactttaattaatacaaaacgttagtagtgtgtattttcacttcatccatttactttgctcaggttgattacatagtttggggtatatactatgtgaagatacacctataagacacaaaactttaattcaagaaaatgttagacatctaacatttatggttatataatttattgtcatgtaatttattgttatgtaatttattgttatttttctcttatttagtcatttgataaatattgagctacctcctatgccttatttaattataatctgccagttatttcttggcctttggaattggctttacgtttagaatacataaaatattgtgaatgtaatgagatcagtgtctcatacagtttttcatcccttcaagcaaagtgaaaaaaaaagaactcatctttcacgtttctaactgattttcaactttgttccagcagtgttgtagcagagttcccttttcaaatcctttgaaaagattgcttcagaattcccttagtataaaccaaagccagaattaatactttcttctgacagaaactgaattccttctgacttatttgagaagctggaatatatactagatatgaatttattataatttgtaacacaatatctaacccaaagaaaattaataaacatccaagttgtcatgcttttactggtccaaattgaaccctttacagccttatctttaatgtcttagatttcccagtagcaaggttgatttagataatttgacatttagatgctaaataatttatttcctgttgactagacagggactgaaaattgtgtttttatttaatgcttaagaacttctagctacctaaaggaatgatggttttaaagttgtaacatgcaaaatagttgccctttgaactcttagacactattaggacaccaattctgatctaaacaaacttggactgcctaacagttttggagcttttgcaaacagaagtttcagttaaattgcagtgagtaagtctacatattcaagaaaagaagggagagaggaaaaaaggaagagaagaaaggtaaatgaactttaaacaccataccattttctatttcaaaagaaaaaataggaacattttttaaacaccacagaaccacaaactgtttaaactggaagaaactgtagccaaaaaataaagattctatactgtgagataatcacctaagatgttctactatataaaatctcatttagaaaatctttaataatgatttattacttatttcaatatatttatctacagtgctccaccctttcattcacatgtattatttttatgccatttgtatactatagttagaaaactggagatagtgtgaagaaatcttagaattctatcttttgaaaacactacaactgctgctattaaaatttattgattcctacctcactttcaaatttgtagaaatgaactggagtatataaattgtcttgttaaaaataaaattagtatatatctctctctctgacatacatattagtagctaatccatagagataatgggaaaacacattacattctgtttgacagggatatttgatatatccatctaattaaagcattctttaaaaagaattgagaagaattctgtctacttgggcatacatttttaaatttccataataaaaatatttttaaaacacactattgtagttggcactagcgaatttctgcttatccttgtatattgcctcatataatgatcatttacaatataaaagaggtcatcagtgaaaatagggcaagaaaaatttaaagtttaagatgagggaatattaatggatgtgtaacaagtttagaaagttcttaagctcccttaaaactaatatataaactatatgtatctttgagagagaaaggagatatgtatatcctctccttcatggaagtaggaatgaagagagtccataaagtacttatgtgaagtccagctttgtatatacacagattagcttatcatcatgatgttctaaattttctttcctatgttctagagaatttacaaatgaaatagattaattagacatatagctagttagagcccaaataaatgatggcacattataatatgatatgttataatgtcatattataatgtgatagcagtaaaatgacagctcacctgcatttatacttatagttccagctgctgtttgaatgtctttttgtaatatcaaactcagtatgtccagctctgctttctaaatacttctttcaatggtaatgttcttaaagtttccctgcatagaaatcttctagttatcttttactctttcttgtttttcatctttgacatttagtgtgacattaaattttgtcatttttgttatttctccttttgaattatctcctaatccttacttcggatacataaatgaactttgttgccacgtctactttaaaatcctggctttggccaaaaataaataaataaataaataatgaaaatggcagctttctatacattacagaggtttaagaaatgtgaagcagctcatggtcatatattgctatggttcatctccatggatttacacagatttggtttaccaccaatcctagtgtaatttttaaagactcaaataagtatcttcttgaccagcaacaaggcaaattttcttttgctccttttgggttttactcctaaacatgcatttgggtgaaatgtatagcctagactttggcaagtagaattatcaattttccctggtcaccttttttccctttcaaagcatttccttcccaaccagtgttcttcagctaagccacagaacacaggaagtaatatgtgtagctattttcttaagatcctgtaaagatgttgacattctatattcaaaaaacagaagtttattcattacacacaatgaatataaatgcattaaggcttaattctctcccagaattgaggaagatatagtaatcccatcttttaagtagctcagtacttcttgaagtcatttgttatttaaagacgcacttgaaatttcatgtttggaaattctttgtgttgcttttttttttttttttttttttttggatacctagagtctctgaatagcctgtgcttaccatgtgattttagggcttgagatcgtgagacatatttttattttttttaaataacctctttatttttctgaaagaaacagatttaatcagcttctcaccatattctaaaaatgttcctgcttggcagttattaacattttgtcggttttcttgtactgttgaagcagacttactgaagatcaatttaacatactgtttaaagtttggggctagatttgaatcctaatcctggatttgaaacccaaccctgtgccttactaactttgtgaccttaagcaagttaacttctctgcacctcatattcctgtaaaataggaatgataccaccttttggggtatcttaagtatttaacagcttaatattacttggtgcaatgcctgatatgtgtaagtactcaataaatattaactatattattatcagtatttattgttatattaaaggtccaaaggtaaagttattttttgtttcaactaactctttcagatacattatctgttaggtttttcatagagtaaaatacgttttatgtatagtgattagccacaacctgattgaaacaagtattagctccactatcaacttaacctgacatcagcacttgtaccattcctgccttacttctttttcctagtcattgtaaaggatatagaatatgaaatacatgaacacttaatgtctttcttttcattctgccaggtgactatcttctccagtttttcaattgtctttttctccaaaatcactttcccatttagtgtctggattagttatgcacataaacacaccccaaagatgactaataggaatagtggttttttattatcagtagtatattgtccttgtattctattatatgtcatacactacaagcaatcaccagtttataagtgggcaaagcacttcctcacaaaaagtaactttatagtgactagatttctagactagtgttcatataactcttaattagctgatattacactattagtaactgaattgagatttaaattgacatatatggattaatgtaggaatctatctactaattgtaacattatttcttaggaaaatgcactttaacttctaacagaatccagcctacttcaaggcattttacctgacaaattctgagttgcaatgagatctacatcctgttttcttccttggacagctcagtcttccttacagtactcattgtagtggaaggtaaagggaggaggaaactctagaaattgggacaaggacttccccacagcatcatcaatcactgtttgttgaaggagtgtatgaattgaatgtttatattaaagatgtatgccaatatcattaaatttcagttaactttatatagtgtgatattattagtcctagattacttcttgctgcctcttcctggtaaatgatgatatttctgaatgattctttattcatttgttaagtgctacttattaaataccctctgtttcttcatatcttgtaaacaagatatagatctttgagtcagcagagcaaagttaaacagatatgtgactgactgtgattaaaagaagtaatcatttctactgccgggtctgtgtcgatttaatcagatgtggtgagctataattgcatttctctttgccccagtttacccgtctctaaaatttgaataaactagacctttatgttcctcagaagggatattctggtgaaatttcagaaaatggaagggagtcatgacaaagctaattcatcatgaatgtaaaaacagaatttttcaggtacagtatgagaggaattatatcttgttatcctgtgtgcattttactttttacatgaaaattcagtcagagagccaaatatgtttagaaaacatactctgagcttaaaagaccataatggtttggatgtgctgtgtaaatgtaaaacttgaaattgatcttgttttgttatttttccttggttgtttatactttcagttttgctgaaactaccagtaggtcataataagtcagcaagcatttatttaacatctatacattgctacagagtagatattgccatattaagcatatagagaatgttgcaaaaattaaatatggggccttaatgattttacaaattgaaatattgtccattttttaaaaaatcataatgtatgaattcaggctatgttgttctaaaatatgactagaggaaatgtctttggctttgaaaactaaaggtctttactaatcgggtgaaaaaagtctgtaggaaaatcaccattcttgagtcctgtgttcacagaatagtcatgagtgagttattttaaatttcaccaaattattgttaagtcacaaaaaaagaatttggtaaaggcagattttcctagaatagacttgagtttttggaaccttattacataactttaaaatgccgtaatacctctttagaccacatttttctctatcagagatggtgtcaggttggtagtaaggcttatttaattaattttccaagttcagacatcttggaaaggagagataaaggcaaggcatgacattactctttataaacatgacttactggaggagaatgcaaattttcatcctttaaatcatttaatcggctttattgagttacctaatatatttgggtgatagaggagaccctgaaagaaagaggacctcaggaagcattataggtcagaatgagtagcatatgcacagcaaaagtagtttgtgaaagggaatttggtctttttttttttttaattcactaagttgaatttaagggcatattttgagtcttatggaatccattttaaacatagtgatagcatttcctgtgcatttttagccacttaattatgtgaataaatgcttgctaccctttacagttgcagctgtcattctccaaagtagattcatccacaatatttacagtcgtaaatcctaaatctattgtatatatttaagattttttaatagtattctttcaccattaggcagcacctccttgagaaagaatttacatttttattctcatttttaacaagaactatacagctaagatttatagagaacttgagggctttttctacaatgtactccatcatcagaagtaggctaaattagaaatagaaatggagaatatatggtgatgtcttttccattagctttgaaaaattcaacttgtatagttacatgtatttgatgtcagagtattttataagtatgcctgatttatcatactgacttgcttctttttaacttaaatattttgggaacacagactcatgtttcatttttcagtgagttattttatgtccatgaataagcgtcaatgcattggttgataagttgaaatcacctacaccctttgaatatgtgtttttgcatcactttcgaatctaccttttaaagtgaatttgacttaatttccatgtgacttttattagtagagaaagcaaataattatgaaacacagtaagggttattatataaaataattttattttacaataaaacagttggatgtggattttacctagaaagactaatattatatatatattatatttctcccttggaactgacaagggagaaaaagtaggtatattggtactcaagtgttttgtattttaagaggaaaaaaagaataaaaaaggggcaatggaaaaaagagaagagaaggaaggagaaaataaaaggaagggaggcaattaccatagtttttcttcttttttgacatcagtatttaaataataggttacttgttctaactttcccattttacatcgttgcagagcataagcagcagcttgtagaacaaaggtgaattcagaaagaccttaaacatatttttggattaatgtttcatgaaaccctgaatggaattcagattcatgtggtctttttatagccatagttttcaattatattagcaattttccttgtcctatttctgtctgcctcaggataccaaaaaaagggtctattttcgaaattttgttcataccattctgcacccagtattgcctggagtcatgaaaacccagcttgctgctattttttctctttggcaacttgctgctataccaacactcagcaattaaatctaattctgtttgggctaccatgcttaaatgttcttgttgagaatcatggcatgaactaatgcatggctctaaaaaggctactgttgtgtgtctgcactgaaggaaaaattccatagcaatctagcccctttggattttatactgaagctgtagattaatggtgaacttctgtgtaatgcttgacaaagaagggaaatccctagaaatgaaagtgtgaactgaggtaaaaatggtcttcagtcagatgctgctaaattaatcactagtaatcatcagttgtggaggttaggagtcccttcacagaatgcacttgggtggaagagtaggaaagagaaaaaaaggatgccagtgagacctgaaagagattatatgaggaaatgttgagtccatcttcatttgtgtgctgtctcaaacatttagctcagagtctgaaatacttttggtcaaattaggactgattttaattgtcttattatacaatttcacagcctcatcatccagcataaaatatatcaaaaatgacttaattccctcatatccatgacaattccaaactgtttttaataaactttataattgcctccaatattttaaaatttattaggaacactggtttcatgtttaaacaatcagcatcctttattagttcccttaagcattcatcttattttaatgtatacaatttttacttggtagaaaataaaccagatgttatttttccaagtggaaagaaatcttttttctttccttttacattacagtttcaccttgaaaatataagaagcaaatgaatggtcccaaaatttggcatttatttttctaagtcatgtttctgggctatgagttactgaattttgcttaatttattaatgtaaatacagtaattgaaccacacaactgtcagttcctccatcctttgatatgtgggctgatgaaatataaataaacaaaaaatgttgtgtgaccagcagctctggatcatctaaatgacctcctttagttcatttccctttccacatatcaagtttatctataacttcaccaatttattagttttagagccatgtagcacagttcaagagttcaaagggaaagtcaaaataatctggggttattcattcaacttcaactgctaccatatggcaaaggtctctgtagccattcttactattacaggtcaatgacagtagcatttctaaagtgctcttgtgcatgtaagtaccactccttcggtcaacctatgtcactgtgctttcacttgcaattatctaactttcagacataactgaactctatttctgatctgaaatgttccccagctagagttatctacctggcctttgctttatagagtcatatgtcctggtagctgcaaattaatgatgaatgaaaaagagggaggagtgatggaagagagagaagggagggatggagaaaataaaaaagggaggaaggaaactagactcgtttttcattccttttttacttcagcatttaaagggtaggtcacttgttctaactttcccattgtaagtagttgcagaacataagcagcagtttatagaacaaaggtgaggtagtaaaggaagtcatactgtgtatgtgctagagggaatcatactatgtcatttgctttaaaagctgtgtctgaaatcgctttggcttccttttaaacatcccacctgcaaggaggaaatatttgcaactgctcttcagattagtcgaccaggcgtggtggctcatgcctgtaatcccagcactttggaggccaaggcgggcggatcacgaggtcaggagttcaagaccagcctgaccaacatgatgaaaccccatctctactaaaaatacacaaaaaaattagttgggtgtggtggtgcgtgcctgtaatcccagctactcaggaggctgaggcaggagaattgcttgaacccgggaggtggaggttgcagtgagccgagatcgctccactgcactccagcaggtgacagagtgagacaccgtctcaaaaaaagaaaaaagaaaaaaaaaagattagtcatgatgtgggtcaaaatacctgtcttttctcttacacacatctttttttaaaatttatttatttatttatttatttaagacagggtttctctctgtcacccagcctggagtgcagtggcgcagtcttggctcactgcaacctccgccttctgggctcaagcgatcctcccacctcagcttcccagatagctgggactacaagtgcatgcccccatgcccagctaattttttgtgtttttagtagagacagggtttttgccatgttgcccaggctggtcttgaacttctgggttcaagcaatcctctcacctcagcctcccaaagtgctgggattacaggtgttagctactgtacccagccctttttaaattttataagctataccttttgattactgcctattgacttaaaagacagttccagatcaggggttatatttgtgcttttacagtctgctttatgttttgaaggttgaagtaaaaaatgtgaagagaaaaaaattgcaaacagaagaataatctaagaatccctgttccattacttattacctcatttacattaacccactttctcactgcagtttcctacactttattttttcttgtgcttcttttccctttccttgtgtgtttgtttttttcattagaaatcacctgtctctttatttctagttatttcttttcctttcctttttcaatgaaagtaataacccatttcagccactgagaaagagtatgaaccttaataattgttattaatttttgtgtttcagtgtgcttcaaaggaacaaaatgagcttggcatagctgcttttatgttctggtacactgagcctaaattctaggcaagtagctcacaggaatataggagaggtaatctggatgaaactaacataaataaattagatacaatatttctaactgtaaaaattttatgcatcatataatgaccctgtcaaaagactatttataaatagaatatgcctttttcagcttgagttaaaacataacgttaatgggtctagggttacagacttgtgaatctagttagcttcacagttgttctatggtagactgtaaactgatcccaaatgtcttaatgtagatgtgtatgcaggggaaggactgagaaacaatgattcacagggaatctatacacaattgagtaaaactgatttgaacagatagtaaaatggtctgtctatattatactaaaaggtttgaattttataattttttgatcaaatggcattttcaatgagagtttctggggttttttatttgtttcgtttctctttttgtttttttagacacccaggttggtgtgcagtggtgcaatctcagctcactgcaacctccacctcccaggttcaagcgattctcctgcctcagcctcccgagtagctgagattataggcgcacaccactgtatctggctaatttttgtatttttagtagagatggggtttcaccatgttggccagcctggtctcgaactcctgacctcaggtgatttgcccgcctcggcctcccaaagtgctgggattacagacgtgagccaccatgcccagccgtgtttttcttttagataacttttgtattgtttttcatacattcagtaaagaatatagataagcaaagagaaaattaaaattacccttcagctcctcccatgttaactgctagtaacttttatcagaaagaaataataaggatggtgaactgaagaaaagagaagagaaagtagggagttctacagataatatagagtaaatcaagaataggccgggcgcggtggctcacgcctgtaatcccagcactctgggaggctgaggagggcggatcacgaggtcaggatatcgagaccatcctggccaacacggtgaaaccctgtctctactaaaaaaatacaaaaaattagccaggtgtggtggcgggcacctgcagtcccagttactcgggaggttgaggcagaagagtggcgtgaacctgggaggcagagcttgcagtgagccgagatcatgccactgcactctagcctgggcaacagagcgagactctgtctcagaaaaaaaaaaaaaaaagaaagaaaaaaaagaataaagaaacatatgtaaaacaaagaattaccaattaaaaatttcctacatggaaaattttttaaaatttttccaagtaggaattttttaaaacatgtgggatgtaagagttggaaagctctaatggatgagtttctgcagagtttgatacaattatattgcccatatgataactgagcgatgcaagacacagcaaagccacctgaagcaaccacaggaaggaagcaagttggtcaatggtgcaactgtctaggacagtggttagaatttaatagcattctcagttcaataaatacttagtgaaggaaaaaaataatgaaaaaaatatatgggttgaaaacattgacattgtttgtttttaggatagtgtaaatgggtatttagatgatatcaaattctaaatttgagaaatccaagctaaagtgttttggggtattgaaagcctaatgtaaatgtccttgggaaaattagtttcttttttttatagttcccattatttaatgaaatgtttcaaatgttatatatagtaaacaacagataatataacaaacacccatttggtaaccatttagatttagcacattttaatgttttactatgatttattcagatcttttgatatatttttaggaaactgaacaattgtgacaaagctcaaatttcctttgcatagaattctcatataagaacaaaacagaatattaaaggcctggcacagtggcttatgcgtgtaatcccaacactttggtaggccaaggcaggagaatcacttgagtccaagagtttgtgaccagcctggacaacatagggtgaccccacctctacaaaaaaaaaaaaaattatctcggggggatgtcacatgcctatggtcccaagctactcaggaggctgaggtgggaggatcacttgagcctaggaggttgaggctgcaatgagctatgatggtactactgcactgtagcctggacagtagagtgagaccttgcctcaaaaaaaaaaaaaaaaaaaaaaagaaggaaaattaggattgtgttctttccacatatggggcatatgttgacccggcatttgaataatgctatatttcccaggatcctttttactcctctttctctctttctgcttatatttattttcaagtaacctactggtttatagtataactttaatgattttcagtgtgtgctatgaagatagaatacacagacccactaaatatgtgtgtgttgtgtgtataaatacacagattttatatatatatatgatcacttctgtttgttgtgctcagattacaataaaataaactggtcagaagcaggcaagatgtctcaaaactactctggctaatcctaaccaaaccactgtgtcatacctctatactagaaatatataggaaatcaaaaggaaccaaactggaatgcaaatgaaacaaaaatcactaacactgaaccaacgcacctcctggcattattaataacattgttctgtcccaaatgaaacttcatatactttggacatggaggttaatgattgctaaaaagagaaaatctttataattaagttttctctggtttgatggttattccatgtgatgcatctttccataaattttgagaatgcctcaacacttatagggatagatttaacagtcaggagaatactagcaagtgtagtagctatcatggatcaatagcattatgaaatcatagctttaatgcagaaatttatttatggtaaaacttcaataaacaacaaaaattgtattctgtcttttaagagatgccttcattgacttttatgaaatagcagattttttcccaaaaggtacttttgtatcccactttgctggaaccctaagtctgaacacccgtgtgtctttttattaccaatctttggcctttctgaccaattacaacagtcttctttgatgtggaagaggttacaaatatttccaggctaggagggattggggagagtaatttcagtctggatttcggtagtttgtatcatagtcattatagccattattattgtcactttcatcattaccagaaaaacatgtatttgtcctttatacaatgttggatatgataacaaatgctctacatgcattagcttattttagtctcacaataattctatgaggtggaaattcaacaaaacatttgagcctttgcacacctttagctgtttcctcagtctggaaagttcttccccatgatcttcatctggctgtctcaaatcttaactaaaatgatacttattcagagaagtcttccttgcttactcttgtctaaaatagctataccttatcactacttatttttttattccattactgtattttattttctttatagcactaaccactttctgaaactatcttatttatgtacttattagtttaggtgcttatcatctgtctactactattagaatgtaaattccaagatagcaaggtctttatcaattttgttcatgttttacctccagcacctagataagagcctggcgatggctctgggcaactgagcttagctcaacacatactcttttttattattattattattgttaatttcttttttccacatatttgttcaataattgaatagtattatcttgatttttgtagatgtggaaactaatacttgaaataatttagtcaaggttatttagctagcctaacttcctatgtttttcctgctgaaaagaggattcgctacatacacaagtctctagctttaaccgatctaattagtgcatgtctctggacctacaggtatagggcttatgttaagaaaaaaatttacatacatctgaaataatctgacctatattgctcatcctgaaaatgagttatatattatattattaaactatacttgttaactattacttggttagatcatgagaggcttgattaacaacataatgtacgccatacatagctgtaatactaggcatcagaatgcctagttcttatatatttctcgaagaaacttttctacacactttctaagctcttgctactttactagtgcagtatagacatatatttgtacatctttcatgtgccttatgaatgctagttaagcatttagaaaaataaagtcacaactttttcaatcaatctaaaatatgatttagaaaggaaaacaatacagccacactgaaatgagtaaagcattagggtttttttaatgatcaaataggtgataagacatgacatttaagaataaaaactaagaatattaaatctaattaaaaactcagtatttcaaacttcatgcttaatgaaaacgaatgtgactttcttccagaagtgtcacaaaatgcataataattacaaatactcaataattcaagtttttatattattgactgtatctattccttggcctctattttttagaattaatcaatattttctgaaaacttcctgttcacatactcacctaaattaatcttacttgatcttacttttgagaactgtcaaaatcacacacacgcaaaacaaaaaaaaatcagcatttcttattacaggcctagaatatcatccaaacaaaaggataatagtaggaacaacaatatagtaatagctaacaatatatactgttaactctgagctactctctaagcaagcactttacatgtatctctaagcaagcactttacatgtattcttattttctttacaaatatcttatgagatagatgttattattatcttcacttatacgtgaagttatgacttatacagtgttatacagctaataatggtagagccaaaattcaaatctagacagtttttttccagaatactactccccaaagttcttttgttataccattctccgtcacccctacattcaaatccctgttctcagtggttctcatcgctaagagaaacagtcaagagcaaagaagcaatgaaaattcaagttgtgattaggaatgcaatgattgtcattgttaggttagaaaggtggagtgattgatagtgtacagataattaagtttggaagtcaagagaaccaagttctattactactttactgtatgacctaaaaccagtaataattcctaccttctaacctttagaatgaagagtaattactctgtaaaataatcagttattcatcttaagattgggaaataatgaataatctgaaattcctcttagccaaaaatacttcatttagctttataatacattatataatttgggtagtaatttttcttcatatttatgatcaacattaacattttcagaacaagcaccaaaccaaaacgattgttggtaccaagaggagaccagcctgggatttgcaaagtttccagaggtcactgaacatggttcaacttggaattaaagctttatataggaaatacattaagaacatttaacattgatgcttaaattcatatttccttgagtcatggtgataaccagttctaaagaatagaaagtgtgttctacatattatagtattttctttaagaacaaataaggaactcaccaagttacctataaagaagcataaacaagctttgattttcagtggtaattataattaacttcaccagctatataacctgacacacttccgacttctttaagaatgggtcaatactgaaaaggaagtgtttttcacattaacctagaacttaggaaagctcggtggaatttaacaatgaaaatttatataacagtgggaaaacatttaagaatggtcacctggaaaagatttataaaattgttttgcttataaatattgtctatttgccggcattctcttatgttgtacatagatttaaaaaaaacagcagcccaggcgctgtggctcaagcctgtaatcacagcactttgggaggccaaggcaggcagatcatgaggtcaggagtttgagaccagcctgagtaacacagtgatacctcatctctactaaaaatacaaaaattagccaggtgtggtggcgcacacctgtagtcccagctactcgggaggctgaggcaggagagttgcttgaacctgagaggcggaggttgcagtgagccaagatcatgccactccactcgagcctggtgacagagcaagactccatttcggggaaaaaaaatacaaataaaaaataacattgctactctctatcagtgagcaataaatgactgaaaattcaaagaataaatggttatggatacatacacacgtgtgtctgtttttatgtgtgtatgtgtgtgtgtatggaagttcacctttgattagaggtttttaaatgtgattactgttaaatgattagtccatctgaaccaatgggaaaagcacaactgaagcagaattttttttaaccctgaggatttaataacttttttaagcaacagtgttccttttttgtttcttgtttcggtctattaaatgggcacttgtttaattcagtgaccaattttatataattttcttaaaaaaaggacaccttttatatctgatttgataaaagacagcaaatagaggtgggaaaggtttcatatagctataatattctgcagataaaaggaggcttggaaattatctggctcagagacttttaaccttttttctgccatggacccatgtggtacttggtcaaagcctacagatatttttttcataaaaatatttttaagtgtataaaataaaatatataacattagaaaaccaattcaaatcatgatcaaaataacttttaaaacaaactgcaatataataataaatgcctatttttaaatgcattaaataacaaactaggagcagatctaataactactataatttgaaatcattataaacataaaaagatatttataaccattgaagtaaaaggttctgttaatattactgtgatttgttgcctgagctcataatgaaagaagataataaatattaattagatttttaaatataaagattgtaatttcatttctctgtcccagtgaatggacctgtcttttacccacaagattctctcaagggacccattgacctgagttaaaacccctagaaacatccatattttgcaaataagaaaaccaagacccatagagaggagataactttactaaaatcatacaacacagaattagattaatcctagcagagctaatctcagacctttactcagactttttctgtagctttagtctagaagttggcaattcatctattatttgtcactgattcctagcatgatttgtagcaaattctttattcttattgtgcctcagattctacctatataaaatatatgtgacttaaaatattcataaagataataagaacaacttcaatttctattttatttttacttacaatagttttcactttcacatacattaccctacttaattttccccatattatggatgaggaaattaaagctctaagtgttaaatgtcacatccaaggttacacagctaggaagaggaaagtccagtattggaaatcataccatgggactccaaaggacatcctctttatcatgctgcctttcatgtcataaaaagccaaaactctttgagttcttcagttgaatatgtgctgtgatatcataaatctaattaaacacataagagctattattaaactcaaataagccaaatacttgcatcctaatttattccaaaaagtgatgcatgaatggaaccatgggaaaaaacttttctagaacaattatccatttgtgtttaagaagtaagaagagaaagaaatagaatgtaagagtctaagattgtagagttattggcttaatgttatttaaatcaaacttttgcttctgtttctgggtaggctaaagaggcaagtaatctgagtaaacgggtccctttttctccttcctcttaatcttatgagtagatggtactcaaagaagttcattctttcagagactgattactcttaaataagtttaataaggtagaaaaactaaagtcaaaataagccatgatgcatcaaaaatttctatcatctctgtcattacagtgaccagaccatgtaagatataaaacatcctgctctcttagaaaataaggaatcttcttaacctaacctgaaactcttggtatagaaaacttttattggactccaaatgtcactatttgattaaccttaagtaatattaatttctaaattcttgagatcattctgtaggatacccagatatctcttagctataatctacatacttctcatattatctgtcaatactatcagacccaaataagtaaaacttctttgtaagctgataaaacaggtacaggaatggctatgatcatacttatactattaaaaataaattttagtctgctgagattgaaaagaaaaataattactacaaaatattcagatttagcaaatgtttcctctgtacaaagcagtgtatttaatgtagtgggaaataaaaagaggataaagtcatgatccttttcctctaagaacctgcagtctacttggggactcatatcagtaattggaatatgagtaactattaactcctattctatattataaacttctataagtcctatattagaatttcaaataagatgccgtaagaatctaggcaaatctaaacctaggttgtagtgttggttgcacagccatataactttattaaaagtcatcaaacttttaatacttttatacttaaaatgaatgagttttatggtagataaattatatctcaacactgctaaaagagtttagagaaagaagaaattatttctgattgaggaacttgggaatttttttttaatggctggtgtaatctaagctggatcttaaaggacaagtagtatttgcatcagaaaataagcaacagtgtattccagataaaggcaacagcttgtctaaggtctaaaagttcaagaatacaaggcagtttctagaggagctggttgagactttgctccatgccttagattatatggcttgcatgcctaccgtgcatatggccatatggctatgacatttccaaaatgttctggcgtatccctactgagaaacgtataactgtacatagaattttccacctctctttgggttagaaacaagagcttgcctacattataatgaggagggtgtgtaatcacagagttattttacagctgtcagtggcaccactgatcataacaactactgacatttattttcatttttatagcttaaaatcactgatgaatgcattatctcctttgagccacaatctttattttttttctgtgaggaaactgagattatgggagggcccagagcctaaaataccaaagccacattaaagggaaagtcaagatattctggcctgctaagagtaaaaagaggaagagaaaatgagtacatgatcattgaacagtttagacattgctaactaaattgggatgtacacatgaatcaaagttcatctcacacaaaaagaataaaatggataaagttaactactgtcaccaataatatgaaagcaaagttgaattttttcctgaagagctgaaataagcctattattgacaggaatagcccattttaaataccttgtattgataacagagaagagtacttaggaaacagtttctaaatagcttttttgttgtttgcttttttaacaatgtaaaaagattaaaatttaaattgtgtctttccaaaacagaggacttctcagattatataagtaagcagctaaacagaaacttaatttctaatttaaaatgtgattagtggccagtaaagtcatgtttaaaatggaaagatagttttcctaatgtccttcaaagaagatgacttattttgttcttgactttgaccccatctgaccaagtgctcagaatttttcaatatgaaccatactgtataccatttacaagaaaaggaatacaaattagcctggtgagcagcaaaataggcaattttttgaaatcggatttgtgttaacctgcaatcaaatgtaatttccattttaatacttatacattcttatattgttatgaacctattcttaacacgggttttattttctttgtttctctcctccctcacttctgtgaaatacagaagggaaaggatgttattcacacatttgtacccccactaactggtgttacagtacatctggcttccactggagagcccctgacatcgcagggaacggtgatcaaaattccacacactagcttcaagctgggggctcgtagctactgcagcattgaaagggaatcttttcctggcttctttaaaataagcatggtgatgggatggtttaagggaagaacacctctcaaatcacatgaccactgctacgctttcgtgtgtcctgctttcttcataacagcttggcactacattctttccctgtatcttaatgggcttgtgtgtgtacaagtggggtggagggtggggaggtaaatggatggttatacattatgcatgcatctttcactgttaaagcaatgtgccttcccttatatgtcacaaattatggtcacagattaaatcttctgtgtcttgagatattgggccatctctctctttttggtgtgagattcatgtgtttgggtgtgttttgatgtttacaccctcaattgttcttcatgttgcatttaacgtaagttgaaatgttctcccataagagttagcttttcatgttgggctgaaaaagtcttcatttctgtgtagcaattcatgttattataacctatggctttcaattgtacctcccataatgaagagctgactttaaacactgtgctattcttgttatgacctaagcataaggtaagtgatttctctaactgtatctaaagattgttgttgtttgttaaaatttcttcgctttttttaaggcattttcacttttgttccttacatttattatgtgctctcccttctgtttttctgtttcacatcttaagatttcctaatggacgatgtgatcttcagcaaaaattatattacacatgtaaacacatgttgaaatgaattatttgatgtctcaaaacaatcttgattagtaaatgaatataccctatgttttcattaagtccttcatgttttttattttctccattgactttaatataatatgctgttcctacatgttattttagttttgattccagttgaaaggggaattatttgtcaatactgtaaagtcagatgttaactgaagtaaaataacatgatccagtagaataaagtagaaggtaatcagatgccataccttttatttgtaatccctgacaaatttaacgttaggccaaaaactgttttattttgctttccagactttcctttttttcccatagagtaaagccagggtaacataaagaaaaaaacgagaagccataaaacttgagacagatctgtgttaccttctttatagtccataagaacagtagttgtttctcaagtgtatcatttcaagtgtatgccattacattgtgagttaagtaaaattttcattttgaaattgtataaaattaagtacatattataaagagaactagtttcatggtgcaagagaaaaagttatttgctacatgcataaataataaacaacatttttaaatttttcttttcttcagtggtgtataggttgattgattgattgatttatacacacacacatactcaagatcactaaaggaattcttataatcattgatattaaagtgattctccccaaatctggttcaaatagccaatgtaatataaatgggaaagcattgattatactgctgttggcaatttatgaaccttgataaacgctcagattcagggaattgaattgttttcatcatccaaatttctccaccaaagctgtttgaaatatgtagttctaaactgaggtgccacaaagcaacacttgggtttctttattcaattcatgttatgaatgattttgcttgttaattttttaagttacctagggaacgggagagggtattttgttgttgttttggtttggtttgggtttttttggtaaagccaactagttcttcaccaccatttccattatatacattagaaaatgtatataagaggcattatataaatctgttggaacattttatgagacaatttgaactactcatctgaactgctctgttcattgtaaatctcttgtttctatccatacactagctccactctagattggaagggcttaaagatgaactctggaggaatagaggctacgacttaagagtaactattactgatcaaaggagccactttccattcgcaaacattgctttgcgctatgggtttgggctccttctgtttctacatcttgttgaatgaagactttcttgacttccatttgacttctttgaactctgtttttgtcttttaacatttccccctttcttttccttctctctcccagatttttctctcactcttctagctttctcttgtgttctttgaatcactttttgaaatgtagtttctctctttattaagcttgtctattgtctgttagtgtgtgtttcttttctttaaggctgtagtggtatagttacacttatgttcattccatagtatagcaacttgcttatttattttgcagcaagttcattagtcattcttaccctcttggtatgaatttttaatgagaaatagcagaacattctgcatttacatattgtccccttctgtaattccatactttattttccattgtttagatttacaccctcaaacctctctctcttttcttttcctcattcttgtgtcttcttccctgtattattttctttaagcagtcattgatttatttcccatttggtccagaattgtacttaaataagacttctgagtaaaagaatataagaatattatcttcagactagctttttccttctagtatgtttaaaactagttgaacaatctgggccaaaagagaataactaacatttggaattatttttccttttttttttttttttttttttttttggtgtgtgtgtgtgtgtgtgtgtgtgtgtgtgtgtgtgtatttttcttgtatgtatgtttgtgacttttttattgccgtttttttaaacattaacaattgtttttttcagggaaggacaaccataacccaccctaagttgcaacattcctttcataagttgtttcattatgatagtagattgtgttgaactatagaaattaatttgttgtgtatatatccatttgtggcaagctgctgtggaatgggaagcagaggtctggagcttaaatacagtttcttttgaaattaacaacatgttaatgacatgtaccatgctccttgaatgtaacagttttatcacatttaaaagaatgtttcacattgacttaaacatttgagtcaaagcataagggtttctgattgataaattctatatacacctaagaactggtaaataaatttgttcaatttcattgattttcaacagaagcatatttcataatcaatattataactatgataaattatgataatcagtaacaggttatcagaatcaaatgtaaatgttatataaggatcaataagtaacaggttatcagaatcaaatgtaaatgttatataaggatttctctattttcctcccattaatttatatacatactaaaaaattactataatggaatacttagttacaacttaattacttgaattttattattattctagtcaagagatatactgaatgccttactattaagggccaatatttacaactaaatatacagtaacaaatttccatataccgattttaaatacaaatgaataaaaaatcacctttggtttatctctgtgtaatttacaatattgtaccccgaatttttttctggaagtcagttctttctttaaggaaaagataaagaaaaaagatgaaacaagtataacatttttactaacatgttatgacatctgaaatactaatatataaagcctttgctcctagacctcaggagcttgcccattaaatatgcatatctgcctattcatgctataaaccctaaattactgagtttatgctctttctacaggtccagtccaggtgcagcagcaaggagaacattctcagagccagtaagtattttaccatttctggtgggctgctgaactagagcttataaagctaaaaatgatattttggtgaaaaaaaagaagaaaagcaatggggaatatttatgtgacaaatatgaatattagggcttttaccttctaaaaatattgccagtatcaatacattaataaatatttcccttaatctaattgtttttgcaagctgacaccagaactttgatgcactcctaggagggtaggaatgagctcctctgtgactctgaacctctctttaattgttccactgccaaaagttatttgaaaacaaactaactgaaaataataataataatattgaaaattcctgaacagagactaattctgaaaaaagaatatgtggctcccaagagggtacatcatactcattttgtgaatatgaattcctgacatataataacttcacaggcagcatgtgttagaacatagaaccttaaaccaagagtaaagaatgctcaatttatttattggtttgatcactaatagcattaactcaggagtcatttaactctgtatatcattcatttttctgtcttataaaaaggaactataataggttttccttatctgtacctttgaaatgatgtcacattgaaaatcgtgtcttaaaagatttgggatcctaagaaaaaagtgctatataaatgctaatggttttattattgttctctatatcttaatagcttaatgacatcattccatcttcttcctgatctttatcaagagaagtacaggggaatcatactgaaataggcctactgatactcataccactgggagttttagcaaattgaatgatttctatttctagcagtatgtcagcattatttttgtgttatactcctggttatgctttattacagtgaaaggatacagattaacatcagcaaaggcaaaaagatacatagggcagagtccaggagaaaccaggtgcaagcttccagttgccctctcccagtggagccatatggacattgcttatttctcccagcagcaatgtatgacagcatgcatcaagtattgccaaccagggaagctcactgagccttaatgttcagggtttttattggggttgggtcacatggccatggagtgctcatgtggctgatctttatttcacaataaaaaaatagagaccttcacaaaggtaaaaattcatggggtttttttgtgtaaatttttccatttttgttttgtaaatctgttatcttagctccaaacccttgggcaaacacaattattgcttgcccaagaccattatattggcaaggcgcagtggctcacacctcaaaaaaataaattcctctgagcccctttgaacctccaatttagggtatggggagtgtttccaattgttacagtgagataagtctcgcattagattgcactttgatttcttttctttgagctccctagttgccaactttattttgtgtcctaggagtaaggaatcctttttaggactcctttgataatctaactaaatttgaaaatgcatttatccttggtaaaaatctgtcttattaccaataacactactatttgtctctgtctgtccttgtcattttttgttgtatctctgtaaggggtacgttcataaggaaaaacatagacataggcctcagtaagtattttgcaagctggccctgaaaaccaagtttcaggtttcttgtaagactggtgtcctttagataaactttaccctggtcattgatcaacctatgagaaccttccttgttctctttctgttttgttagtgagagtcttgctatggaagaattataataggcaccctgaggaatttttgatatgaacaaaattgtttatttaaaaggagcctgagaataaaaaggaaacaaaattgcaaacaactaatgagctagttttttattggtttgaggaaatatcccaaataaattgagattccaaaagtacttccataagaaattccttggccaaggcaaaataaaatgtaataaacttaaaataatgcctcttttatatccctcaaaaccaaatcttggccctaattaagaagatacctgggtctcactggctatagcaggcaatgagtttgcaacttttctgaaattgccatgccattatatgacttaaccaagtccttagaaactgaacctctttcgtggccaccaaatgtgaacaagctctcacaaccccttgccttgctatatccatcaatcccaaatgattacatcaggatctttatccaatcttaatgaagctcctatattgaaagatctactttggaccaaacttcaaaatctcataaatatcctgactttcctttctgtgactctgactctaagactaagtctttgttgaagtgacatttttcctttctagagtcaaactccctatattaaaatctcaatttctctacttatttgctgtgtgaacttgaacaagtgctcagtatctctatgcctcactttcctgatctgtaaaatgtggtaataacttgttcagaaagggcagaaattgtaaagaataaaataaataaattttaaaatgtggtaataagatggtctgccttatagattgttacaaggattaaatagtataatgctaggtacataataatcactcagtaaatgttagctgatattattgttactattactactaatactaccaattaccattattttcttgataatgatgatgataataaaataggttactttttattgaacgttactgtgtattaaatacttttctacatggttcatcccacttaatcctcacacacaacaacaaatcctgtgagtaaaattctattaatttctacattaaatagataaggaaattaaagattccagagttaaataagttgcttgtgtatatggtaaatggtatatgagttgaagccagtatttcagaccttgattttatagcccacatttttttttgtttgtttgttttgttttgtttttgagacggagtcccgctgtcgcccaggttggagtgcagtggcgcgatctcggctcactgcaggctccgcctcccgggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcccacctcggcctcccagagtgctgggattacaggcgtgagccaccgcgcccagccttatagcccacatttttaaccaacatgctgtgctacctaattaatttcaataaggccttcaaaacccgattcaatattgtgcaaaatatctaagcaataggtaagaatagaaattgatagctggtatatccgtgggtacttataaacaaatatctgattatcagtgccaaaattgttttattaccacgtgttatcaggatgatatgacactattgtcttctgtcatctttccacctataattcatttccgtcaaccactttatttttaataaagcaaacttttgttatttttacgaataactggttttatgcaagaaatcaagtaaaataaaaaaattttacagatgagaatttatatttcagcactgtaggacagcgttttaatagctttctttctgccccaccccgagacaaagtcttgctctgtcacccaggatggaatgcagtggcacgatctctgctcactgcaacctccacctcccaggttcaagtgattctcctgcctcagcctcctgagtagctgggactacaggcttgtgccaccatgcccagctaatttttgtatttttagtagagacagggtttcactatgttgcccaggctggaacttgaactcctgacctcgtgatcagctgcctcagcctcccaaagtgctaagattacaggcatgagccacggtgcccagccttaattgttttcttgatgtactttgttcagcctgtgttttatcggacaagtggtacattttcctgggattaacttttctagatttttttagtatattttaatggaattcagaatttttattgatatataatatttgtacatatttatggagtacaggtgatatcttgatacatgcatagaatttgtaatgatcaagtcagggtatttgggatatccatcacctcttgagcatttatcatttcttcatgttgggaacatttcaaatcctatattatagttattttgaaatatacaatacattgatgttaactatagtcaccctactgtactatcaaatattagaacttattcattctatataactgtatgtttgtaccttttagccaacttttctttatcccccacaccatccttcccagcctctgataatatcactctgctcactgcctcagtgaggtcaacttttttaactcccacagattaatgagaacttgcaacatctgtcattctgtgcctatcttactttcacttaacatgccttccagttccatctgtgttgctgcaaatgacagaatttctactattttaaatagtagtccattgtgtgtatataccacattttctttatccagttatttattgatggacacagtttaattctatatcttggctatggtgaacagtgcttcagtaatcatgggggtacaggcatctcttttgatatgctgatttcctttcctttggatatataccaatatagcagaattgctgagttatatggtagttctatttgtagttttttgagggagtccatagtgttttttataatgtcttactaatttacattcccaccaacagtgtataagagttcccttttctccacatccttaccagtatgtgttagtttttgtttttttatagtagccattctaactggagccggattatatttcattatggttttgatttgcatttctctgatgattagtgattttgggcattttttcatatacctattggccataggtatgtcctcttttgagagatgtctattcagctaatttgattactttttaatggaattatttgggtttttgctgtttagttgtttgaattccttgtatgttgtggatattagtcccttgtctgatgaacagtttgcaagtattttcttccatgttgcaggttgactctactctgttgattgtttcttttgctgtgcagaagcttttcagtttgatatagtctcatttgtctgtttttcttttgttgtctgtacttttgaagtcttagccaaaaaatatttgcctataccagtgtcctaaagtgtttcttctgtgttttcgtctagcagttttatagttctcgttcttatgtttaagtatttaatctattttcaggtgatttttgtatataataaaagataggcgtctaatttcatttttctgcatatggctatccagttttcccagcaccatttactgaggaagacaccttttctctgatgcatgttcctgatgcctttgtcaaaagttagttggttccctattctgtttcattgatctatatgtctggctttatacaaataccatgctgttttgcgtactacagctttgtagctgctattgttacaattactactagtactactagtactactagtaatactatgattagtatactggtggtacttctggtattatcattattctttttttttttttttgagatggaattttgctcttgttgcccaggctggtgtgcaatggcacagtcttggctcactgcaacctctacttcccggattcaagtgattctcctgcctcagcctcccaagtagctgggattacaggcatgcgccaccacacccagctaatttcgtatttttagtagagatgggatttcaccatgttggccaggctggtcttgaactcctgacctcaggtgatccacccgcctcagccccccaaagtgctgggattacaggcgtgagccactgcgcccagccttatcattattctttagcgtaaaggcactgtcttaaaagatctactcatttagtgaagatacattaactagttggaataacaaattaagctttaaaatacactagtcttacgtaaatttatcagataatttggctgccacctctgagagcagagttttaagaaaatggatgcatttaggactatgattagggtataagaggaagggaaagcctaaaggaaggcatgtcaagcttgggtacctttataaatcactccctccttaatgaagtaattatctttcttggcacttctgtctcctagtgttccttttaaactatctgtttgcattttctccagcttctttggtagctctttttttttttttttttggcccagtcattaattatcagtattattcagacttctctcatagatcttccattcacactctatattatgcatgagcaagaccatctattaacaagtctttcaagtaaaccaaatctataactccaatccatatcttcttcctaaacttcagttttttttccaattgtctgttgtagatcttttcttaaatattacacaagtatctcatactcaacgtgactaaaactaaatttatcatcttaatttactcttcttccatatttcaaggagtaacatcactagccactgatttgtccaaaccagaaatctttagtgtttattattcctcatcctacaagcatttttatcattctaaaatacaaatctaaacctatcatactcctttaataacattaacccttaaatggctccttattattcttgtgtaaaggcccaactccttaaaattgcttactattggcttctgcttatctctagttttacctggaattcagtgcaccagccatatgaacatttcaatttgcaaatagttccctctttcccaaaatgctgatttctcatttcttccaaaacctggataactcctacttatcctacagttctttcaggaagccttctatcacctcccaaatctgagcaaagtgcccctcccaagttcttttctagtatactgtagtttccctactttattgcaagagtatttacagtgtagtgcttttctgtcttctccactgtcctctctactccaccctaagcatcttgcaagacctcatctatcttgttccctgataccattaccagaatctatcaccatgactctctctcaataagagttgattggatgactgcataaataaatgagaggaagaccttaagcagacagagcaagcaaaagacagcagaattgctaaataagaaaccagtatgggaacagaaaaggaaaataatgaacattagcaaaaactctaatatatttattgaaaatactgggggttttgtttgtttgtttgtttgtttgtttgtttgtttgttttaactgctccttctcttcaaattatctcatgtatccactttggcccttatcccttcattcattctcactactgccacccaggttctcgacttattactacctcttgcctggagtgtaagtcagacttttcagtcttataccccttaatttgtcatagatggataggtcttctggttagttttcttgcatcttactattaagaaacatgaatttttatcttttttattattcccaggaaagaggattttgaaataatccttggagaagtatgttaatttcttatgcctcctatttttagaaaaaaatttctgtttatctcttgctgcaacctaatcccttatcatcttgattggcattcactggatctgacaatagctgcttaccatcacttagattacctttctttatataactaaggataattagcaattgacttccataaatatttattgaggtactatttataagcactatttttctcgacttttttatctagtctaagtaaaccaacttattcaattttccttgctatatccttatgtagtttatttactaggttctcgaaatttaaaaagaaaaaaatattttagagattgtatctcactatgttgcccagactggatttgaactcctgggctcaagcaatcctcctgcctcaatctcctgagtagccatcatgcctggctttcaaatataatttttttatttgtgaaacctatattcccaaagtactattcgctattcaatttaaattttgtcttatttctcttatttttctcggttatcacctttttattttatatgaaaagttgcatcattcattactttgagtcaggctttttaccttcctcgttgtcaacattatagcaggtattgctaagaaacattaagttaatagataggaagccccaaccctcatatcctcatagagacaccaacttaaaagcaatatatggtcataatagcttcatgaaaactccagaaaaaaggttgttgcaatacccccaagctggcacaaagccaagaatagccacattgaaatggataagaactgttttactttacctgtgatagtccctcctccaagtcagcatagcttagcatgataaagagaaaacaccctactcatggtttctttctgtgggggaagagtggaaacatacatccaatattctagcttttcagaggactgcccaaataactgccttctatctcactgcattgatggaactaccacagtttgaatgcctgagggctactgaaagccagggagagtggaggcagcttgctgtagtaccacagggcctacagtgccacacacaggcaccagcacctctcagtgcaatctggagaaagtgcccaattcttgacttttcactcaggagggagagagaagagtggaacatgcattaggtgttctgactttttggagggctaccaagagaatggtttctctgttgcctcactggggtggtaacagagagctggtgtactttggatgtctgcgggccactgagaataaggaacagtgatggcttgctacagcagcaccacagagcctccagtgctgcagacagacaccattgagagcaagagattgcaagctcctgacagagaaacctgcaaacctctctaattgggaaattacatacacagacccagagaagtcacattcccccgctttcaaaaaggtttcagaggccgcctcagaatttctagccaggttgattggtgagagtgtcccctatataaggccagtctgtaaagattgggagacatggctgtttctcaaatgactaaaactcagcaaaaaatcacaaagcacaccaagaaatcaggatacatgcccaatcaaaagatcaaagtaattatctagaaaccaacctcaaagaaacagagatttatgattacctggcaaataattcaaaataattacctttaaaaaggtcactgatctaagagagaacacaaatggacaactaaacaaaatcaggaaaccaatgaatggacaaaatgaagatttcaacacaaagttagaaactattaaaaaagaaccaaagagaaattctggagccaaaggatacaataactgaattgaaaaactcactagaggggttcaacaattacttgaccaatcagaagagatcaacagcaaaattggaagacaggtcatttgaaattattgttagaggagcaaaaagaaaaaaaaggaacagaaaagtaaagcaaagaaagccaaagaggccaggagtggtggttcacacctgtaatcccaacactttgggaggccaaggcaggcggatcacttgagtccagggattcgagactagcctggccaacatggtgaaaccccatctctactaaaaataaaaaaagtagccaggcctggtggtgcacacctgtaatcccagctactcaggaggctgaggcaaaagaatcgcttgaacccaggaggtggaagtttcagtgagccaagattacaccactgcactccaccctaggcaacagagtgagaccctgactcaaaaaaaaaaagaatgccaaaaagatttataaaatgccattttgtggaccagtgtatacattatgagagttccaggagaaaagggacaccaaacttatttgaagaaataatggtcaaaaacttcccaaatttgatgaaagaaatgtacatccagacacttgaagttcaaaggatataactaaggtgaatccaaagaggcccacactaagacatgttataatgaaactgtcaaaaatcaagggcaaagagaaaatttgaaaggagcaagagaaaagtaactcatcatgtacaatgaagttcccataagaatgtcattggataaaccttacaggtcagaagggagcagtacgttatattcaaagtgctgaaggaacaaaatctgccagtgaggaatactgcatccagcaaaactgtcctttcaaaaatgaaaaaagaaagactttcccgggcaaacaaaacctaagggagttcatcacaactagacctggcttacaagaaatgctaaagagagtcctgcaagttgacatgaaaggactctagacaacaacatgaaagtttatgaaaaacacaaagctcactggtaaaggaaaatatatatatatacaaattcagaatactatattactataatggtggcatgtaaatcacatgtaacactgtggggatggaaaatgtaaatgagtagacttttatatatgattgatagattgttctgtttcatgtaagtctcatggtaattacaaagaaaatgcttatagaagatacagaaaagaaaatgagaaagtaatcaaagcatatcgataatgcaaaggaagacagcaagagggaaaaagagggactaaatagctacaagacggacagaaaacaacatgtgccaataataaggcctttaagtgtaattggattaaactccccagtaaaaagacaaagtgaattaatggattaaagaaacaagatgcaattatattctgtctacaagagactcatgctagatgtaaagacacatataggctgaaaatgaaaggacagaaaaagatattacttcatgcaaattataatcaaaagagagcagtggtggccatagttatatcagacaaaatatagactttaggttaaaagctgtcacaagagacaaagaagaatattatactgaaagaacagaaatatataacaattataaattaaaatccagctaacattagagcacccaaatataagaagtaaacattgacaggcgtgaagggagaatagacaataacacaataatggtaggagatttcaatattctactttggataatggatagaacaaccaaaaagattaataaggaaacagagaacttgaacactgttgaccaattagatctaacagaatattccacccaacaatagtaaaatacacattctttcctagcatacatggaatattctgtaggatagaccacatattaggctaaaaaacaagtcttaacaaagttaggaagactgaaacctatgagatcttagtggactgaaactagacatcaatagcagtaggaaaactggaagatacacaaatatgtgaaaattaaatgagacactcttgaacaaccagtaggtcaaaggaaaaaaaaatgagagaaattagaaatatcttgaggcaaaaacacaacacaccaaaacttatgaattgcagcaaaagcaatactaagagagaagtttatattagtggcatgtactttaatgagggggaaagacctcaaatcagcaacctaactttttacctcaaggaatgagaaatagaataaactaaatcaaaagttaggagaaagaaggaaataataaagatcagagcagaaataaacaaaatagagaataaaaatactaggaaaaaaagcaatgaaactaagagtaggattctctaaaataccaacaaaattgacaaactcttagctagacagacagaagactcaaaataactaaaatcagaaataaaaggagacattgcaactgatgcttcggaaatagagatgataagagactgctatatacaattatatgccaacaaattgaatcacctagaagaagtggataaattcctagaaacacaaccttggtgttcagtcacagtcttggtgactgaattatggagaaatagaaaatctaaacatatctataaccattaaggatattgaatcagtaatcaaaaacctccccataaagaaaacctcccaataaagtaaaacccatgaccagatggcttcactagagaattctaccaagcatttaaagaagaattggtaccagttcttctcaaaatattccaaacacttgaagaagaaggaatacttccaaaataaatttattaggcaacattaccctgatacgaatagaaaaaatacaacaataaaaaagataactgataaaaaaaattgatgcaaaaatcctcaacaaaatactaggaaaccaaattggattatacacttcagccatgtgggatttatccctggaatgcaaggatcattcaatgcatgaaaatcaataaatgtaatgtatcacattaacagaacatggaatgaaaatcacatgatcatctcaaaaggtgcagaaaatgcattttagaaaattcagcaacctttcgtgatataacaatcagcaaactagaaacagaaggaaattacctcaatataataaaggtcatttatgaaaagctcataacataacatactaaatggtgaaaaactggaagctttttttttttaagatcaagaacaaagcaaagatgctcatttttgccacttctttttagtataatactggaagttctaatcaaagcagctaggcaatgaaaagaaagaaaatgcatcccaaatggaaagaaagaagtaaaattatctctgtttccagatgacatgatcttatgtagaaaactctgaaaattccacttatatacatacatgcacacacacacacacacacacacacacacacacacacacagagaaacactaactgttaaagctaatacaagaagccagtaaaattgcaggggtacaaagtcaacaataaaaaatcaattgcatttttatacactaacagtgaatgattaacaatctgaaaaagaaattaagaaaatcccatttacaatagcatcagaaagaataaaatacttaggaataaacttaatggagaaaatgaaagacttgtgcagtgaaaaccacaaatcattgctgaataaagttaaagacacagtaaatggaaagatacctggattcatggatggaaagacacaatattgttaaaatatccatactacccaaaggaatctacaaattcaaggcaatccctatcaaaataccactgacattttttatagaaatagaaagtaccaccctaaaattcatatagaatttcagaggtcctgggacaaccaaaataatcttgaaaaagaagaacaaagctggaagtcttacatctcttgatttcaaaacatattacaaagttacagtaatcaaaaaagtctggaactggcataaagacagacatataaactaatgtaacagaatatagagcccagaaatacatgttcgtgtatatggtcaaatgatctttgaagatggtgccaagaccattcaatggggaaagggcagtctcttcaataaacgttgttgggaaaacagctattctctttgcaaaagaacgaagacagacccttatcttataccatgcacaaaaattacctcaaaatggattaaagatctaatagttaagtctaataggtaagacctgaaactatgaaactcacagaaggaaatatgcagaaaaactttatgacattgaaatgggaaacgatctcttggatatgataccaaaaagcacagacaacttatacaaatgtagacaaatgagactacctcaaatttaaatattttctgcatcaaaggaaacaatcagcagagtaaaatggcaacaacagaatgggaaaaaataattgcaaatcatatatctgataaggggttaatatccagaatatataaagaacccctacaactcagcaacaaaaaaaatcaaatatcccaatttaaaaatggggaaaggacttgaatagacataactcaaagaagatatacaaatggccaacacacatatgaaaagctgctcaatgtcactaatcatcagggaaatacaaatttaaatcacagtgagataccacctaacaccattaggatgactactaaaaaaaaaaaaaaatagaaaataacaagtattggtgatcatagggagaaattggaacccttgtgccctgttggtaggtttgtgaaatgttgcagctgctacagaaaatagtatggcgtttcttcaaaaaattaaaaatagaactttcatatgatctgtcagtctcacttctgggtatatatccaaaagaattgaaaatagcatctcaaaaaactacttacacacctgtgttcatcacagcattatctacaatagccaagatatgaaagtaatcttaatgttcattaacagatgaggggataggcaaaatatggtctatttatacaatgaaatattattgagcctccaaaaaataaggaaatcctgtcatatgctacaacatggatgaaccttcaggacataatgctaagtgaaataaactaatcaccaaaaactaatacttcatggttctacttatatgagacatctaaagtaattgaactcatagaaagtagaatggtggttgccaggggctgggaggagagggaaatagggaattagccaatggatgtaaagcttcattcacacaaaatgagaaagttctagcaatcagttgtacaataatatgcatatattgttaattctgttaaattttttaacataaatacttaaaaattgtttaagagggttacaaaatgtatatagattaagcatctggaaaatgtattaaaaagttaagttaatcattgatcatagaattatcctggaatggacatatattgtccttcagtgtctcttttttgtgatgtgtatatgttaccattctatgtgtaacaagtgaattactgattctcattattagattcaccacctacataccaatggctttctattttaagcctgacttctcttccaagctccagattctccttgctgttgtgtactggaatcaccctttgatgtcctgctggcatctcacatttctttcatcagaaaccagatttaggatcctttcctccaaattattcctgtattgttcttttatacaattacactcccacttactctaataactaaatttgaaatctcctcatgatattaccatctccttctcaaagcatagtcagtcagtcatggaaccctctgctgcagctcttctaaatatcctttttcccattcttgttgtaatagttcaggccttctgcatcattctcctttgggattgcagtagcataataattgctcttcctatcttcagtctcttgctccctgacagtcttccatcagtcaagtattacattttaaagtacatactacttttctactgaaaatcttgaatagttctccattttccatagtactaagcctccagaatttgtcctgaactgaattgaccagccttataccttatatttcatcctcttcacctccaacctccagcttcattgggcaatttcgcattctctaaaagtactttcagatctttgtaattttgttcatattttctccagtttcatatgttcttctcccttttctcattgtttaaagatcccccctgtaaagccttatagtttgtcccatcagaattagctgttgctttttctttgttatcttacatagtgttttgtttgtactttaaaacataagcatacacatagtctgttattttttccttaaaacacagcctgatttgtgtgttccttgaaagactgtgtaagataggaatctcatctggtttatttcaacatactcccaggccaggtgcagtggcttgtgcctgtaatcccagcactttgggaggccaaggcaggaggatcacttgagcccaggagttcaagaccagtctgggcaatatagtgagatctcatctctatcaaaaattaaaaaattagttggatgtggtggcacatgctgtagtctcagctactcaggaggctgaggtgggaggattccttgagcccaggaggtggaggttacagtgagctgagatcaagccactgcattccagcctgggcaacagagcaagaccctgtctcaaaacaaaacaaaacctcactcactgtgtttaacaaagtgccctatattgaccagaataaagtttgaagttgtaagtagtgtttgcttatctatacaaccgttctactttgtcagtctatataatctagactgtactgtgtgcataacatctttggaccttgatgttaaggcctttttttcttcctcaaagaggtgataatctagttaagaaaatggacatgtatataaataagtataattactgtgagatatgtggttaatataatatgcaattagaagtcctaaaaattgagtattttatagtacctcagtgcaaaaatagacatacgtgcattgtttcagaaaggagagactattgatgaaagtgatttttgaaattttgaaataatttcaaacttcagaaatgttacaagaatagtatagagaattcctgtatatctttcatccagactcccccaaatgttaacattttgtcacatttcctttatcatttctctctataaattaatatacatattatcccaaactacttgtgagtaaattgcagacatgatgcctctttacccctaaataatttaatgtgtatttccttccaaaaaaatctggagggatggcaaataaaaaagactttctcttacataaccacagtacaattatgaaaattaggaaatgaacattgccacaatactattatgtaatcttattcaaattacattttgtcagtttttctaataatgttctttataacaaaggagacaacattcttctgatctgggattcaatccagaatcatgcgttacatttagttatcctgtctctgtagactcctttaatatggaacaagtcttcaagtttgtctttgtctttcattacctttatatttttgaagcatatagctcagttattttgtacaatgtccctcaaatttatatttttctcaggtttcttaatggtttaattcttgttatacatttggtcaggaatatctcaaatgtgatgttgtatctttctcagtgcatcttatcagggggctcatgatgtcagtttatcctattactggtgatattaactttgatcacttggctaaaagggtgtctgcgagatttctccactgtagttaatgagtacagttaataaatatcttgtagggatatactttgagaccagacaaatatgttttgtttttcttgaggcttttaccttctagtcttagcattaactgattatttttccctaaaccaattattactagatggttgccaagtggtgattttctaattccaatatttcttcatgtaacagctgaccttctgttataaggaagaatttattctcaggccagcatattttcaaaatgagaaaggcatcatagctctactttgggccttattggtatttgcccaaaatacaaacactttctttttttttattttttttattatactttaagttctggggtacatgtgtagaaggtgcactttttttacataggtatacacgtgccatggtggtttgctgcacccattaacccatcacctacattaggtatttctcctaatgttatccctcccctaaccccccaccccccaacaggccctggtgtgtgatgttccccttcctgtgtccatgtgttctcattgttcaactcccacttaggagtgagaacatgtactgtttggttttctgatattgtgatagtttgctgagaatgatggtctccatcttcatccatgtctctgcaaaggacatgaactcatccatttttatggctgtatagtattccatggtgtatatgtgccacattttcttaatccagtgtatcattgatggacatctgggttggttccaagtctttgctattgtgaatagtgccacaataaacatatgtgtgcatgtgtctttaccatagaatgatttataatcctttggatatatgcccagtaatgggattgctgggtcaaatggtatttctaattctagatctttgatgaatcgccacactgtcttccacaatggttgaactaatttacactcccactaacagtgtaaatgtgttcctattcttccacaacctctccagcatctgttgtttcctgacgttttaatgatctccaacctaactggtatgagatggtatctcattgttgttttgatttgcatttctctaatgaccagtggtgatgagcatattttcatatgcctgttggctgcataaatgtcttcttttgagaagtgtctgttcatgtactttgcccattttttgatgggtttttttttttcttgtaaatttgtttgagttctttgtggattctggatattagccctttgtcagatgagtagattgcaaaaattttctcccattctgtaggttgcctgttcactctttttagtttctaaattttttagtttcttttgctgtgcagaagctctttagtttaattagatcccatttgtcaattttggcttttgttgccatttcttttggtgttttagacatgaagtctttgcccatgtctatgtcctgaatggtattgcccaggttttcttctaggatttttatggtcctaggtcttatgtttaagtctttgatccatcttgagttgatttttgtataaggtgtaaggaaggtgtccagtttcagttttttgcatagggctaaccagttttctcaacagtatttattaaatagagaatattttccccattacttgtgtgtgtcaggtttgtcaaacatcacatggttgtagatgtgtggtgttatttctcaggccttcattctgtcccattggtctgtatatctgttttggtaccagtatcatgctgttttggttactctagccttgtaatatagtttgaagtcaggtagcgtgatgtctccagctttgttcttcttgcccaggattgtcattggctatgtgggctcttttttggttccatatgaagtttaaagtagttttttccaattctgtgaagaaagtcaatggtagcttgatggggatagcattgaatctataaattactttgggcagtatggccattttcatgatattggttcttcctatccatgagcaaggaatgttttttccatatgtttgtgtcctcttttatttgcttgagcagttgtttgtagttctccttgaagaggtctttcacatcccttgtaagtcgtattcctaggtattttattctctttgtagcagttgtgaatgggagttcactcatgatttggctctctgtttgtctgttattagggtatagaatgcttgtgatttttgcacatttattttgtatcctgagactttgctgaagttgcttatcagcttaaggagattttgggctgagacagtggggttttctaaatatacaatcatgtcatctgcaaacagagacaatttgacttcttctcttcctatttgaatatcctttatcgctttctcttgcctgattgccctggccagaacgtccaatattatgttgaataggagtggtaagagaggtcatccttgtcttgtgctggttttcaaagggaatgcttccagtttttgcccattcaatatgatattggctgtgggcttgtcataaatagctcttgttattttgagatgtgttccatcaatacctagtttattgagagtttttagcaggaaggagtgttgaattttgtcaaaggccttttctgcatctattaagataatcgtgttttttgtcattggtttggtttatgtgatggattacatttattgatttgcgtatgttgaaccagccttgcatccaggtatgaagccgacttgatcatggtggataagatttttgatgtgctgctggattcggcttgccagtattatattgagaatttttgcatcgatgttcatcagggatattggcttgaaattttcctttgttgtgtctctgccaggttttggtatcaggatgatgctggcctcataaaatgagttggggggattccctctttttctattgtttagaatagtttcagaaggaatggtaccagctactttttgtgcctctggtagaattcagctattaatccatctggtcctggactttttttggttggtaggctattaattactgcctcaatttcagaacttgttaatggtttattcagggattcaacttcttcctggcttagacttgggagggtgtatgtgtccaggaatttatccatttcttctagattttctagtttatttgtgtggaggtgtttatactattatctgatggtagtttgtgtttctgtggaattagtggtgatatcccccatatcatcctagcactttcagaggctgaggtgggtggattacctgaggtcaggagtttgaaaccagcctggccaacatggtgaaaccccgtctctactaaaaatacaacaattagccaggcatggtgacacatacccgtaatcccagctacttgggaggctaagacaggagaattgcttgaacccaggaggtggaggttgcagcaagccaagatcgcaccactgcactccagcctgggtgacagagacaagactctgtctcaaaaaaaaacaaaaaataaacaataataatttgctcacttaatattcccagaaacaatgccttagcccgtgtttgttcgttttgttttgttggtattttttctttttcttatttctttccaggtgaagtagaattcaccaatttttaggaagatgtatattttccccaggacatgttagctggtgttttcttctgttgttgactagcacttttctgaatctctcaaggtatagcaagagccggttgatgtaaactatactttataacatcttattttccagaactccatgagtgctgctgctgcttttgttgttgttgttgttttaaaagcataccccagccaccgtttatggcatcaaaagcattataaaatatgtgtaattatttcttgagtacccccttcctcctcctcctcctcctcctgtctccctctctctgtctctctctctgtctttctctctgtctctctctgtctctctcgtctctgtctctctgttggtgtgtctctgtctgtctctgtctctctctctctgtctctcttgctctccctccctctctttctttttaaaataagctcaggtagatctaatccatttccaaggcctgaattcttaactttagaaaccccagatttcatctccatacagaatcctgtacaaaactgacgagttgatttctggacttggatgcctaataggtattacctattaataaagacccaaccctaaaatctgggtttgcttctcccttgactcacctgtgatccagacttaccgtctcaataaattgtaccactgttcacctaggattctgggaggattttcccaatctgtatttccccgtgtcctaaaggacccatgaccaagccctgtccgttctgtctcaaatatgtatctccaaacacttctctcaatttccacaactacccgcagccccttgtggaacaactggctctttgaaaaacatcccagaagttgtttcagctttttgctatgaggcctaagcctgaggcctaagacgctctctgtctctttttctctatctctgtctccctctctgtctctctctctgtgtctctctctcttgtctttctgtctttgtctctctctgtctctgtctctctctgtctctgtttctctgtctctctgtgtgtgtctgtctttgtctttctctgtctgtctctctctgtgtatttgtctctctgtgtgtgtctctctctgtctctctgtctccccctctgtctcagtgtctgtctgtctctctgtctctgtctgtgtctctgtctctctccatctgtccatctctctctgcctctgtctctctctctctgtctctccctctcttggtctcagtgtctctctctgtctctgtctctctctctctgtctgtctctctctctctgtccatctctctgtctctgtctctctttctctgtcactgtctctctctctgtgcatctgtctctttctctctctgtgtgtgtgtctctctctctgtctctctcctttcctctctttctttttaaaataagttcaggtagatctaattcattttcaaggcctgaattcttaactttagaaaccccagatttgatctacatacagaatcctgtacagaactggcaagttggtttctggacttggatacctcatagatattacatattaatagagacccaaccctaaaatctgggtttgcttctcccttgactcagctgtgacccagacattctatctcgatttttttttaaaggaagaatttatttaaatcatttttatatttagtatatattcataaattcttattttattttattaaatagattaaaatatgttactgttctaatttatgttgatgataaatttgtatcagatttagccaaagggagctcttcaatcttgttccaagatccttttgacatgttcctatcattatttgagcactttcttactgaaaacagttgtgaaggaagagttgtaatttcccaggaaaataaaaggatgagagaaaaattactctaggcagaaacagcatcatatgctatggcagaaaactatgaaatagtacagtgtattctgatatctacaatattatcaattttctgagtgatggaataatgagagatgagactgaaaggaaagcaaataagggttttatatactattctaaggaactgaaattttatcctgtaagtgataatcaactattgatataaattatgaagctaacattttgggacagcaatgcctattttatcatctttatgtacagaaatctcaggagaacttccatattttttaatcagccctagtaaataataattctttcagctatgcttttttggttttgtcagaaatgctttgaggctcattgtcttgaataagcaagtagaaaagttgtaaaactattagattgaagacaatatgaaaattattttcagatgtacaaagtgccctgtagtcctgagcctacaaactctaccattgccagtgtttccctagagctttggaaccactttctcctaattggagagagttatatgaaagtctaaatgctttgtatatctgaacacacattctttaaattaccaaggaccctaactatttaagctgaccatattactattacctatctttgctctttaagtttcctaggaaagctattccttatcttaggcggtttgctcttcagaaagatccaggaaatagaaatacaaggaattgaagctgcaaataccatgtggaatagaggcagtaatattaataggaacagaacaagtctcctgatatttgcagtatatccaaaaaatgaataatgatttacactttatgtagtttagggagcttttctactgcttgttttgaaaaatgaagtttcttgaggttctgaatttaatcaagaaggacctgcatgaacatcagaacatcttgtttctgctatgttctctcctatgatcaaaggcatcttttcttcatttattttgtgtgtgtgtgtgtttgtgtgtgtgtgtgtgtgtgtgtgtgtgtttgtttttttttttttttttgagacagagtctcactctgttgcccaggctggagtgcagtggtgcaatctcggctcactgcaacctctgcctcccggattcaaggaattctcgtgcctcagccttctgagtagctgggactacaggctcctgacaccatgcatgactaattttttgtattttaacagtaatggggtttcaccatgttacccagagtggtctcaaactcctgagttcaggcagtccacctgtgtcagcctcccaaagtgttaggattacagacatgagccattgcacccgacccatttccttttcattttaaaaatggattttcagggaaggccggtcatggtggctcacacctgtaatcctaacactttgggaggccaggggtttgaaaccagtctgagcaacatagggagaccccatctgtgcaaaacatcagaaaattagccaggtatggtggtgtgcacctgtggtgccagctactcgatggggtgagacaggaggatcatttgagccagcaggtcaaagttgcagtgagccgtgatcacgcaactgcactccagcctgagcaacaaagccagaccctgtctcaaaaccaagatgaaacattgtatattaagaactgactggtttaagaggatgcattttaactgagaaaaataatttcattggtataaatagctccatttcaagatgaccacaccacaaaaaaaggttactgatagataacaaagatccatattgttactctgctcagtagaaaggaatccatttgtactttctgtgaccctttggaggctttctacatcatagatagtgtcattagtatttaaccatgtctttgatgatgacaatcctgagtgaacccctattcattttgcgctgagttcttacatagtcttttcagtgattataactgtaccatggaggataggaaatctcactaacatttttattacttcctctgcaaaaattctgaactaaaatatagtcaacctcatctctggactaaactggaaaatgtaagagacaagttaagttgtacttatggaactgtaggctcattagagaaacctgtagcatcaatttgtgcccactttagaatagctttaatcctacaaatctacttaagaaaagtaaacccattgcaggggaatgctgtcagtttagatgttataataattcagtctgtcactcttagctccttagctcagttcagacagctatagtggggaagatgtctagactccctcccctacctctgccccaactctcaaataaaaatcctatatcctaaagaaccttgtagtttatttttaccaaacaagctagtctacctgcaaattaacagtaacagtgatatcaccaggtaattttaatattgtaaattaaagtgagtattctcttgaatgctatgatcttctcagtgggacatgtattttcacatgttttgtaatacatatgagtttaataaagctaatgccctcgcagattctctttgtgaccattagtaatcatttgtaaggtagctatcagaatatatttgtggccatgaaatagttttgcttcataggaaactattttttctatccaaaagtaaaacttatttttcattataaccttaccttttttaaaatgtttcattccttcctttcctgtttctgcctaaaggggttttatgggctaccggctgctaggtgataactcactggggccttcaagaggaaaaagtgcatacttttttctcaatttttttttctcttctaacaaacttctgttctacagtcacaatcaacaagagaaacaatcaacattttttggtcctttttcctgctgattaagtttgttgttgttgttgttgttgttgttgttgttttgagagagagtctcaccgtgtcgcccaggctggagtgcagtggcaccatctcggctcactgcaagctccgcctcccgggttcacgcctttctcctgcctcagcctccggagtagctgggactacaggcgcccgccaccacacccggctaatttttttgtatttttagtagagacggggtttcaccgtgttagccaggatgttttctaatggcccaagacagtaagaggtgctttgggtttgtaatttacaaaataagagaagtctgtgacaacttttttttttttttgagacagagtctcgctctgttgccaggctggagtgcaggggcgtgatctcagctcactgcaacctccgcctcctgggttcaagcaattcttctgcctcagcctcccgagtagctgggactacaggcatgcgccaccacgaccagctaatttttgtatttttagtagagacggggtttcaccatgttggccaggatggtcttgatcatttgacctcgtgatccgcccacctcagcctcccaaagtgctgggattacaggcgtgagccaccgcgcccggctgaagtaggtttttttattggcgaagtagctaattactgtataatttggggtgagtcttgagtgggaagaagcctcgtggcacataaaaaggtgcttaattgatattgaaaacacacgcacgcacacacatgcatgcacacacaaccctacctgctgatgtgccagagaattacaatactcctcctttgagacattgcttttagttaatttgttatatatccaaaggtccttgtgttaacatgcaaatagtttaaccaaggaccggtatcaatccaatagcaccacagtatgttaatttcttcaattaagttattccacaatgtatgcatatctcaaaacatcatggtatacaccatgcatatataaaatttttgccaattaaaaataaattttaaataaaatgtttatactataggtctataaaaaagtacaaattatttttccggtgaggtaatcactttatgacaaagactttataaatattcagtggcttagagaagtaaaatgacagcagaaagcactgctttactttttgcttcccaattttggactttgtttgaaagatttgccattcattaaataccccaagtatttactgagtatctactataagtgtaaggaaggcactattctaaaagtgacagagaatacaaagattaataagacataggctctgtcttcaatgagtttaccatctactagcagaggtaaggcaaatatttaaatatctatagcataagatggagagtgatagataccagaagacaaatataaacaaggtataacattactttagtgatggaagagattattcctgccagtagataaccatactgcaatttccaaacaacaagaaaaaaaaacaaggaggggccaagatgaccaactaaaaacagctacggttggaggctcccacgtagaagaatgaaaacagcgagtaaatcctatgccagcaacttgaggtatccaggttctctcactaggactgaccaggcagttggtgcaacccatggtaagtgaggaaaagcagagtggagtgacagccaacccaggatccacacaggggaaggggaactcccactcccagccaagggaggtagtgagtgattgtgctaccccgcctggggaaccatgctttttccatggatctgtgcaacccacagatcaggagattcccctcataagtccacaccacccaggccttggttcccaagcacagaactgtgcagattcttggcagccgctcaggtggagactgcctaagacaaccaagttcctaggggagggggcggctgccatcactgcagctgcctgctgccagagatgactgagctcccagtgggaggagtggctgccatcactgcaactgcctgctgccaagacaactgagctcctgcggggagagacggctgccatcactgcagctccagtctgccagtttagagaggaaaataaataacctgatggagctgaaaaacacaacacaagaacttcataatacaaccacaagtatcaatagctggatagaccaagggaaggaaggaatttcggagcttgaagactatcttgctgaaataagacaggcagacaagattagagaaaaaagaatgaaaaggaatgaacaaaacctctgagaactatgggattatgtaaaaagaccaaacctacaactgattggggtacctgaaagagatgggagaatggaaccaagttggaaaacgtacatcaggatatcatccagaacttccccaacctagcaagataggccaacattcaaattcaggaaatccagagaaccacagtaagatactccatgagaagaaaggtcatccccaagacacataatcatcagattctccaaagtaaaaatgaagggaaagtattaagggcagccagagaaaaaggccaggttacctataaagggaagcccatcagactaacagtggacctctcagcagaaaccctacaagccagaagagattgggggccaatattcagtatccttaaaagaaagaatttccaacccagaatttcataaccagccaaactaaacttcgtaaagtgaaggaaaaataaaatccttttcagaaaaacaaatactgagggaatttgtcaccaccaggcctgccttgcaggagctcctgagagaagcactaaatatggaaagaaaaaaccaatacctgccactacaaacacacactaaagtacacagaccaatgacgcttcgaagcaactacatcaacaagtctgcaaaataaccagctagcatcatgatgacaggatcaaattcacaaatatattaaccttaaatgtaaatgagctaaatgcctccagttgaaagacacagaatggcaagctggataaagagtcaagacccatcaatgtgctgtattaaagagacccatctcatgtgcaaagacacacataggctcaaaataaagagatggaggaaattttaccaagcaaatagcagagaaaaccaggggttgcaatcctagtgttaaagtcttacaaaacagacattaaaccaaaaaaaaaaaaagatcaaaaaagacaagggcattacataacggtaaagggctcaattcaacaagaagtgctaactatcctaaatatacaggaggacctagattcataaaacaagttcttagagacctacaaagagacttagactcccacacaataatagtgggaggctttaatactgcactgtcaatattagatcactgagacaaaaaattaacaaagatattcaggacccaaactcaactctggatcaagtggacctgacagatatctacagaactctccacccaaaaacaacagaatatatattcttctttgtgccatatggcacttactcctaaaaagattgcataattggaagtaaaacactcctaacaaatgccaaacaactgaaatcagaagaaacagtctctcagaccacagtgcaataaaattagaactcaaggttaagaaactcactcaaaaccacacaactacatggaaattaagcaacctgcccctgaatgactcctggataaataacgaaatcaaggcagaaatcaagaagttctttgaaaccaatgagaataaagagacatcatgccagaacctctgggacgcagccaaagcagcgttaagagggcaagttatagcactaaatgcccacatcagaaagttaaaagatctcaaattgacgtcctaatatcaaaattaaaagaactagagaaccaagagcaaaaaagaaaaaaaaaaggccaaagctagcagaagacaagaaataaccaagatcagagcagaactgaaggagatagagacacgaaaaaccttaaaaaaaatcaatgaatctaggagctggtttgttttttttttttttggaaaaaaaaattaataaaatagactactagctagactaataaggaaagagagaagaatcaaatagacacaataaaaaatgataaaggggatatcaccactgaccccacagaaatatgaacaaccatcagagaatactataaacacctctatgcaaataaactagaaaatctagaagaaatggataaattcctagacacacacaccctcgcaagacagaaccaggaagaagttgaatctctgaatagacaataacaagttctgaaattgaggcagtaattaatagcctaccaaccaaaaaaagcccaggaccagatggattcacagccgaattctacgagaggtacaaagaggagctggtaccatttcttctgaaactattctaaacaactgaaaaggagggactcctctctgactcattttatgaggccagcatcatcctgatatcaaaacctggcagagatacaacaaaaaaagaaaacttcaggccaatatccctgatgatcattgatgcaaaaattctcaataaaatactgacaaaccgaatccagcagcacatcaaaaagcttatccacatgatcaagacagcttcatccccaagatacaaggctggttcaacatatgcaaatcaataaacgagatttatcacataaacagaactaaacacaaaaaccgcatgattatctcaatagacacagaaaaggcctttgataaaattcaacttcccttcatgttaaaaactttcaataaactaggtattgttggaacatacctcaaaatataagagcaatttatgacaaacccacagccaatatcatactgaatgggaaaaagctcaaagcattccccttgaaaatcagcacaagacaaggatgccttctctcaccactcctattcaacatagaattggaaattctggccagggcaatcaggcaagagaaagaaataaagcatattcagataggaagagaggaagtcaagccatctgtttgcagatgacatactcctatatctgaaaaccccatcatctcagccccaaagcttcttaagctgataagcaccttcagcaaagtacaaaatcaatgtgcaaaaatcacaagcattcctatacaccagcagtagacaagcaggaagccaaatcatgaatgaattccctttcacagttgctaaaaagagaaaaaatacctaggaatacagctaacaagggaagtgaaggacctcttcaaggagaactacaaactgctgctcaaggaaatcagagagcacacaaacaaatggaaaaacattccacgctcatggatgggaagaatcaatatcatgaaaatggccatactgcccagagtaatttatagattcaatgctgttcccattaaactacccttgacatttttcacagaattagaaaaaaactactttaaagttcatatggaaccaaaaaagagcctatataatgaagacaatcctaagcaaaaagaacaaagctgaaggcatcacatatctgacttcaaactcaactacaaggctatagtaaccaaaatagatggtagtagtacaaaaacagacacatagaccagtggaacagaatatagaagtcaaaactaagactgcacatctacagccatgtgatcttcaacaaacctgacaaaagcaatggggaaaggatttgctatttaataaatggtgctgggagaactggctagccatatgcagaaaattgaaaccggaccctttccttataccttatacaaaagttaagtcaagatggattaaatatttaaatgtaaaacccaaaactgtaaaaatcctagaagaaaatctaggcaataccattcaggacatagatacggacaaagatttcgtgacaaaaacgtcaaaagcaattgcaacaaaagcaaaaattgacaaatgagatctaattaaagagcttctgcacagcaaaagaaactgtcatcagagtgaagagacaaactacagaatgggagaaaattattgcaatctatccctcagacaaaggtctaatatccagaatctacaagaaaaaaataaccccatttaaaagtgggcaaaggatatgtacagacacttctcaagagaagatatacatgcagccaacaaacatggaaaaaagctcaacatcactgatcattagagaaatgcaaatcaaaaacacaatgagataccatctcaggccagtcagaatggcaattattaaaaagtcaagaaacaacagatgctggcaaggctgtggagaaatgggaactcttttacactgttggtagttcaaccattgtggaagacagtgtggtgattcctcaaagacctagaactagatataccatttgatccagcaatcccattactgggtatatacccaaaggaatataaatcattcctttgtaaagatacatgcatgcgtatgctcattgcagcatttattcacaatagcaaagacgtggaatcaacccaaacgcctatcaatgatagactggataaagaaaatgtggtacctatgtgtccagaattggtgagttcttggtctcgctgacttcaagaatgaagccgcggaccctcgcagtgagtgttacagttcttaaagatggtgtgtccggagtttgttccttcagatgttcagatgtgtccagaatttcttccttctggtgggttcgtgatctcactgacttcaggagtgaagctgcagaccttcacagtgagtgtcacagctcttaaaggtggcacggctggagttgttcattccttccagtgggttcgtggtcttgctggcttcaggagtgaagctgcagaccttcaccgtgagtgttacagctcttaaaggcagcacggacccaaagagtgagcagcagcaagatttattgtgaagagtgaaagaacaaagcttccacagcatggagggggaccccagcaggttgctgctgctggcttgggcagcctgcttttattcccttatctgacctcacccacatcctgccaattggcccattttacagagagctgattggtccgttttcacaggttgctgattggtgcgtttacaaaccttgagctagacacagagtgctgattggtgcatttacaatcctttagctagacacaaaagttctccaagtccccactagattagctagacacagagcactgattggtgcatttacaaaccttgagcaagacgcagagcactgattggtgcatttataaaccttgagctagacacagagtgctgattggtgtgtttataatcctttagctagacacagagtgctgattggtggatgtacaatccgctagctagacataaaagttctctaagtccccaccagattagctagatacagagcgctgattggtgcatccacaaacccgagctagacacagagtgctgattggtgcatatacaatcctccagctagacataaaagttctccaagtccccaccagactcaggagcccagctggcttcacctagtggatcacacgccagggccgtgggtggagctgcccaccagacccacaccacgtgcccacactcagcccttgggcagtccatgggactgggcgctgtggagcagggggtggcacctgtcgtggcaggagcccacagtgggggtgggggggggtcactcaggcatggcgggctgcaggtcctgagccctgccccgcaaggaggcggctgaggcccagcgagaattcgagcgggcgctcgcgggtcggcaatgctgggagacccagcacaccctccgcagctgctggcctgggggctaagcccctcactgcagggcccgccgtacccacgcccacccagaactcgtgctggcccgcaagtgccacccacagccccagttcccacccacgcctctccctccacacctccctgcaagcagagggagccggctctggcctcggccagcccagagaggggttcccacagtgcagcggcaggctgaagggcttaagtgcagccagagtggacgtgaggccaaggaggtgccaagagtgagtgggggctgctagcatattgtcacctctcacctatacaccatggaatgctatgcagccgtaaaaaggaatgagatcatgtcctttgcagggacagggagggagctggaagccattatcctcagtaaactaacacaggaacagaaaaccaaacactgcatgttctcacttaaagtgggagttgaacaacaagaacacatgggcacatgggtggggggggcaacagcacacactgggtcctgtcagagggttgcagggaaggagagcatcagaaagaatagctgggcctaatacctaggtaatggattgatccgtgcagcaaaccaccatggcacaagtttacctatgtaacaaacctgcacatcctgcacatgtatcctggaacagtaaataaaataagtaaaataaaaaaataaaacttaacagaaccatcaggtggtttactaccctctttttctttctccttcttttcttgcttccttccttccttcctctttctctttcttgttctctttctctttctttcattttcttacctttctgctggactgttacattcttcatggcaggatatattttactgtcagtatcccaagtccctaactgtttctggttcataaaatgcagtcagtaaatatttgttgaatgggtatgtgtatcactgatcatcaaacttgctgtttaataagaaaatgcctattacaaagcatattcaacagataaaacctatgtaactaaaaagtagaattttcttctcagaaactaaacatatttttaaaagaaacttttgtaagattatatccagtttgcaccataaagtgcagcctatcacaaaaaaaaactgtctgatctgagacctataaagctgaataagaagcagaagcagcaatatcattctgcctagttacactggttgtgaatgatttttttatatttgaatgagtaggtcaagacctcaatgaaaatgagttataaataagtttatatttcaatccttttttaagtgttcacccacaatttgaatagaaaattctgtctagcaataaataatctctaaggtttttcaaactttgaaaattttgcgattttgattgaccatgagaagaaatcacatattaatagtataagcaactttgtatatatttttcttaggtgcctatgacaatgtcattagtcttagaatgaaaaccctttggggtagtgcctttaagtcagttcattgaacatgtctggagcagccactgggttttgacacatgatgtaacattgctaacttgatttaatgttccaccagagcaggctgtattttggaggcaggagaaacagtttcttacctgctaatcttcatctggggacatttgaaattgggagttgtgatattataagtcattgccactttttaatcagtgttacagcatcatattcttagttaattatcttactgtttaggtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattacagttatcatcattctttttttttcttatttctactcaataagaaaaaggctaagggttcagccttaacagtatacagagtaaaatccatgaaactgccttttcattaaaaaaaggaaaaaaaaaaaaaaaggaagaaaatcagctgtgtttctgctgtccatgaaaataccaatactgcaaactaaagaaagggttctcagcactgagtgaggaaagtagttaactctgagtctgtatgatgtcctttctgtcagaaatgggagacaactaatatgtcttgtaatcatctttttctgtttggaaaacctgtatttaaatgtaaaaatgtaaaaaaaaatattaatttatccatggatactaagacaacggaaaggtagcattccccagtattttgtttttaattaacaacttccatttctaaaaattcagcataggagttgtatttaggcatccagttccaggagaccaggctcctgaggagaacttccagccaataaagcttgtggtttctccccaacaccaaaaagagaagttgtatttagtgcaatttgaataaaatatagtttcttaatttgttatgcagaaacaacacaacagaattaattttataaataaaaaactttatagaatcataaaatattcaaactacaatgaacagtagagagcacaaacaccctaatttttttgtcaaggaaactcaaactcagaatagcagaaaatgaataggattaaggtctcaagatttacattcttccttttactacataattgtgctcttcttcaaccattaaattataaaaaataatggcagctaacttactggtgccagattttagctctttcgtctgtgtccccacttagacaaggattgttattatacagtttgcccttatcctacgtctttggttcacattcttttagatatgcatatcattaggcttaaatcgtttgtttttcttttactcctcaataaaggaaagattagaaaactcactagagtaggggattagtcaggaattaactatgtgatttcagaacaattttaatggaatagttttgtttattattaaaggtagaatgttgagatatttattggtatcagtagaaaccaagacattttcagaaaatatgaatgtaaacttaagttataaaaaaattaataatactttacctgttataaaaataaataaaccatccctggttttttcttttttataatttcagaggagtttcccttaacatcagtccttagaaaaatctcaccatgtattccaggtcacatttaaagagacattctaatttaaaaaaaaaaaaaaaagagttggaaattgccatttcatttttcctccagagaaaaatgctgtcatatgtattctcttttcccttcatgtgcttgtttcccattcatttgttcatcaaatcagttgtcacttgtacttgagcagactcttcatagatggataactttttgtcaagtgtttccacctatgatgatgaaaaataataatgaggttcacattaaacctttgaattggatcaaactcaattttttgtgcaaatgggtattgtaattagaccccctaggcactttgattaggtgtttagaaaccatcatacatagaaacttaatttactttgttcaacaaatatttaataaacatcaagtaaatgtcagatactatgttaagtcctgtatttgcaaagatgaataaaaataaaactcctgccccatggatttcataggctagtgcagaagagatgggtaaattaatgtggtacttgtctcctttaattggctcctttacaggcttgccttcctttgtcaattccttgaaaagctttctttacagttttttttctttggctcttttcacatcttgtccattgacttcagatggcctcatgcaggctagtagtttcagataccatttataaagtgaattgtaagtctataccattgcccagagcttgtccaagctccaaactcatattctaaatgtattatgtatctgctgccagtaaatataacatgacaaatactaaacttattttgtcgacaatacttgtttttctacatcctcttaaaactgtcccttgttctacattccctctgttactgttttagtttaggtgttttttttcttttttttatttttctgagatggagttttgctcttgttgcccagtctggagtgcaatggcacgatctcggttcacggcaacctccacttcccaggttcaagtgattctcctgcctcagcctcctgagtacctgggattacaggcatgcaccactatgcccagctaattttgtatttttagtagagatggggtttctccatgttggtcaggctggtctcgaactcccagtctcaggtgatccacccacctcgacctctcaaagtgctcacaggagtgagccaatgcgcctggcccagtttaggtctttattattaacttcctggacaattgttataggctcccctccccccagttaacatcttcccaatccgttctccaatttgatgccaaagtaatctgttcaaatttgctaattcgttattaacactccctacacgcaactcttcagcagttttttcataacctcaagataaaattcaaactccttaacatgtcatgaaaggccctttataatctgatttcttctaatatttttgtttcttctcttacctccttatcatcagaccttgcttctccctaaacctgacatgatgattcttacttcttattctctcttacctctaaggctttatttatatatcctttttttttaagagactaggtctcactatgtttcccaggctggccctcaactctcagcctcaagcgatcctctcgccttagcctcccaaagtactagtattacaggcataagccaccatgcctggcccctttgcttatatagtttttgcttggaaaaactttatcttacttctctacatattaactactgcctaactaccacatattctttaagatcaagcttaagatgcttctcctttatgaagaagtctttcctgatgtctgcttccccctttccctagctgagttaaacactcttcattcgtgttcccatagcaccttcttcatatgttttgtaagacaactgactgaaatatttgttcactattaattttaaatgccctaataaataacatggatataaaaaaaaagcagagttctgtaagtgtgaatcactgtaaattgaattgtcataagtaaaataaagcctagaaaaaaaggtagaagttcattctcactacactttagaatattttctttaccaagtgtatttgcgttttaatgagcaaacctttatagtttgttttgatttcagctagatgtacctctaaactatttaatatcattcattaatcactgagtaggaaaaagtatttgggggaaccaaaaggccttcacattctatgaaattacaaatactttgcctctgcaaacactctaacacctgcaatcacagaagcccttagaggaaagccagtgttttgtaaggaaaatctaggaccaactgaatccatgcatttgaagctgtgacatctctaaaatgatttttatatgtctaagaaggttcaataataatcccagaaaactaaggacttaacatgtagagaaaatgctgaaagtgattgttgtgaaggtcatagacacagggaactctatgaaggaatttcagagtatagtacatgaaacactttagatataatagtaagactaagagggtaacttgagatcaaatgagcattttttcttgtgtctgttggctgcataaatgtcttcttttgagaagtgtctgttcatatcctttgcccactttttgatgggttgtttggtttttttcttgtaaatttgtttaagttcttttagtagattctggatattagccctttgtcagatgggcagattgcaaaaattttctcccattctgtaggttgcctattcactctgatggtagtttcttttaccgtgcagaaagttctttagtttaattagatcccattcatcaattttgcttttgttgccattgctttttgtgctttagtcatgaagtccttgcccatgcctatgtcctgaatggtattgcctaggttttcttctaggatttttatggttttaggtctaacatttaagtctttaatccatcttgaattaatttttgtataaggtataaggaagatccagtttcagctttccagtttcagctttctacatatgcctagccagttttcccagcaccatttattaaatagggaatcctttcccatttcttgtttttgtcaggattgtcaaagatcagatggttgtagatgggtggtgttatttctgaggcctctgttctgttccattggtctatatatctgttttggtactagtaccatgctgttttggttactgtagccttgtagtgtagtttgaagtctggtagtgtgatgcttccagctttgttatttttgcttaggattgtcttggcaatgagagctcttttttggttccatgtgagctttaaagtagccttttccaattctgtgaagaaagtcattggtagcttgatggggttggcattgaatctataaattaccttgggcagtatggccattttcatgatattgattcttctatccatgagcatggaatgttcttccatttgtttgtgtcctcttttatttcattgagcagtaatttgtagttctccttgaagaggtccttcacatcccttgtaaattggattcctaggtattttattctctttgtatcaattgtgaatgggagttcactcgtgatttggctctccatgtgtctgttattggtgtataggaatgcttgtgatttttgcaggttgattttgtatcttgagactttgctgaagttgcttatcagcttaaggagattttgggctgagacgatggagttttctaaatagacaatcatgtcatctgcaaacagagacaatttgacttcctcttttcctaattgaataccttttatttctttcttttgcctgattgtccctggccagaacttccaacaccatgttgaataggagtggtgagagaagacatccttgtgttgtgctggttttcaaagggaatgcttccagtttttgcccattcagtatgatattggctgtgggtttgtcataaatagctcttattattttgagatgcattccatcaatacctagtttattgagagtttttagcatgaagggctgttgagttttgtcgaaggccttttctgcatctattgagataatcatgtggtttttgtcattggtttggtttatgtgatggattacgtttattgatttgcattttttgaaccagcctttcatctcagggatgaagccgacttgatcgtggtggataagcttttcgatgggctgccggattcggtttgccagtattttattgaggatttttgcatcgatgttcttcagggatattggtctaaaattctctttttttgttgtgtctctgccaggttttggtatcaagatgatgctagcctcataaaatgagttagggaggattccctctttttctattgattggaatagtttcagaaggaatgataccaactcctctttgtacctctcgtagaatttggctgtgaatccatctggtcctggactttttttggttggtaggctattaattattgcctcaatttcagagcccattattggtctattcagagattcaacttcttcctgctttagtcttgggagggtgtatgtgtccaggaatttatccatttcttctagattttttagtttatttgcatagaggtgtttatggtattctctgatggtaatttgtatttctgtgggatcagtggtgatatcccctttatcattttttattgcatctatttggttcttatctcttttcttctttattagtcatgctagcggtctatcaattttgtcgatcctttcaaaaaccagctcctggattcattgattttttgaagggtttttcgtgtctctgtctccttcagttctgctctgatcttagttatttcttgccttctgctagcttttgaatgtgtttgctcttgcttctctagttcttttaattatgatgttagggtgtcaattttagatctttcctgctttctcttgtgggcatttagtgctataagtttccctctacacactgctttaaatgtgtcccagagattctggtacatcatgtcttcgttctcattggtttcaaagaacatctttatttctgccttcatttcattatgtacccagtagtcattcaggagcaggttgttcagtttccatgtgcttgtgcggttttgagtgagtttcttaatcctgagttctaatttgattgcactgtggtctgagagacagtatgttgtgatttctgttcttttacatttgctgaggagtgctttacttccaattatgttgtcaattttagaatacgtgcaatgtggtgctgagaagactgtatattctgttgatttggggtggagaactctgtagatgtctattaggtctgcttggtccagagctgagtttgagtcctggatatccttgttaaccttctgtctcgttgatctaatattgacagtggggtgttaaagtctcccattattattgtgtgggagtcgaagtctctttgtaggtctctaaggacttgctttacgaatctgggtgctcctgtcttgggtgcatatatatttagaatagttagctcttcctgctgcattgatccctttaccattatataatggccttctttgtctcttttgatctttgttggtttaaagtctgttttatgagagattaggatggcaacccctgcttttttttttttttttgctttccatttgattgttagatcttcctccatccctttattttgagcctatgtgtgtctttgcacagagatgggtctcctgaatacagcacattgatggggcttgactctttatccaatttgccagtctgtgtcttttaattggggcatttagcctatttacatttaaggtccatattgttaggtgtagatttgatcctgtcattatgatgttacctggttattttacctgttaattgatgcagtttcttcatagcattgatgttctttacaatttggcaggtttttgcagtggctggtaccagttgttcctttccatgtttagtgcttcctttaggaactcttgtaacacaggcctggtggtgacaaaatctctgagcatttgcttgtctgtaaaggactttatttctccttcatttatgttggctggatatgaaattctgggttgaaaattcttttctttaagaatgttgaatattggcccccactctcttctggattgcagggtttctgcagagagatccgcagttagtctgatgggcttccctttgtgggtaacctgacctttctctctggctgcccttaacattttttccttcatttcaaccttggtgaaattgacaattatgtgtcttggggttgtttttctcgaggagtatctttgtggtgttctctgtattccctgaaattgaatgctggcctgccttgctaagttgggaaagttctccttgataatgtcctaaagagtgtttttcaacctggttccattctccctatcactttgaagtacaacaatcaaatgtagaatttgtcttttcacatagtcccatatttcttggaggctttgttcgtttctttttactcttttttttctaaacttgccttctcactttatttcattaatttgatcttcaatcactgatatcctttcttccatttgatcaaatttgctattgaagctagtgcatgcctcccgaagttctcgtgccttggttttcagctacatcaggtcacttaaggtcttctctacactgtttattctcattagccattcgtctaaccttttttcaaggtttttagcttccttgtgatgggttagaacatgctcctttagctcggagaagtttgttattacggaccttctgaagcctacttctgtcaacttgtcaaagacattctccatctagctttgttccattgctggtgaggagctgcgatcctttggaggagaaaaggcgctctggtttttagaattttcagcttttctgctctggattctcaccatctttgtggttttatctacctttggtctttgacgttggtgacctacagatggggttttggtgtggatgtcctttttgttgatggtgatgctattcctttctgtttgttagttttccttccaggagtcaggtcgctcagctgcagatctgttggagtttgctggaggtccactccagacactgtttccttgggtatcaccagcagaggctgcagaacagcaaatattgcataacagcaaatattgctgcctgatgcttcctctggaagcttcatcccagagggacacctgcctgtatgaggtgtctgctggcccctactaggagatgtctttcagttaggctacacaggggtcagggactcacttgatgatgcagtctgtccattctcagagctcaaacgacgtgctggtagaaccactgctctcttcagagctgtcagacagggacgtttaagtctgcagaattttctcctgccttttgttcagctatgccctgcccacaaaggtggagtctgtagaggcagtaggccttgctgagctgtggtgagctccgcccagttcaagcttcctggccactttgtttacctactcaagcctcagcaatggtggatgcccctccccccgccaggctgcagcctggcaggttgatctcagactgctgtgctagcagtgagcaaggctccatgggtttgggacctgccaagccaggcatgggagagaatctcctggtctgccagttgctaagactgtgggaaaagcacaggatttgggcaggaatgccccgtttttcgaggtacaatctgtcacggcttcccttggctaggaaagggaaatcccccaaccccttgcacttcctgggtgaggtgacgccccgccctgcttcgactcgccctccatgggctgcacccactgtccaacccatcccaatgagatgaactgggtacctcagttggaaatgcagaaatcacctgtcttctgcgtcggtcatgctgggagctgcagaatggagctgttcctattcggccatcttggaacagagtcccagtgatattcttaaagttagacaaatagttatggttacaacaactggaacccgggatccttaactcccagtctggtgttcatttcactatagcatactgcatctcaaatcaatgtaaacattattcttataaagcaagtgcctagacgtgtttgcatgtataaagtgttttctgtttttctattttgactaccgatgaattttctattttctctggtctgtcttttagcctattactattttcagctcctatctgcaagtgaggattttaaggaacaagtattccactgataggcattcctggcataactatggatgataacatttgtaagactaacatttatgattcattttctttatttgtaaaatgcatgacatgaataaattacaacttcacacttggtacagtatcaacttctgtaaggcagattaaaatattctggcaccattccctgaaattcccaatctttttctatatacaatggaaaaactatgagcttttttttaatagaaaggattttgctttcttgggaattttatgttagattataagctgtaagcttttttatttaagattacatgattaaagacttcagtgtctctgacctaggttctctgcttttccactttagcagttctagtcaaggaaactttaagttttgctgttggaagtaagtttggagcagtgaaatatctcttttagaatactgaccacagcacaaaggcacatgttcccgtctctgacttctagctagttagctgcctgagcataggcagttatcttaagctgagattggcttccctttagaagaaattctgaagctcttgattccaagcagtaggaagtcctcaccaaggtcatactgggagttcattaactcttcctgatggttcaggggctgttagagaataagggaaaaggaaataaggtatacttagaagtagctttgtcaagacactctttggctcttttacttgctctaccttttactagccaaatgaccctggacaagctacttaacctttctaggtcttatctccctcctatgcaaaatggaaataatgtctacccaatgtagggttattgtaggatactattaaaggagataatattgtgtaaataattttattttcgctaacatgctctatttggaattcagcaactgcttccctttcctctactctcctaacatggggattctaagatcataaccctgagataagcacttgtaaattacagagtatttacagtatgaccttggtgaggacttcctactgcttggaatcaagagcttcagaatttcttctaaagggaagccaatctcagcttaagataactgcctatgctcaggcagctaactagctggaagtcagagacgggaacatgtgcctatgtgccgtggtcagtattctaaaagagatacttcactgctacaaacttagttccaacagcaaaacttaaaggttccttgactagaactgctaaagtggaaaaacaaagaacctaggtcaaagacactgaagtctttaatcatgtaatcttaaataaaaaagcttacagcttataatctaaaataaaattcccaagacagcaaaagctaaaattggctcaactccatttgttggcctgcatctggatcctgtatgcattttgatgtaatcaaattttaattccacccacccaggtcattcaggaatatatctctgtctcattagaaaatttaattaagcagcagtttttattttattttttatttttgctcttctctgattgagctgtacaaaattgaagcaaagaattgagatacctattcaaatatttcaagtgaaagcatatatttttattatccaaatcactgccttaagtttctaccttcagtctagtaaggtcttcacttagaatgattctacttgcaaagggatgttggtctgtgctggcatttgctgtctattttttaatttttccatgaatgtggcctcttaaactcattcataattcccttcaggtattcatatctctttagactcatcattccatgaacttcattacactgctaaaatatgcacatctcattatatccttctacttctgcatcttattatatcattacctttatactccctgcattcttcaaaatgtatatcttaatccctcaatatatttttgtgacatatatgtgtgtatatatatgtttgtgtgtgtgtgtatatatatatacattttaaatatttttatatatatatatatacacacatatatatataaaatcacaacttgtaactaatcatggtatcttcatattcaaaaattatattaccggccgggcgcggtggctcacgcctgtaatcccagcacttcaggaggccgaggtgggcgggtcacaaggtcaggagttcgaggccagcctggccaatatggtgaaaccgcgtctctactaaaaatacaaaaattagctgggtgtggtggtgcacacctgtaatcccagctactggggaggctgaggcagaagaattgtttgaacccgggaggtggaggttgtagtgagctgagatcgtgccattgtactctagcctagtgacagagtgagacttcatctcaaaaaaaaaaaaaaaaaaaaaatatatatatatatccaatcagcattctgtatatgtgctttcaggtgctttttcccccagtactgtgggtcccacttgtgtgcttttaccaccgtacttattaagccttcttgtttaggggggttatttttatagctatgtaattgaataaaattacctattcacacagaaatcaggcctataccatcagagaaatgcaaatcaaaactacaatgagacaccatctcacaccagttagaatgccagtcattaaaaagtcaggaaacaacaggtgctggagaggatgtgaagaaataggaacacttttacactgttggtgggactgtaaactagttcaaccattgtggaagatagtgtggcaattcctcaaggatctagaactagaaataccatttgacccagccatcccattactgggcatatacccaaaggattataaatgatgctgctataaagactcatgcacacgtatgttgattgcagcactattcacaatagcaaagacttggaaccaacccaaatgtccatcaatgatagactggattaagaaaatgtgacacatatacaccatgaaatactatgcagccataaaaaatgatgagttcatgttctttgtagggacatgaatgaagctggaaaccatcattctgagcaaactatcgcaaggacagaaaaccaaacaccgcatgttctcactcataggtgggaattgaacaatgagaacacttggacacaggaaggggaatatcacacactggggcctgttatgggatggggggagtggggagggataacattaggagatatacctaatgtaaatgacgagttaatgggtgcagcacaccaacatggcacatgtatacatacataccaaacctgcacgtggtgcacatgtaccctggaacttaaagtataataataaaaaatttaaatttaaatttaaaaaaaaatcaggcctataaccttggcctaaattgccctatgtcgcaatcaggtagactgatcttcctttttcacacttccttctatgcataccattatatatgttcctatacatattcactcttaaaaaaaataaagtatattataaataaaaagtaaagtaggaaaatgaaatagaaaattgaaaaaagcacattacaaatatatctctttaagcaattttagtagaaaacaatacttaatccaaaaaggaagggggggttaatttttcaataggatttttaaagttaatttacacagcttttattgactatacttgtggttaaaataaggtacagtctttagatatgattcttaatatttccattatttataggtacctcattatgttttcacattttctatatacatgtcttatttgctgtagtttatcttgcaatttttaaattctgtatctattttgaagttccttagtctatagaattacatgaggattcagaatgtatgcagtggaaaaaaatgttttaagttaaaatggaaaaaaatagaaattttctcagaagtaatggcataaaaataccttattccagtaaagaaggatctccaatatttttagaaattacaactcatccctgtctattcctaatgttttattggtggaattatgaaaattagtgaaaattaaaagagaaaaccttaggtgacagtaaaggatttgccagtaccagcagggttatttttttaagtttgagtgattcactttctcattagagcacctagtgctgcaagaattacctttttgactgttttctcaagtaaagactttgcaactcctaggagaccattagctcatcccaagcagcagagggtaagtatcagggaaacccagttcttccttttatttaattgtgagacaaaagcataagaagaaaatcagagacacaaagattctaatcaacaatactctttcttatgtgtctgaatgtgtataagaatgtaacttagttgcaataatctttaatactttaactcaattttccaaaaatggaatttattgactattttctaaaatctcgttttcagtttctataaactcctcttctgcagaatcccagtctccttggttaacttcctaaaaaaaaaaaaaatacaaaccattaatgtcttatcatttggatataacagtgaatgatttggtaatactgttgcaaccctgtgactataatgccttgctaatttccttactttcattctagcaatatggaaataagccaccagtatttcttcaaagtcagtatcatagttggcatattggtatgtatttcttcttacatcccatctaggagctttgtttcatcatgcattttattttattttttattttataaaatatttcctgcatataaactttgtttttttaattaatggccacagtaatattctaacacaggaccactctttgtgggaaaaaacttaacagttatttttagaatactaagatccagggttcaaaaagaaaagtacatggttcaaaattataggacagtgactgagaaattaccattaaagaagaatttaaattattcagactacagagtgaacattttctttctttctttgcacaaaatcctgaccaacaaattcacccattggacgtaagtgctacccatttatcagtgatatcctactcatttgaccagggtgtggcaaggttttcatcattaagtactgaaaaaagtaggcatttgctctcaattgaagcattttctgtgacctcaaggacattttagatatttttaaaaattattcttcctaaaaacgtacccctttcatgttaattaagttaaatgctttttatatttacacagttattttaaaagtttaatgttttatacatagaaatgaatatatgtaacacagatggaagttgtagtgataaaataaacatgaaacaccaacccaacttaataactaattcattaccaattctgttgcatctttttgtaccactaaatcatggcttaatcatttctggtaatcataacatttgtatttattccaaactctataaccttacataaagcttattttattttatgacataagaactgtaattgccagataatgagcatctttagatggaaaaaagtgcacaacacaatagcactttgagaaagctatgtattttataagcataggaattttattattccattaacacaacttctggagtaactagattaatgaatgtactggttttcaacaaaggagatcttaaccctaaatgattcaatctttttcactctacgaatatataaagcctgtaatacataagcaagacctgcagtacaccaaagttttgtctagttggtctttcaaataaagaggtgaggaataaattatactggaatagacttgagggcatccaccatgttaaatgtttattttagtatctcataaatagccgtgaaactttccttatgaatgttatacatgcatacctcactttattgactttgcagatattccttttttttttttttaacaaattgaaggtttgtggcagtcctacattgagcaagtctcttggcaccatttttccaacagcatgtgttcctttatgtctctgtgtcacattatggtaattctcacaataattcatactttgttatttttatatctcttacagtgatctgtagtcagtgatctttgtttttactactgttattatttgggggcaccacaaattgcacccattataagatggcagacttaatcgataaacctgtgaattctgactgttttgccaattggctgttcccttttctccctctccttgggcctccctattctctgagacacagcaagattgaaagtaggccatttaataactctacaatggcctctaagtattcaagtgaaaggaaaaattacatgtctctcattttaaatcaaaagctggaaatgattaagcttagtgaggaaggcatgtcaaaagccaagagagccagaaacctaggccgctggtgctacagccaagttgtgaatgcaaaggaaaagttctttaaggaaattaaaagtgcagtagaccaacattcccttaagccaaagcgtaatccagagcaaggccctaactcttttcaattctgtgaaggttgagagaggtgaaaaaggtatagaagaaaagtttgaagccagcagaggttggcttatgagctttaaggacagaatacatctccataatataacaatgcaaggtgaagcagcaaatactgatgtagaagcaacagcaagttatccagaagatctatctaagatcattgatgaaggtgactatgctaagcaacaggttttcaatgtagatgaaacagtcttatatataggaagaagatgccttctaggactttcattgctatagaggaaaaattaattcctgtcttcaaagctttataggacaggctgattctcctgataggggctaaagtagctggtgactttaagttgaagccaatactcattggccattctaaaaatcctagtagctttaagaattatgctaaatcttccctccctgtgctctataaatgacaaagcttggatgatagtacatctttttgcaggttggtttactgattatgttaagtcttttcttgagacctcttattcagacaaaaagatttctttcaaaatataactattattgatattgcatctagtcatccaagagctctgattgggatgtacaagattaatgttgttttcatgcatgctaatacaacatcccctctgtagtccatagatcaaggagtaatttcaatattcaagtgttattatttaagacatacattttataaggctatacttgccatagatagtgattcctatagtggatctgagcaaagtaaattgaaaactttctggaaaggattcaccattctagatgtcattaagagcatttatgattcacgggaggaggtcaaatatcaacattgacaggagttgaaaagaagttgattccaaccttcatggatgactttaagtagttcactgcttcagtggaagaagtaactacgatgtcgtcaaaatagcaaggggactagaattagagatgaaacctgaagatgtgactgaattgctgcaatctcatgatgaaacttgaacagataaggagttacttcctatggatgagtaaagaaaggggcttcttaagatggaatctactgataaaaatgctgtagacattgttgaaatgatgacaaccaaggatttagaatattacataaacttagttggtaaagtagtgacaggatttaagaggattgactccaattttcaaagaagttctactgtggattaaatgctgtccaacagcattgcatgctacagagatatctttcatgaaggaaagagtcaatcagtatagcaaacttcattattgtcttattttaagaaattgccacagccaccccagccacaagcaactaccacccagatcagtcagcagccatcaacatggaggcaagaccctccaccagcaaaaacgttacaactcgctgaagactcagataattgttagcattttttagcaataaagtattttttaaattaaggtatgtacattgttattttcacataatactatttcacacttaatagactacagaatagcgtaaacataactcttacatgcactggctaaccagaaaattggtgtaaatcactgtactgcaatactcagtttattgcggtagtcttgaactaaccctgcaatatctctaaagtatccctgtaattcactttaaagtttttttaatgatgtagagactcaaatctgtacatgcttcacctttcatagtaaccctcttaatccttagccttagttaatattgttcctactgatggtcattttagcagagtaaatatatgttttgacattgccttttcagctcttttggtaagcgcagtgaatagttgttatgtgaaaaaagatcttacagtaacctctcacatagattatgtataatggtggcttttaaatgttgcagcatcaatgccgttacaatgggcatgagtaaacttttgaagaatttataatcaatagcagatggatttatgtccacattttatatttgaaaggcttaggtagtatgttttcctttcagcattctattacctaccacactctttctccactctcgattcatataaatgataaatcttggttagccaaagtgatgacaaggaatcaatttcctggaccactgaacttagagctctcccttaactttctaaaaagcctcttagagctaactacacagggaactttataactgtgggattattttgataagtgactttgagaaattagaatgcttttcactcttatatccaaaagcctttcagttcttctaacatcttaacttggacagtaagaagaaagtatagacagtcactgacttgtgataatttgacttgtgggttttgttttgttttgttttgttttgttttttacttacaattatgtaaaaccatcacaatttcaacatacttcaaattttgcattttgatatttttgtggtctgttgatatgtagtacctgagatattcaacactttgttataaaataggctttgtgttagatgattctgcccaactgtatgttaatgtaagcatcccgagcacatgtaaggttaggcaaggctaggctctgatgttcactctcttagctctatttgaatgcatttttgacttgccacatgttttcaacttaaaatgcgtttatcaggatgtaacctcattgtaaatcaagaaacatctgtattatctgtgtcagaataaatgcccaaccaaacaaattaactattaattttcccctttagagaatatatttgagctcaatgctcacaaatcatacttaattttagacatagttccctgtctttatttttcttgtgtgtatgtccattgtcagccatttgaatcgataaagactttttctaaagataccttaggccagtcatctcagttttaaaaagccagtactccagctagtggggaattcattaatcactgttatcatatggaaaactgaattttatatgtgtactactaacaacataaaaagactaccctttttgatccaaccagactgccactgttatcttgcagcacaagtaagcatggcacacaaaacaatgtatcagccagtctttttccactctttcttcttgtctaccgcctgagatcacttaattgtatatgtggcccagggtgcccagtgttacatagccttgcctttaagatttctgacactctgtagaatccgtaaatatgcatgtgtgtttatggtcttcatcttcatcaaattgaagacattattttacagaatttatgcaatacaatatgtggaagaaagtagaacagaataaacattgtctagtcagaccatgaaagcaggaccatagcttcttggcacacagcctaaccttcagcaaaatgaaatgctcacagcagtctgtgaaaagctgcaaattcccgacatcaaatgttcctaagcaagcatattagttatattaatcgcctattgggaaagccatcttttgcttattataaatggggctcttcctggaatggggcaactggtaaaaggaaattttgcttatgtttttctgaaattacatttttcagtaagccctttggctcccactgcttcagctgctcactgctgtttctctaccaaatgctaaacttaaaacagtcataatatccaggtgagaagttactgctccccggttcccatttaagtttgaagccttaggatacctttctaaaatcacaagcacaagttttatccaacactactgcttagcttctacctatgggcaaagggaagggatggtttcacatctgtgtaagtatctgtacgaatgcaagagagacagtcccatgtggttaagtaatttgcagtactattatattctctttacattccaaatggatcatttggcttgacattgaatgaagtctaatactgactggttggaaaagctagaaaattgtttagtcctaaactttaatgagagatacggatatagcagcttgcagagaggtatatctggcatttattccttcaagattccttttgtatctgctgccgactgggagcccttaccattttccacttgattgcctatttctctccatatttttttcccttcccttaagctctcagaccaaaacttgaggtcatgcatgcttttctctttgaggagacttaaatctttgctgacaagttgactttataccaactccaaaatcaggactaatccactagggatctaatttaccttaaatatagcaaccactatatatagcgtgagttcaaaataaaaagctggttggttatatatattgtaaattttatattaataatattaacaaaagaccagatggtatatgtgtgctataaatatgactttcctaaatatcacatatagaaatgaaatatgcttctttaaaacaactcttgtacttgcctttaaaaaaaattatcaagataaaattcaaagtattcagtgtttttagtatattcagacatgtgtagccatcaccacaattttagaagatataattcatatgctatacaattcaaagtattcagtgtttttagtatactcagacgtgtagccatcaccacaattttagaacattttcattaattcaaaaagaatgcctgtcccttttagcaatcatcctcctatcccctcatcttcacatctagccctaaataaaccactagtctacttcctgtttctataaatttgcctatttgggacatttcatataagtaggatcatataatacatggtcttttgtaactggctttttccacttagcttaatattttcaagattcatccatgttacagcatgtatcagtaattcattcctttgttgtggtggtaaaaacacaacacaaaatttatcatcttaaccatttttaagttcagcagtgttaagtatattcatatttttgtgagacagatcttcagaattgtttcaattcgcaaattcaaaactctctatccattaaataactcttacacctccctctagcgtctgataactatcattctacttttttctattaatttgactactttaattgtttattcattcacctattaatgaacatttgagttgcttccacctcttgactattgtgaatatagtttctatgaccatattcaagaccttgcttttaattcttttgaatacatacccagaagtggggttgttggatcatatgatagttctatttttaattttttgaggaacttccatactattttacaagtggttacaccattttataaccccaccagctgtgcacaagggtttcagtttccttattcatgccaaaacttttctgggttttttgatggtagctatcctaataagtaaggtgatgttctcattgtgattttgactttcatttttctgacaattactgataatgagcatctttttatattctcattggctatttgtatagcatctttgggaaaatgtgtattcaagtctttttttcattttaaattcatgtgattttttgttgttgagttgtaagagctctttatgtattctggatattaactcttactagatatatgatttgcaattattttctctcatttcataggttgcctttttactctgttgattgcattctttgatgcacaaaatatttctgttagatgtagtcccatttgtctattttgctttagttgcctatgtttttggtgtcatatcccaaaaaaaaatcattgccacattgaatgtcatgaactacttcctgttttcttctagttttatagttttaggtcttacatttaggtctttaatgcaggttgagttaattttctttgttgttgtttttttcactgtcttcttcttattattaatttccataggttattagggaacaggtggtgtttgtttacatgagtaagttctttagtggtgatttgtgagattctggtgcacccatcacccaagctgtatacactgtacccaatttgtattcttttatccctcacctgcctccgaccctttcccccaagtccccaaagtccgctgtatcattcttatgcctttgcatcttcatggcttagctcccacttataagtgagaacatacaatgtttggtttttcattcctgaattacttcacttggaataatggtctccagttccatccagtttgctgcaaatgccattatttcattccttttttggctgaatagtagtattctgtggtatacatataccacaatttctttatccactcatggattggtgggcatttgggctggttccatatttttgcaattgcaaattgtgctgctataaacatgcatgtgcaagtgtctttcatgtataattacttcttttcctctgggtagatacccagtagtgggattgctggatcaagtggtagttctactttcagttctttaaggaatctccacactgtttgccatagtggttgtacaagtttacatttctaccagcagtgtaaaagtattcccttttcaccacatccccaccaacatctattattcttttattttttcattatggccattcttgcaagagtaaggtggtatcacattgtggttttgatttgcattttcctgatcattggcgattttttttatatatttgttgaccatttgtatatcttcttttgagaattgtctattcatgtccttagcccattttttgacaggatagttttttcatgctaatttgcttaagttcctcgtagattctagatattagtcctttgtcagatgtgtaaattgtgaagattttctcccactctgtgggttgtctgtttactttgctgattgtttcttttgctgtgcagaaactttttagattaattaagtcccacctatttatcattgtttttcttgcatttgcttttggattcttggtcatgaagtctttgcctaagccaatgtctagaagggtttttctgatgttatcttctagaatttttatagtttcagttcttaggcttaagtccttgatccaacttagttgatttttgcataaggtgagagaggaggatccagtttcattcttctacatgtgacttgccaattatcccagcaccatttgttgaatagggtgtcctttccccacttttatgtttttgtttgctttgtcaacgatcagttggctgtaagtattggatttatttctgggttctctattctctttcattggtctatgtgcctatttttataccagtaccatgttgttttagtgactatggccttacggtatagtttgaagtcacgtagtgtgatgtctccagatttgttctttttgcttagtcttgctttggctgtgtgggctccttttttggttttatatgaattttaggattgtcttttctagttctgtgaagaatggtggtggtattttgatgcaaattacattgaatttgtacattgcttttggcagtgtggtcattttcacaatattgattctacccacccatgagcatgggatgtgtttccatttgtttgtgtcatctgtgatttctttcagcagtgttttgtagttttccttgtagaggtatatagtataattgtaagagtccaattttattcttttgcatttgggtatctgattttactagcaccatttgttgaagagactgtcctttccccattgagtggtcttgacacccttatcagagatcatttgactatacacatgaaggtttatttctaagttctctattctattccattgatctatatgtctgtttatgccagtaccatactgttttgattactgtggcttcataatatgttttgaaatcaggaaacatgactcctccaactttgttctttttcacaattgttttggctatttggagtcccttgagattccatataaattttaggatgagtttttctgtttttataaaaaatgtccttgggattttgataggattgcacttaatttgtagattgctttgggtagtatgaacattaacaatatgaacacaggctgtctttccatttacttgtctctgttacttctttcagcaatgtttagtagttttccaaaaatacatcatttctttttatggctatgtaatgtttcattgtatagatgtaccacagatataccacagtttgttcattcatcagttgatggatatttaggtttccatcttttggctattatgaaaaatgatgttaaaaataattatgctcaagtttttgtgtggcatttgttttcacttattttcagtttgcccttggtttttaagaataattgaacttaaataaaagtaaagactgttctggaagtccaggatagaaaaagacattttgagtaagacctatatttgttgctttgagtagacacaaaggaaataaaaattgcaattctttcaaaagcttgaggaaccacacacaccaacgtgagacctcttacatgtcaattttgcaaatagttgctaactgattgatagtatttggatctatgcccccccccctccaaatctcacgttgaaatgtaactcccagtgctgtgctggaagtggggcctagtgggaggttactggagctgtgctgtcatcatgatagtgagttctcttgagatctggttgtttaaaagtgtgtggcacctgccccctctctctcttgctccttctctggccatgtgaggtgccactctccctttgtcttctgccatgattgtaagtttcctgaggcctccccagaagaaaaaagccactatgcttcttgtacagcctacagaactgtgagccaattaaacctcttatctttataaattacccagtctcagtatttctttatagcagtgcaagaacagactaatacactgatatattacaaattgaatatatagttgacaaaaaatatatacatgagtagtattcagagtggcaatgatcaaggagaacttactatcttgaatgaagtcttgatatagataacggatgtagactggcagcaaaaaggaaaataacagtctgggtttagggaagccttgaccatatgcatggaggtgagcaagtatatacagaaacatgacttggctagagagggggtacagcttcaaagaaatgagattagagattagcaaaatatccttctctattttatatcctctttgatcgaagctggttgtatttgattgatatgacctttttctctacttatctgatattttcttgtagtcataatcattaatgcactcattcattgactcagtcattcaaacagtgactgagtgccttttacataccaaacactgtgcttgatactagggttacaaagatgaatgatatatactgtgacaacaaagaattcaaagcctgatgcagaagtcaagacaatttcacaaacagccacaatacaatatgaaaagtgtgcaaaaatagatggttacaaatcttatgcaaatattaagagtaaatgtagtccttccaaccaattctctgttttatcaccaaagaagttccaaaaagacaaatctcattacctttcaagagacttaaattatgctagtaaattaacttgaagtcattagtctgcttaaaaatcccttattggattcccatttttacaaaattaggtttaaactcccttgatcctgtttcatttgtctaaaacgcccccctctcctacctggttttgagttactctttaaaactcagctcaggtgtttatctcttctaggaagattttctagatgttccacaagtttttggttaggtgattttctgtatgtctcccatatcaccctgtacattttcctgccactgtctatgtcatactatcttgtaatcatctctatttctctgtctttctctttctctcatgcactgtgcttgtgaattccttgaggacatcagccaggccctacgggtatttttgtctccagtgtctagcatatattatgttcccagtgtttgatgaatggatgagcaaatcagtcagtgaacttgttggccttggtaagagacagaagatcaaagaggtaacatctgagctgaaccttgaagaatgcatgatacttactaggaggagaaaaaggaaagaaaaaaggccttcctgtccaatgcaacatgatctgcaaaagcacagactagaaaaagcccagaatgtttaagatgtgacaaatcatactttgtatcagaaactggacatttgtcagaaataaaggtcaatcgcagtgtaaatatttcccacattgtgctaaacgattcttaaactagcactgcagaattattataataggatatgtttattaatttttagcctactaaagttttggtgggttgtagcatttaaataactacattattccttgtcatacatacatttttctcatttgagcctcctcagaaacttgagggttattttttagtatttatgtgtatgttagaatggggagtaaatattattgcaaactaccagaacaaagtttttagattccagaatcaaatgttatcaaattattattgagtagattctataccataggaaccttccagaatggaattgcacaataagatatatgaacaactcaggcattcaagacagaaatcaagtgagctgatattcttttatccaaattgtcagtgagaccttactccactttcttctacttccacgtatctaaatcttgcaaaagcagaagataatcattatttctctcctcagagtggtcaaataattcattcatgtgcatttcaagacactgtgagatctataatacagctgtcagtatcaactgtctttcaaacttagcatattaaatataaagcccctgtcttagaatataggaagaaagagagccatgctgagcctgtttctttggggctactggcaagaacttagggtgtaaaagtgactatactaactgttgattcttatggcaaacagatttgtagttttttgttgttgatgatggtgtatgtagtgataacatatacataacataaaacttaactattttaaccatttttaagtgtatggttcaatagcattaagtacattcacattgttctgtaaccatcaccaccagccatgtctagaactttttggtcttcccaaactgaaactctatacccattaaacactaactcttctttccctcctcatcccagcacctgccaccaccattctactttctatctctgtgatttgactactctatgtacctcatgtaagtggaatcataaaatatttgtctttttatggtcagcttatttcacttagcagaatgtcctcaagattcatccatgttgtagcatagtcagaatttccttcctttttaaggctaaataatatttctgtatgtatataccatactttgcttatccattcatctgtcaatggatacttgagttgcttccaccattgattattgtggataatgttgtgaatatgggtgtacagatacgtgttcaattcccagcttttaatgttttggatgtatacctggaaatggaattgctggtttatatggtaattatgtttaattttttaacttgcaactttttaaatgtgagagatataaaggaagagcagtgggtagagggaacatgagtggtagtagttattactatggtggtagtatggctgaaaagttctggtcgggcgcggtggctcacgcctgtaatcccagcactttggaaggccgaggcgggcagatcacgaggtcaggagatcgagaccatcctggctaacacggtgaaaccccgtctctactaaaaatacaaaaaattagccgggcgaggtggcgggcgcctgtagtcccagctactcgggaggctaaggcaggagaatggcgtgaaccccagggggcggagcctgcagtgagccgagattgcgccactgcactccagcctgggcgacagcgagactctgtctcaaaaaaaaaaaaaaaaaagttctaaaatctagtttttccatcttactttagccacctatgaaatatattgctgtgggtaagtacttactgtatttaaacgtctcttccggccaggcgcgtggctcacgcctgtaatctcagcattttgggaggccaaggtgggcggatcatgaggtcaggagatcgagaccatcctggataacacggtgaaaccccatctctactaaaaatacaaaaaattagccaggtgtggtggcgggcgcctgtagtcccagctactcgggaggctgaggcaggagaatggcgtgaacccagaaggcggagcttgcagtgagccgagatcccaccactgcactccaacctgggcgacagagcaagactctgtctcaaaaaaaaaaaaaaaaaaactctcttccttcacctgtaaaatgaacataacagtgctctactagattttcatgggattaagtgagattatatatgtgattcatacagtgttaataaacatttactgtatcattggggctagccaccagaaaaactcagcccttgtgctatctctgataattaaccactattagtgcactattcaaaatcccagcaaagtcattcatgtagattctgagctgatgtatagcttacattttgatctacaccccccagtgccaggacaaactacttccagataaggaaccatcccatgaggtttactgtgatcctggacaagcaccactgggcccactgctagggactatatagcttcaggttcatgtgagagttaatgttatatatgtgaatacaaactagaccctatggtcccaccactttgcttgtctgacatagtatggcccaaacctccagtatagctccagaatagcttcaacatcctaggagtatctgaaggtagaatctgctaagttctcccttccaattcaggtgccaaaagggaagagtcaatatcactataggatatagtgatattcagaatagaaatttgaacatcagatggtccgaatataaatttaaaaatctctctacacttacttctaggtcctaggatctggaaatcagagaccctaggtggctaagaaggtcaaagataaaaaacacagactcacttatccagctccggaaacaatgaaattttataaattatacaaatacttcatgtaaatcaagtcctatattacttgtcttggtttcttttcttccttcctcttcctctttttttaacctcatttatttttgctttcctttttttaaattagcaataaagacagtttctgactagaggatttcaggaattggttatgactcctgaaacttttattcttattggcactagttcaaatttctgagccaaaagtgattttcatccagagtagtctgaatacttacttcacacaaaaggttactagtgctcttcttataggcactaaattatttcaattaatgaagccaaaatcaaaggctaaaactcaaatggaatgactgggatattccttcctttttttttaagctttctcttcttaagaaaaaaacaactttaggattaaaaaatgatgcattcattgtagaaaacgtggaaattttgggaaaagtagagcaaagggaataaaaaacataaatctaacattctgaagtaataaatgctttatattttcatgtatgttctttccttttctactgatatatacacatatatcttaatacagttaagactatatgctgcagatttgactttgcatgttgtaaaaatatgtatcataggaattttcctatgtcaatgaatattcttcataaatattactttagcctccataatattttaccttaagaatctatcatttcttatttaagtacctatattgttgatagtttggtttctttccattttttctattgtaagcaactgtgaaataaacatatacagaaacatttatccattttcctacgatagatttctagaagtgaaactactaggtcaatgggtatgaaaacgtttaaagttggctttccttttaaagaaaatcatatttgggttgttaaaggattactgacacatcaactgagcacatctttgattactgtatagcacctcatattcagataatctctgcaaacattgccatgaattgactgagtataatcttttatttcaggcaccagaatgcatctcttctatctcctgtttcttgggacagaaatcaggagttctgactgagcccatttacaagctgtgtcagacaagcactcatgcccatcttgtttatgactgcctgcttacccattgctctccatatttacattttccttcttttctcttccttcagatggaatggggcgagtccttgctcaagatgtatatgcaaaagacaatttaccccccttcccagcatcagtaaaagatggctatgctgtccgaggtaaatattttggttttcttaaacataatcaggcactgtatttttttttctttttttctttttttttttttttttttttttttcaaatttttggcttagcccaagcacccagcaactgttaggtttgtttccccatgactgtcaaaataacttcattcacagataaccatgttaatctgcacctgtaaattttctggcacaatcttgattaaaacttttgaggtaaagaaaagttacatgaaaattctcgttttaaattttttatttttaatatttgtggatacatggtaggtatacatatttatggggtacatgagatatttagatacaggcatacaatgcataataatcacatcagggtaaatgtggtatctgtcacatcaagtgtttatcctttgtgttactgaaattcttggctacaaataaatatataggaataaaattaaaacactgtacttcaatttattctttccgttcctacacatgccagacagcatacattcttagtgtgaaagttttccagatgttttctagttgaaaacatctgatggtctaagaaaaaagagcagattcccaacacaaggataaagttgaggtggtctgttctgctttcaactcaaacatcagtaaagggcttcatgaaaagcggacatgagggaaacctctaattctctagaagacatcatatttcaaaattctggcgccccagcagctcacacaaagttgcctgagattgcataaagcttaaaagcaaatactaaatagcatttttctgcctaaattccaatctaagaaccccaaatgtaaattctgaattgcttagaaactgttgttgatttttttggttttgtttttgtttttccatgtacaacatgatattttaaaatatgtagtacacattgtagaatggcttagttgagctaattaacacatgcattacctcacatacttatcatttttgtagtgagacttaaaatctactctcttagtgattttcaaactatgatacattgttattatgttattggttattaattcaaggttgatatcattgaagaaacatgtttaaaaagtttttcagtttatcagagctgttaagcatgccaattcctttttaatggggtacatgagatatggagttatggagtctcttacttggttttggttttggtttttttagctacatttagccatgaaaatacaggttgggcatccctaattcaaaaatccagaatttgaagtactccaaaatctgaaattttttgcgtgttgacatggcaccacaagaagaaaatttgatacctgacctcatgtgaagggtcaccataaaaacacactcaaaactttgtttagaaaaattatttgaaacattgtttaaaattacctaccttttggctatgtgtataggatatatatgaaacataaattaattttgtgtttagacttgggtcccatccacaagatatctcattatgtatatgcagatattccaaaatctgaaaaacatcaaaatccaaaatacttctggtcccaagcatttcatataaaggatggtcaacctgtaatttcctttttcctgtaattaaatacttcattaatctcctctgtattccatcatctcttagtagttatctttttatgttggagatagcatagcaaatgattaaggctacaggcattgagcaaagctcaagtgatctgggttttagtaccagttccatctgtgtaactttgagcagctcacttaaattttttagcttcagttttcttatctctaaaattatgataattacaacaatacttaccccagcaggttgttgtaagaattatattaaaaattaattgtagaaattaattagttgtagaaagccttagtaaactacctggcacacatttaaaaaaaaaaacacttgataattgttttttaaaatatttaatgatagtaaccattattatcatattataaatacattttcttaaactatctctgaaaaatggctaacatttgaattgctactctcattttctgtgtaaataaaatggtagagagattgagcttatgttttttcatttccactaatgtattctttctcaggaagattatcttggattcacttcattcagcttgatctcactagattagaatacttctgaaattggcaaagccaaaacttaaataccaaattcccaatggctcctatgtttttttctttcaaattgattccttctacagtgttgattagaataaatattatccagacagaaaattattttattcttgtgatagcttcactggctcttctagtttcttttttttttcccaatgtcattgttggcttgaaatagtttcttattgcccatctaaaaagtaaattctgtgttgatcttacaatttgtagccatacaggattactataaaatgacaaagaattcttacttccagagtagagcaaacagctacagtagatgaaacaccagagacaaagaagtctgttttttatagtctttgtaacataatgtgggagagagtgagaaaataaattatttgaggcagaattattcccaaacagaatattgttctgtgatttttacatgagctagcagcagctcaattaaaaaaaaaaatggttgctgttagcttttcttgttgccaaagggagccattagcccttatgagcttttctgacactgtacaactcatcaaaaaatttttatgtaaaattaccatttagtatcctatttatgcttttgtttgagaggtttttttttttgttatttcaccaaaaaaaatctaaaatggtatctcacattataaacagtccaagagattatctaccgtgaagctgattcacattgtttctttcttgcaaagggttggtacttctccaagatatgtaacatataagagcgacataagtgataatcattgcataaatggttaaatctcaaagtaggaatggttagtatgtctgtgtatacaatatgaacatcataattaaagaagcaaaagtcttctgtagacaagtggcatggtcttagaactatgctgaattttccagtttatacctcctcacttttttgtctgtaattcaggaagataaactctatgaatcctaaaagtgatttttactgtatttagtaataaagatgattttcatttctttaaaggtaaatgtattcattagcctcttttctgttataaataccacccccaggcagtgttttggtaaagaatatccttgaggccaattattgtggctaagaccctcctttgagtacctccttctctctacccctgtcttcctttactctggttcctttctccctgctcccttgattctccctattttcttctcctctgcctttaccttaggccttccagtaataaccagtggcactcgtgggcattgctaaccctctaggtgtaaagatgttgctaacttgctctggatcactaagcattagccagtatccttcagaaacatgtgggataaaactccaaaccagttggaggatcacttgctttaaggtatgtgagttcaaaaatcaagacagtaataaaatgactaaggaaataagtagaaacagctcaaaataaaacattaagaaagaatagaatgtaaagaaggcaggaataaagtaatgataatataaaataataggaagacctgtaaacctaaaactgcattcacgtgggagtgaatttgaaagataaaagtagataaaataaaaatgaaagtggcatatttacaatttgaatcaatacagtatttttattcttcacatttttcgattttgtttctcccttcacactgatgaagctaatcatcctcttgatgcattcacatcctcctatatagatgtaggtgactattttatcacactttctttgtggatattaataagggcaaaaatatgttagaactccaagttcagctttcttgaaaaagttcaatttgaaaggtttatcccttcagagcttattttgggatcatttggaaaaaaggaatattttgaacaaaccaggaattattttcagagtcataggtaacatacagttctgaaaagatatattaagagaaagttttgccatttgggtagagagaatttaaaaatttttttttcttgtttacattctgattgaaattacttatgaaaaatgcaaaaataatgaaaaagaacattttaaaattacccattaacttaccccctggccactattagcattttgtgcatttacctcacatacagtgggttagaatacaccaaaattcaatatagacaatccacagccattgtgacttagacctagttcttattctttcaacagtaatcatatttcagggcttttgttgtatccatttgaatcctctttcgctacaactggttctgcaattcatttgacagcctattttgccctctactataggatactttcagtgaaaaagagggccttatgatatgggagtaatactcatgtgaatagataaataatttggaataatttagtttagttaattccaaaaagaaaatatttctgaaaataatgccttctttcccaatactaacaattaataggcattttccctggaagataatggtaaagaatacacgatgccttcttactcatgtatcctatgcccacctccctgcgttccataggaaaaggtagccagtttaaaattccaaacaatttacctaatgtaatacttgagtgtaattgcagcaagtatgaatcctcttattccagctttgtcaccttctcttgttacctttccctaccaacccctcctataatcttaactttagtatgcatataaatactattaccctgtgcccttcttgcagtctcagacagtgtagttctataagcagagcagacaaattactattccttctgccttatttctctatcaactatttcctaggacctctgaaagttatgccatctctatgtgctctaatttgttcagccttaaagtggaaatgatgagactctttagtattgaaaataaatgactagctatacagtatttcaagagacttaaagaaagatcactatggctggaaaatgaaaatgaaggataattccatggcagatgatttgaagatcatcgttttctgtgtacacaatgagtagttatctagtgttatcaatttcatatcaaataatataaccagaaatcttcaaataaatgggtgaacagaactaaaagtgttttctggatattagaaaaaggaggaataagaaggaacagcttcagggtcttgcattaaacattaattgtttacataatgcatatgccattagggtttggtttatattgcttttatcacttctttcaaattaaattctacagttgcaaagcagaaaagaaattcattagcagatatgtcagaattacaagggaaacaattctaaatctgcagaagtccttcaaatctattcatcttttctaatgacgtactgtggtttactttctttttttctttccaagctctaggttcatgtgctatcatgcctccgcttctgccctctcctacctaaacttgtagaattcatcttgaaaaactgcaactttttaaaacctgtttctttcatagatatttttaaataaatatagccatgcaccacattagcatttgagtcaaaaacagactcttacatgatggtggtcccatgagattacaatggagctgaaaaattcctattgccaagtgagattgtagccattgtaaggtcacatagtgcaacacattacctttcctatggttagatatgtttagatacacaaatacttaacattgtgttacagttgcctatagtatttagtattgtaacatgctgtacaagtttgtaacccaagagcaataggctataccatgtagcctagttgtataataggctataccatctaggtttgtgttagtacactctgtgatgatgttcacacaacaaaattgcctaacaatgcatttctcagaatatatccccattgttaagtgactcatgactgtatcaggaagttagatagattgatacttatttttctgtcttcataagacaaaccttggtgttaatgtaaaatttggactcctgtagttcactaatttttttattccttaaattttctcttagtctgaatttgtctatattcagtttgatcttatagtgctctgctcctcaaaaagggtaatccatggaccagcagcctcagcatcagcttgttagaatttagaatctcactgttggtgggactgtaaactagttcaaccactgtggaagtcagtgtggcgattcctcagggatctagaactagaaataccatttggcccagccatcccattactgggtatatacccaaaggactataaatcatgctgctataaagacacatgcacacgtatgtttattgtggcactattcacaatagcaaagacttggaaccaagccaaatgtccaacaatgatagactggattaagaaaatgtggcacatatacaccatggaatactatgcagccataaaaaacgatgagttcatgtcctttgtagggacatggatgaaattggaaatcatcattctcagtaaactatcgcaaggacaaaaaaccaaacaccgcatgttctcactcatagatgggaattgaacagtgagaacccatggacacaggaaggggaacatcacactctggggactgttgtggggtggggggagcagggagggatagcattaggagatatacctaatgctaaatgacaagttaatgggtgcagcacaccagcatggcacatgtatacatatgtaactaaccggcacattgtgcacatgtaccctaaaacttaaagtataataataataaaaaaacaaaaaaaaagaaaagaaaaaggcaaaaaaaaaaaaaaaaaaaagaatttagaatctcagaccttgtcccagccctactaaattagaatctgtatattcacaagatctcgagatgatttgcatgcacattaactgttgagaaataagagaaataagaaaaatgactcctctcttggtaccaagaaacttctatgtagttgtttgactgattcttccttagctagcaatatagagacacatttaccaactggaaaggttcagagtaaggttgagaacatagtgcaagtgagcacatattctctccacaattggtatactttccctgataacaaagaccttgctccttagaatcgcttcagagtactttcacatatggacctccctggaactccatactaggcttgccccagatgacctccccagatgacctccagctactcattattcagtttatttagaggattatgcagaatattgatatgagcattttgagtttatgtgcatgtgtgggggaacaggagaaaagagaaatacttcccaccaaaaactttttgagaatgccaacttcatttctttattcttttaacaaatatttattatcagcgatgacttaggcactatgctagacagaataatgacataatctaagttatacagaattaatcaaagcagtctttttttttttttttttgagacaggatctcgctatgttgctctggctggagtgtagtggtacaatcccagctcactaaaacctccactccccaccccccacccggttctcaagccatctttgtgcctcagcctcccaagtagctagactacaggcacacaccaccacacctggctattttttgtatttttgtagaggtggggttttgccatgttgcccagctttgtctcaaactcctgagctgaagtgatttgcccagccaaagcagtctttctaaacattcttaagatgttgactcaaattttgaaggaaacaatatatatggatcagcaaaaagtatatataacaaatataaaactttgtgttagaaaatattacttatttggtcattcgtgcatgaatcttctaagaacgtttttgtagccacattcattcgtctgccaaccatttttgaatacttaacatattgaacatttatttaacacctattgtacagcaagtgccagggattagcaaatactgtaaatatatttagaagccataattgatttcaggctacactggggaaacaaaagaggatgcacgcaactcttgaggggagaggagtcagatatgacttcacagagaagatgacacttgagctgagtcttaacagctaaaaaatctttaatcagaaggcaagaataagaaaaggacgctttaagtagtggaagtagcacatgtcacggagccaacatatgagttatcttggtattctcagggatagtactagcagttgataatagctagagtataagatataaggaagacatgaaccaaggcctttgcacatatgttctctttgcacacaatgatggagcacttccacttcatgtctatcttttcctctctctccctctccttctttccctccctatttccctccctttgtctctccccacctacatacctgcacacacacacccctacttagctcttactcattcttcatattcaaatcagaaatccttttatcatgcttttcatgactctccagtgtagctcaggtactttaattatatactctcataaaatcatgtttctttgctttggagtggttttcttaatttgtatttatatattcattaatgtgattatttgattaatatctgcctctcctgatgcatcagtggctttaagagttttattttaaccacacccatgggaagaaatacattaaatatattatacatcaaaagccaatgatatacacacacatatataacatatacagtacatataaatatacatacatacacgtatataaacaaaaataagttttatgaaacaagagtcatccttaccatgtgtgttgaaatatatttttatccttttcattagaaaattgttcacaagttgattttacagcctatctccatttgtcatccagagtttgaaaaaccttgtaacacacaccatcatggcacatgtatacatatgtaacaaacctgcacgttgtgcacatgtaccctaaaacttaaagtataataataataaaaaaaaagataaacctaacctggaaaaaaaaaagacaaaccttgtaacaggttggcactgcactaaaatagaagcagcgtctaggtttaccccctactctctctccagcccttagtttaacacttggggcataaaagacactcagtagacatttactgaatgaataaaaggaataaagagcttcaaaggtattgttttaaaagtgtgattatccccatttttaccaacaagaaaactgaaggtgagagaggtttagtaattttgctgagagtccctgaagctaacaataaacagaaccaggattcagattcaggtttttttactctaaaacaatgctaatttcccccttgtgcaggaagtaaaaaaaaagaaaatgggtcaggcgcggtggcttatgcctgtaaccccagcattttgggaggccgaggcaggcggatcacctgaggtcaggagtttgacaccagcctgaccaatatgatgaaaccccgtctctactaaaaaaataaaataaaatacaaaaattagccgggcatggtggcatacgcctgtaatcccagctactcaggaggctgagacaggagaatggcttgaacgcgggaggcagaggttgcagtgagctgagattgtgccattgcactccagcctgagcagcaagagcgaaactccatctcaaaaaaaaaaaaaagaaaaagagagagagaaaatacctaggttgctataggaggtagcaagctgataattatttatctagtagagaaacaattttaaataagtttattcacgtttgagatgcagttggtgtggaactctgaaagataattgatgttttaattttctacagtaagaaaattatcatttgctctgaaagatggcaaaaataagtggggggatagatgaaacaagattggtaaaatgttgataattgttgaagcaatgacgtctatgtctgttgtaaaaacttttttttttttttttgagacggagtttcactcttgttgcccaggctggagtgcaatggcacgatctcagctcaccacaacccccgcctcgcaggttcaagcaattctcctgcctcagcctcccgagtagccgggattacaggcatgtgccaccatgcccggctaatttttgtattttattttgtatttttagtagagacgaggtttctccatgttggtcaggctggtcttgaactcccgacctcaggtatctgcccgcccgggcctcccaaagtgctgggatgacaggtgtgagccaccacacccagcctgttgtaaaaacttcttaaactttaaaaaaaaaataacccatgaaaatggcttaataaaataacattacaataaaactcttctataatactttttacaagtaaaaactgaacaatgtaacaggattcaaaaaaaaaaacacaagaaaggcaagagtttattaactgagataatatctgtaaagcataaaatacaacatcctgtgacagaagggacccagtgttaatttttgtccctcttcacatcaggctaaccaaagccatttatgcaaaaaagggatgacttcattataaacggtgttttatataagcctttagaaaaaaataacactttatagctacataaacgagcaattaatctaatgtccttttaaaaagagaaaatatcattattagtatgattataaatgtaatctaaatattcatatataatgtatatattttttgtagatatgctcccaaaactctgctgtttgcagataacatgaaggtaatggtcatgattttaaaacttactagataggcacttttgcccagtcgtattggtctgaaagccacatcatatgtcaagaaaactctttgaatctccaagaatgtttcttcatctagccattgttatactgtacatattttttaataaattttttatcccaattatggaattttttttttcaatttaaaaataaatagccaatggaaaatgtgatgcagtactgcctatgtattctaactcataaatagaattttgatacattattttaaaaaactgtgctacaattacaagactggattttagtcctagctctaccattaaccagaaattgttcagagtactttaccttttctttccacctgaattctttcattctataattcatttccttcagctgtcaaatgaagaaaggaatgttcttcctatttcacatcaggaagcccagactgggagacaaataagaaaacagtatgaagttgttaaaatgttatagaaaaatggagacatatggatatgtatacaaatagtgataaatccatttatatatatatatatgtccatgagtgtacacacacacatcacacatacatacacatggataaggtggcatttatttaggaagattggctagaataacttattagaaaagcacaagtgtggaaattacgaggtgacaggaagaccacctccagtgacaccatggcacaattaggcaccagtggtacaattaggaccacttctatcagtgcatgtgagttgcggataccaaacattaaatcagtcgtaacaaagccattgtcaagtctaggagatcagaaaaatattccacttctctaagccttatcaaataatttgagtcaaattttagaattccaattttaggttcttgttccatgctgtaggtccatactgatgtttgttcttggctctgttccatctcacagctgctgatggcccaggagatcgtttcatcattggggaatcccaagctggtgaacaggtgagattgataggcctgaaaggcactgaagatttcagcttcatggactttgggcatctaattctaaatttctcctatcagtttagtggaaattagagagagattagtcagaagattatcaaagggatgaaagtatagttcccaggagaaccaaaagaattatttcttaattgaaagtatctacatctattaatatatgtcatagtattattagtatgtctcacagacatgccttacaagcattttccagacctgtgattgggtgattctttttttcctgaaaaaaaaaatgttctgaatagaacaatttctaggtagtcttctcagacttttccccaacttgtgttacaaatggggaaacttagaagtagattatttaaactttttagctaattatttaatttaatttttctcacttgggatctagccagggaacaggtttacatatatttttattaagaaatgaagcaataataggccacattggaaatacaagtccatttgacactttgagaccagtaattggccacttaattgaaaaatcagttaaagtgggaaattattttatatatttaaaataaatataaatttaacttaaatatttattagtcaataatttgatgaagaaccaaggtcttccttttaaataagtatgctgttttaatttctatcaggtctttcttacgtaaaccacacaaaaggcaatgtctctgatttccattttgatttcttcaaagtagaaaaaaactgaaggatacttgcaatacatagaagagcagaatccttttagggttttattatattttacactcttttagtttcctcactcacacctaattttacagcatttctttttagcagcatttttaatggaggtttccaaaaggttttacttaatttttataggaaaaaaataacatatatcattggtttatgtattatttatttatttatttatttatttatttatttatttttgaaacgtagtcttgctctgttgcccaggctggagtgcagtggcgcgatctcggctcactgcaagctccgcctcccgggctcacgccattctcctgcctcagcctccccagcagctgggactacaggcacccgccaccacgcccgcctaatttttttgtatttttagtagagaggggatttcaccatgttagccaggatggtctcgatctcctgacctcgtgatccgcccgcctcggccttccaaagtgctgggattacaagcgtgagccaccgcgcccggcctggccattgttatgtttaagaggaaatagcatctgtcaatccggtgagttacgaaggttgatcaacagagctcctaccttattaaatggaactagaaggaaaccaaagaacttttttcctttccctgctgcttcccttcaaagtttcctcttcctgagatggaatacccaactgctactaccaagcaatatataaaaataaaagtggcagcgggcgtggtggctcatgcctgtaatcccagcactttgggaggccgcggcgggcagataacctgagttcgggagtttaagaccagtgtaaccaacatggagaaagcccatctctactgaaaatacaaaatgagccaggcgtggtggcacatggctgtaatcccagctactctggaggctgaggcaggagaatcgcttgaacctgggaggcagaggttgcagtgagccgaaatctcaccactgcactccagcctgggcaacaagagcaaaactccgtctcaaaaaaataaaaataaaaataaataaaagtggcaagaaataaataaataataatttttaaaatgaaggcagcagtttggcaaacgctatgttccatgcctttcttccttggcttagcatggactaacactagaaacgagttgagatatataggagaaggatgatgccaatggtgttgacactagcttcttcattttagcatccaaaaattgaggagattcgcatgcaactctctgaagctaagttggcactatagtgatacatattctcatccatactgcaccaagctggatttcattaccatgaccatttttctgacaaaaagaacagctaggcttgattcttttttataaatgacttgtcttgtttgtttgtttgtttgggtttttttgaggggagggaggttgttcttggttttgggtttctgggttttttcttgagacagagtcttgctctgttgcccagcatgatctcagctcactgcaaccttcaccccagtatggactctgtgtgggggctccaaccacgctgggttctctattctgatccattggtcaatgtatctgttttgctgtccaaaccatgctatttcagttactatagctttgtagtatattttgatttctgacagtgggaagcctccagttttcttctttttattcaggatagctttggctatttggagtctcttgtggtttcatacaaattgtaggattttctatttctgtgaagattgtcattggtatttttataggaattgcaatgaatctgtagatcgcttttttcgtagtatggtcattttcacagtattaattcttccaacccaacgacatgggatgctgtttctttctcttttttttttttttttttttttttttgtggcctcttcagtctttttcatcagtattttatagttttccttatacagattttttacctctttggctaaatttattcctaaattttttttgtagttattatacatgggattgctttctcattttctttctctgctagtttgttcttggtgtgtagaaatgctattcatttttgtgtgttgattatgtatcctgcagctgtactatatttatcagttgtaagagtttttggtggagcttttagggttttctatatataagatcatgttatctgcaaacagggacaatctgacttcctcttttcccctttggataccctttatttctttctcttgcctaattgttctggctgggacttccagtactaggttgaataaaagtgttgaaagtgggcatccttgtcttggtccagatctcagaggaaaagctttcaactcttccacattcagtatgatgttggctgtgggtttgtcatctagggccttcactgtgtacactcattctttctatacctaagttgttgagagttttaaccatgaaggattgttgaattttatcagatgttttcctaagtctgttgagatgatcatatggtttttgtccttcattctgttggtgtgatgtatcacatttattgatgggcatatgttgagccacccttgcatccccacagtaaatcccacttgatcatggtaaatgatctttttaacgtgctgctggattcagttgcaagtgttttattaagcatttttgcaccaaggatattggcctatagttttccttttttgtgttgtatccttttatggtttgagtagcagaataatgctgacctcatagattgagtttggaagaattccttcctcttcagttttccagaagagtttgagaagaattagtatgagttcttctttaaatgtttggtaggattaagcagtgaagtcatcagatcttgggcttttcttcagtgggagactttattacagattcagtctcattactcatgattgatctgttcaggttttctattctttttggctcaagcttggtagattgtatgtattgaggaatttactcacttctgctaggttttctaattttttggcatgtagttcttcatagtagtctctaatgaccctttgtatttctgtagtatcagttgtaatgcctccttttccatttctgattttgcttatttgggtctttttttattagtctagctaatgctttgtcaattttgtttatatttgcataaagtcaactttaatttcattcatcttttgtggttttttagtctcaatttcatttgtttctcttatctgtattctttctttccttcttctgattttggatctggtttgttcttgcttttctaatcccttgagatatatcactatgttgtttcattgaaatctttctactgttttgatgtaggtgtttattgctataaacttccctcttaatgctgtttttgctgtatcccataggtttttgtctgctgtgtttctattttcatttgttttgggaaatctatttatctcttaatatatttattgatccattggttgctcgggagcatattttgtaatttctacatgtttgtacaattttgaatgttcctcttgtattgatttatagtttcagtccattgtggttggaaaaaaattcgatataattttagttcttttaaatttgttgagacttcttttgtggcctaatatggtctatctggagaatgttccatgtgcaagtgaaaaaaaaatgtgtattttatagctcttggatgaaatgtactttaaatatctgttaggtccatttgatctaaaatgcagtttaaatccagcgttcctatgttgattttctatctatatgacttgtccaatgctgagagtagggtgtcaaactccccaaatattattgtattggaatctgtctctccttttagataaataatacctgctttatagtgggtgatcccatgttcaatgcatatatgtttgcgattattgtatccttgtgataaattgatccctttataattatagaatgacctctcatatttctttttacagtttctgacttaaagtctattttatctggtataaatgtggctacttttacctgattttggtttccatttgcatcaaatatcttgattcatttcttcactttcagtctatatctgtataggtgaagtgagtctcatgtaggcagcaaatagttgggttctttttttttaaatccattcagcttgtctgtatcttttaactacggaatttaatctatttacatttaaggttattactgatagatgaggactcctgtcatttcattgtttcctggttttgcttaccccttgctccttctcttattgtttatcattgcagttgggtggttttctacattgatactgttttattcttttctctttctcctttattaatctggtctaccagtgagttttatgcttgtgtgtgtttttatgatagtgattattgtcttttttgcttccagatatatgactcccttgagaatttatggtaaggccagtgtagtagtaatgaattctctccatttttgcttgtctgggaaagactatttctccctcatttccaaaggatagctttgctgcatatagtattcatagttagaaatttttttatttcagcactttgaagatgttatctcctttcttcctgtcctgtaaggtttctgcagagaaatctactgttagtctaatgtggatttcattatatatgacttgatttggagacctttggaattcctggacctggatatccatacctttccccagacttgggaagttttcagctattattttattaaataagtttcttatgccttttcctttctttttttctgaaactccaataatatgaatatttgttcttgtatggtgtcccataagtcttacaagctttcttcactctttttcattcttctgtttctctctgtctctctctcttgctgggtatttcaaacaacctatcttccagttcaaagattctttcttctgctttatcaagactgctattgaagctctctattgtaattttttatttcattttttgaattattcagctgtaggatttctgtttggttcttttttatgatttctctatctttgttgaatttatcattcttatgaattgttttgctgattttgttgaattatcgctaggttttgtttttgtttttgtttttgttttatctaattgagtttccttaagatcattattttgcaatttcttttccaggagttcattgatttccttttcattggagtctgttactagagatgtattcctttagtggtgtcatatttccttgcttttttgtgtttcttgtgtccccatgttgatctgtgtgcctagtggaacttttgcttctttcagactttctgggtggttttgtagagacgcctgtagttgggctttagtgtgttggttgcaaagggtatggtgactttctggacaggtgcaatggtgtagtctccttgcagctttttcagttgcattcaatgtcagtaataactgtgagtacctcagtggcctaatccatagaagtttgtgtcagtggtagtagtggcataggctgttaatatccttggtgtcaagggcttttagagtcctcctcttcttgttttccacacaatagggagaatcagctgaagggatccctcttggtgttaggtctgacatgccctccaagcagctacagtggcactgggctcaaaatatggtgcttggagtgactgtggagccaggatccaaggctcagggtcttgtgaatccattgtggcacctggttcttggggttcaggttcactctctgtggcagagttgggtgtaggttatccaaagaaccaaggtttatgactgaggcaccccctagcagcttggacccaggtgccctggttgtacctgtgattttatacctcatgggtagggtgtagtactgaccaaactccaaagaaaaaggttttggccaggggagcagggtatggccgcagctcaggaaccagagccagtagggctcagcagcagctcgggtcacagtggataaggtactgtgtagtagtgaccctagacccctggatggtggggctacgcaggtcctcacttcagactctgaggccaggtgcagaagcagcagataccttagaatggcagagcgcagctgtggtttgatccccgggggggccaaggatcaacacagaaatgactcaactccccagagaggggggtatctcagcagctcagactctaaggggctatagtctagctccagagaagcagggtactagagttatttggcctgtaggtcaggatatcttggctcaatcagcactctgtttccctaggacatgagtgactacatcagctcagcctgggatgcgtaggtgctcagcttggcaaagtgtgtgcaacatactttctaagccttgccataacagagcaatatgtctggaaaaaggatgattaaagaagattagaaactatctccaatgtctggatggagttaagggaaaccaataaaggaatctgcagcacccaggagctagcaacagtgagatttccttaccacatcttagtctgaaggagcaaagaaagacaatggtacctgaacctgggaagattcatatctgtgggagaggactgcccaacagcagctcttgctctcagtaggagagatgccctaaccatcaccaaactgcagcccaggaggaaaagagcaaggggaatgaaaactctacttttctgtctctctcctaccctctacatctcttactgacccctccctttggctgagtctcaccagacgccaaagtggtgggaaactggttaaaatagtccatagaggtcagcttctggaccacagcacagagtagagaatgatgatgtgatctggagaggcaaacagaaaatgaaacaaatctttgtctttgtaaggcttatattctgtaatatataatgcacttaacattgtacctagcatagattgtgggttcaataaatattagttattggtagtattgcttacagtaataatattatggagagaagatttttaagacttttgtaataaatttcctgttttactttgattgtactttcagtagtaaggtatttttttttcttaaccattccctaaggggtgtgtgtgtgtgtgtgtgtgtgtgtgtgtgtgtgtgtgtggtttattttactttgtcttattttggtggttaaaataacaacaatgacaaaacatacacacacataacattaaatataccatcttgacagtttttaagcttatagttcagtagtggtaaatatattcacattgtagggacttaagattttaaatagagtcatgagttacttaatgaagatatattctgagaaatatgttgttgggcaattttcttgttgtccgaccatcatagagtgtacttacacaaacctgcatgagtagcccactacacacctagcctacatggtgtgacctgtagctccgaggctacaaacctgcacagcatattacagtattactgaatacgtaagcaattataatggtatttgtttatcaaaacaaaaagtacagtagaaaatatggtaatcttataggaccaccatcatatatgcagtccaacattgagcaaactatccttatgcagcacgtgactatacttatgaggcagacatctttagaaaggaatcttttggcaggggggattaatattgtctcaggattttttcttagggagaatttgaagcattcattttccaaactccagtctaaatcattgcccctgacaagtgactttcagatcacttctctatcagatcaaatctatcagatgaatcttacagaaaaatgcttttcctcatgttgtaagaagttagcagggaaggttctgtctcttataccatcaatatgagagcacaaacaatgaaaatcttgtttttcattttcaaaagtaatgtttaacctaggtcattacagacactggaatcatttttaaatgatttaattatatttgctcaacctctattattaattgataggtgagctaatgtgttttagaatattttcaaaggcaataattaaaatatttctggcttgcctttatttaaccaaaaagtttagttaataaagtactgcatttctcaaacattagaacttcaataagttatgaagatttttttttgtaattgttattcacaatgtatgtcctagcaatttttttacttacagactctcaaatcactttacatatattaggaaaatgtacattatttgagaggcaaaagtggcaaatgtaaatggcagttcttcaaaagtaaagcagagcaccaagacaccgaatagtcattaccttaaagtacacataaaatcagcttaaatgaacctaaagcccctttagtgtgagtgcacctgtttgtggatagcttttattacactggcccaaaatgaataagactgtaagactttcttttatggtttattttttaatattaaaaaaattaacatcctctgcagacttttcctttgcagcagcaaagtacatcaactgtctttttcatctttatttccagccaactcagacagtaatgccaggacaagtcatgcgggttacaacaggtgctccaataccctgcggtgctgatgcagtagtacaagtggaagataccgaacttatcagggaatcagatgatgtacgtcatcaccaagtcttactgtgctgttgttcctatggcagtattatgtcacaaccattttctgcagtgtttgtgagattaacccagttttttgggttgtttagttttgttttgtttttgcttatggtgggatcttatattgtagtatatgagtctccagtaaataagaaatttccttaatcttgaaaatctgttgttacaggaggggtttctatgatcattgctgttatagcagaatttgaatcatatttgacccaagcagtttcacatgcaaacaacgaaagaaagtacctcaagaaagaaatgcagagatattaatggttgacataccttccagagcagagatattaatggttgacataccttccagctgagaaatttgccattgagactagcttctgataaaatgtcaaggagttcatgaaatcagaatttactagagaagaatttaacaaagagcacttgggcaagttcttgaatattacactaagccaagcatttgaaccaaatgaccctttcacctctggttttctgtaagtctggaaaaagctgtgccaccaaatgacagcctggaaatattaagtgtatgtcagttctccctccattgcctcaagtaaaagatgctggaatctttttggacctaagcaagcctttatctcactgaaaatagtggcaggttattgaaaccagagtataagccagtaataaaagtagaatagattcaactgaggttttaataatcagctctcttacttgttttatgaagaaagtaaagatatattttaaagctgaggtgaaaaataaacatatattctcccaagccgagtagatagtaaaattggccatgccaagagacagacactttccctgatctggagattttctttttaatcacctttccatatgtaaggcttataaaattcaacccttggcaaacagatcacattgcctgctgttaaaactgcctaagcagatttattggcatcagggaagccagcaaagcactgaattccagaacacatacatccacagactctgccagatgacaagacacagttccaatgtcacaatattattcacagcccataaatgtaaaattgattactgcaattaatggacagaaatctactaccaggcaaactataagtcctttactgaaatttctgcaagtatttggtaaccttggcatggtattgaacccatgattcatgggaaaagaaggaagatattacctccacacacgttcactttattagggtagccacctacatatgtatataaaaatatataaacaaattctatataatgtattagttcaaatattaaatcttataaacaagatttaatatttgaattggtacattttttaaaagcataaaaattggagaaaaaaattttttatttattggcaccaaaccttctaatttttcaggaacctgtgttagaaattcagtgttttcaaagggtgtagcaaatagttttctttttgtctatatttgtatatatcctgggcctatctgatggtaaaagtatcggagtaactaaattctactgctcagaaattctgtttgaaattacatgaccggctgttattatagggcactgaagaacttgaagtgcgaattctggtgcaagctcggccaggccaagatatcaggtaacttcaaaacacatagaatatatagcctacttttgtttctacatgatcatttactcaggaaaccctggctactataaatctgcagccatgtcagttagccattaattttcagggctttaacaaaaagcaaaatgaatgttatgaattctgtatcacatatctgccctgcctactttttaatgaagatggtaaaggcgagttagtcaaaagcaagatgagaaagaggtaaagtcatgagcctacatattctacagttaattctacttctagataatccagaattacccaatcccatccctaaataatctggaatttggtatcaactcagataataccagaattgggtatttacacaattaactaatagcatatgctctagtgactaccaataataatggaataatctgttccttgttatatacaaagatgaggctatttgctatgataaatagtgcatataccttaaattatttttcttaaaatggaatatgtttaccctgattccattaatactaatttgctgaacatccctttgtaacgaagctacacttctcccatccctatggcagcacaccaaggttaatgtacctcagtagccacagatcaggaccaacctaagtggtccatatggaaattacctctatgactgtagcctcattagcattattctccttgacaaagctagccagctgtggacctcttatcattaatgccgctagatattgccatacaaattcttgccttatcaaagaaagtttacaattggtatttttactataatgtaacataaaacaatttgtaaagtaattttattcacaggtactcatgaaaaaaaatttcaaatatgaagtaacatgtttttctttagcagtaatacattcaaatcctatttctgttttctgttgtgtgatttaacttttaaaattaaaaaagcataggatttttagaatcccttcaattcattgttttcctactactttatttctagacttttttgtcttcttgaatgtccttttttgacactaaagtttccctctgagttgagaaaatgttgttctctaatcacactgcttatggttctgctttgactttcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgaggtattaaaaataaaaatggagggagtggggagagggcccataagataaaggtatttctgacatatgttctgtgttgtaaatagaatgttgtagattatagatcataccagtggatccacattcttataacagggaaacaataaattggctttaggatagtttcaagttcagaatatgagaacaaagaagaactagtaaaaattatgtattatgaaatgttctcttctattagaatgaaatattataaccaatggcctttccacaaagtcagtacacataagcaaaaaactttagctgctagctatagatattaaactatacaaactcagtactgtttctgtttagacaatgaattgtgcccatcctgctgctgaaatgatgagctacttctgtgtgggaagtatcaatgaatcaggacatcatggctagcacttcttgtgaaaagttccatttgatctttaatcactaagagggatttgataatcaggttttttttttcctctctctctccctaaagatagcatctctagtggcatgatatttagaatgggtcaaaatgtcttttcattcctgatttagaaaagagaatttagtccatctctttctgagaactcttgaaaaacttcctattgcttgttttgcttaggttgtgcaaaacttcagtcagaagctccaaggtcaaatggagaatactaaaaagtgaatctgctggaaactcaaaaccttataaaagaatcagaaactattgagatttttaaaagtattaataattcctttgaccttactattaaagaaaagattagcgggattttttaaaaatctctttgttctgaaaataaacccatcattatttttaatttcttgaagtcttggaaatgaaaattttcagaggtctttttatgacattatagtccttttggttaaagcaaaagaatagactgttttattttgcaaatagatagctaaatcaacattccagatgtgcttacttcccagtatatatgcactagtcatttccaaaaactattgattgacaaaaaacattcttttcaatttgatctacatagtaatgattttaatatccttagaaccaaataacactatatatagcatcagaaataaatttttgttaaactggttgactcagtgaactattcttttttatgatatacttacatgctttgtgcaacaagtaagttcatggagtttgagaaagctaaacagtagcacactcatggaccaggcatggtggcttattcctgtaatcccagcatttagggaggctgaagcagggggatcaattgaggctaggagttcaaaaccagcctgggcaacatagcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctctcaattatccacagagtatattgttagtgttttgtttaagctaccttttacactcaattaaaactatttactggaagtaggctaaggtaatggggtgagaatagagatggtattatatcatgaaatctagggaagagtttgtagtcttagttccctgcccccacagagcttattactcttgaagaagctttgactaattctacatgacttattcccctactttaacagacctgctatactaaactataccacagttttccaagagaataatgcttctaaattatattatctctggttccatatagctcaacattcctccctttctcttattcaaagttagtttttattatgactctatgatcatatagtttagttttgttcagcagataattgggtacctctgtgccaggcactttactggaaattggtgataaaaaaaaaagagataaataaagcatattatctctccagaaggcttgaaattctcagatacctagaaaacaatagcaaaaaaaaaattacctattttcagagagggcaaaagaaattgcacttaatgtagcaaggccataatttacccagtcacagtacaaactttccttaagtattggttttagtttcctttgatacatatggtttcaggccgggcatggttgctcacacctgtaatcccagcactttgggaggccaaggcgggaggatcgcttgaggtcaggagttcgagaccagactgaccaacatggtgaaaccctgtctgtactaaaaatacaaaaaaattagctgggtgtgatggcacatgcctgtagtcacaactacttgggaggctgaggcagaagaattgcttgaacccgggaggcggaggttgcagtgagctgagatcgtgccacggcactccagcctgggtgagagagagagactccatctcaaaaaaaaaaaaaagatatatatggtttcacatatgtccacttcttgaatctcatatgacatattggtaagcaggacagttgccttggcaacccaaagagtgccgtacaagatgtctatgtatactctaaaacttgccccagtattttattactgtatgagcttgttaaggaccagcaaattatttcaaaattggggatatagagttatcaactatagctaacatggaatagctgatttctgtattcgttgatttcaacaaactgtgcatattaaaatttagatatgcaacctgtggtgattcatgtctgtaatcccagcactttgggaggccgagatgggtagatcacttgaggctaggagtttgagaccagcctgggcaacatggcaaaaccctgtctctacaaaaaatacaagccaggcatgatgctatgcccctgtagtgtctgctactcaggaggctgaggcagaggttacagtgcgcaatgaccattccactgtactacagcctgggaaacagagtgagacaaagaaagaaaagaaaaagaaagaaagaaaagaaaaagaaagaaagaaagaaaaagaaagaaagaaacagaaggaaaagaaaaaggggaaggggaagcaaaaagaaaagagagaaaagaaaagaaacaaggaaaggaggggagggcagggcaggactgcttaggagatgggtgcaccaaaatctcactaattaccactaaataaattattcatgtaaccagataccacctgttccccaaaaatctattgaaatgaaaaatgtttaaaaaatagaaaaagaaaactcattcataatccaaaaaagaaagaaagagtctcgccattttgcccagactggccttaaactcctaagctcaagtgatcctcccacctcagcttcccaagtagctgagactacaggcttatgctaccatagccacttcacaggacaggttttaagccaatcaaatctgtccagagtcatcttaatggaaatattatattaattattttctaatacaatttgtaaacctctgtatttctaaaccaaattcttaaagactccttaaattgtttaaaagatctaaatgtttctcttcccttcttatcttgtaacctagtaagccaggcaattagcttaacgatcagttaaacctttttttccccagagttgtgttaaaagctatttgcaacaggaacattcttcatgagagctcattgacttttctccctctttttgtgttagacctatgtatctgaactatctgggtgtatccataataacaagaattgagttttgatcaattaatagattaagttttctagaagacagagaaagaaagtgagatgattaccacaaatatgtaaagagttactgaccactataaaagtcaaatcaccttctctttgcaaagagtgggaaagccttaaatgcaagcaaacccatttcaatacatgagaaagaaaggaagtcattacaaccagttcaaatagtatcttgggcacttgataattccatcaagactataggattaattaagtctttaaaagtactttcaagtgaataattgtagtcatatcaaaagtacttcaaaatgaccactgcaattccaggttgtccttgatgaaattatgctttttagaaagataaatgtgtgaaagagaaaacagaagccagagttatgcctggagatagtgcaagtttattattaaatgaacccatgaattcattagctactggtcattcaaaagggaaaaatagcacttaaatattgtacctaaagtcctcaacagtaaaggttgaacccctggcagctaaccctgaaacctaacaagctagaatgggtagagaggaaatctctcccaaagccagtttctcatagacaaaactaagaaaagttcttataggcacacaacaatgtggccaactgacagataggatggccagtttcaaatctttactaagaaaaacaaaaattagtataaatccaatcagataaccaaacaattctggaaaccttataacaaaaacaatatcagctgtctttgggagttcagcaaaaaaacgatcagacctcaaaacaagggctggagttaatctaagcatcatagacaaggaatctgcccaagcaaaaaggcagaagagacctcactgaaatacagtataaccaataatataactggtggcaagagttcctgcctaagtcttggtaggattttcataataccaaaatcctaatacaaagaccaccagggaaacctgttgatcatacaaaatggttatattaaagtttctgagaaaaagaaaacatcaccttgacaatgttggggagggaaaaataatttttcctctacccttgtgagttcttacctgggacctctataaacgatagattaacaagaaaaaaagagaagttagttaacatgtatacctcgtgtatatatgggacatacccaagggaaaattagtaactcctaaagtgatggctgagaagtctggcttaaatagcatcttcagcaaagaacagtacattcttagagaagtgatgagacaaaggaccttgagtctctagggccggcaatttgtgggaaggcaaatatatgggaaactaatgatagattaaaggctagttaataaagtttgatatataaattcctctggcgccatctgcaggctgataagtgtccaaagatttatccctcgggccaggcgcggtggctcacgcctgtaattcaagcactttgggaagcctaggcgggtggatcacaaggtcaggaaattgagaccatcttggctaacacacggtgaaacccctactctactaaaaatacaaaaaaattagccgggtgtggtggcgagggcctgtaatcccagctactcgggaggctgaggcaggagaatggcgtgaacccgggaggcggagcttgcagtgagccgagatcgcatcactgcactcactacagccagggcgacagagcgagactccgtctcaaaaaaaaaaaaagattcatccctccaggggtcgcggggggagttacctttcttaatttatgtcctacttttaggcaaacaggagaaaagcagagagcgtttcttatatttttcttctcaagtgccttcggctaaaaaatatttgttatgctggcatattttggggtagtatattctgctacccttcaacagagtctcagtggtgtttcacaactgggaagtcataagatttttatgagggtatttataggattttgaggactagggttggccatgggatagttttaaggtagaagttattaagcaaagtccgagcagagattggtcggaatttgtaaaataggtgaattggtggatcacagtcagtcttatcttcagagcatatgaatccatgtggaactactgttaaaacaagttgtccatgatcttatcttaaagtatatggatctgaacaagcttgtgttaaaaacaatttatttcaagttacatgtcctggtttggtacagtttagctgttatgcaaataatggtatagttttgcaagttgatgtttctgttttatttctcagaaggaaatagtttgtaggcaaggcagccaattataaggctttcacagaaattcagacataatgtaatgaatgtctagaattgttttgggaggtagtaaaagagtgaatgaaaatgtagggtcaaggaagagatggattagaatattcttaatgattgaggcttttgggaagagtgggctacaaaggggaaaacaaagttaaatgtttaggccaggcgcagtggctcacgcctgtaatcccagcactttgggaggccgaggtgggcggatcacctgaggtcaggagtttgagaccagcctgaccaacagtagagaaacaccatctctactaaaaatacaaaattagccgggcgtggtggcgcatgcctgtaatcccagctactcgggaggctgaggcaggagactcgcttgaacccacgaggcagaggttgcagtgagccgagatcacgccattgcactccagcctgggcaacaagagcttgatgctgtctcaaaaacaaaaacaaacaacaacaaaaaagtttaatgtttaaaaagtgggaagatagtggccaggtatggtggctcacacctctaatccaagcactttgggaggctgaggcaggtgaatcacttggggtcaggagttcaagaccagcctggccaacatggcaaacccccgtctctactaaaaatgcaaacattagccaggcatggtagtgtgcgcctgtagtcccagataggaagctgtggtaggaagatcgcttgaacccagggggtggaggttgcagtgagctgagattgcgccactgcattccagcctgtgcaacagaataagactccatctcaaaaaaaaaaaaaaagaggtgggaagatagtggtaccattgataataccaaaaatgggaaattgaacttggtgacttgatatggagatgatgggttatgttttgttttacctcatatttttttcttttgaaactgtaataaatttcagacatcattcccaagatgactggaagtataacagaaaataagattcagttttaaaaggaaaaattgtgagtttattctagtatatttagccttatactcttccatttaattctgtattgttttatttgaaattatttaaaatacactgtaaatcccacaccctcatttaactagctattttttcgttatgtcagttttacagacaaataatgggttctccagtgatctctaattttccgttatttctggaactgtttgcagcaaaataacagagaggaacataaatagcaaagaaaacaccctgataacagaggaatcttacttagttcgtggtcaataccctgctttgaaaaaaatgatataatcacacatttttctttctaaagcaactagtttgattaatggagttaaagagctgcaagccttgccccttataaaattataatcactttaataactgtgttaattaagatcagaaaattaatctatgttagcattgcagtagcaattttccaagtactgccagggagtaagaatgaaagtgggttacaatgtcacatggcatctgattaagttaaattagtaagtattcgaagggaagactccctggtgacactgaataagatggtcacagttttcctgtagcctattgtaaggggacagttggttgcaaagctactacttttccaatataaagtcaaaaatctggccacatactatcactaatgagtctgaaggaagattaggacttgtggttattgtctgggagaattcatataataagctctggtgttggccatattagtagctaaaacatcttaaatgtgcaggcttgcctttaacctcctaaaataatagtccaggttttctcacttcaagtaagtacttctttttttactttataatttctgaaatcaaagcatatcttaaaactgatacataaattgttgtaagaatgtatctgtgtatgtgaaggaccccctactcttaggtattttataatctaatagtctatgttcacattataaactgatgtcatctgtactagcatctaggggtaacaatatgagaacaattgggaggaaagtaggtgatcctttgacgtcatatgtcataaagaaaggaaagagaatcacatttattgtacatttatctgcataaactgaatgttcattatctcactcctaacaattaccttgcaaggtagttattattactatattttataaatgagaaaattacgacaaagaattttgtcaacttgaatttgaaccctgttggaatccaaagctcttcctactctacaatctgactacctcattggaacatcctaaggtagaataagcttcgttaattttcttcgtagacatagtagatattaaatctctaaagattaattcagttcagaataatggaattgtgcatacatgtagctaagtattacttaagtttgctagtatcagagacaaaacatctgtcttcctctccttcacataagcttagcttctttgatactgttgaccccacttcagaaaagagacaaaaaagtttgaaagaaaagataaactattattctgttcagacttaaggatatcatgtcacacaatctatacctcaaatattcccaatggaagacaaattggaaaataatattgggagaaaaaaagataattgttttatttagtttggccagtatctccagagcattattatcaaattggagcccaacctggtgggatattttgcatgcagttcaatcgccagtgaaatttcagagtgttttttgacttccataggaacattttctcatcctcctatactttcaatatttatttaaagatcctttgggcattcaccttcaaaatgccagataccattgtaggtgctagatatgctaaactcagtttagtagatttttttttcattagaaatatgcaacattaacctaatagaataatttgtggtggttttttggctttgtagctgctaaatcctgaagatgacctcttaccagggaagattcgagacagcaatcgttcaactcttctagcaacaattcaggaacatggttaccccacgatcaacttgggtattgtaggagacaagtaagtatttgatgtcattctgaaaagtttgtattgtacaaatacgagtttttggaatactcattaggtggagttgctgctaaagagacagaaatttaatgtcataattttcacttatctcattcttcagaagccaaagaatattgaggtatctatgtcctttagagataaagatttcttggaatgtctctgaaaacaagagaaatactttactttcctgtagtatgttaggtttcaaaggatgtttttgtaatagttttggttttatcccaatggagctaacagtgatggcattattctgatgcacatttttacttctttcaagaaagacaggaaaagcataggtaagaagagaaagagagattgtcaaaagtagcactacctaattctttgaaatttaagtacaatttttttctaggacttctatattgatttttgtgtctttatgtaacctgtttctccaggctttacctacttgaaagtacaaagggaagcacaatgactataattactcaatttttaagagcctattacccccatctactgaattaactcagccctctgctaagttttctaagtatttctgtgaatctccagtgctgtctcatgtgtgatcaaaagcaagtctacactttctaaacatcctagtatcatgcaacactgctgcctggctgtctttcaaaagtcaccctttccatttcactagagctacacctgcttttagtaatactcaaatatcaacccaatggagacaaggctcagagacagatctgagtgataaatactcatgatgtatctatcacccataatcccctttctctcttatcactacctcatcactgtgtagacctcattaagcatggatccttcttcccttatgttgagtactttcccaaaactcagatgtgcttttgaagaggttctgacctaccattcacaaggtaggatctgacaaggcatgctgtgaactttatcttaggctcacactggacatagtctaacctaagcttgtccaggccaggcacagtggctcacgcctgtaatcccagcactttggaaggccaaggcgggtggatcacttgaggccaggagttggagaccagtctgactaacatggagaaaccccatctctactacaaaatagaaaaattgcctaggtgtggtggtacacatctgtaatcccagctactcgggaggctgaggcatgagaatcatttgagcctggggggcggaggttgaagtgagctgagatcgtaacactgcaccccagcctgggaaacagagtgagactctgtctcaaaaaataaataagtaaacaaattaagcttctccaacccgtggcccatggaccacgtacaacccaggacagctttgaatgtagcccaacacaaattcataaactttcttaaaacattatgagatttttttgcgatttttttttttagctcattagctatcattaatgtattttatgtgtggcccaagacaattcttcttctgatgtggcccaggaaagccaaaagattgaacacccctggtctaaaccttggacacaagcatcttgccagtaacctgaaaggtagtagcttttatgtcatctaaccttttgaagttctcttctttcctcctgatttttttttctttctctgaggacactggagtggaagctggtgtattttcaaatgtcattctttttaaaatcttcaccatttgtatttgcatggatgtttagctctaaagaagtttggccaggagtggtggctcacacctgtaatcccagcactttgggaggccaaggcaggtggatcacctgaggtcaggagtttgagaccagcctggccaacatggtgaaaccctgtctctactaaaaatatgaaaattagctgggggtagtggtgcgcacctgtaatcccagctactcgggaggctaacacaggagaatcacttgaacccgggaggtggaggttgcagtgagctgagactgcaccattgcactccagcctgggcaacaaagcgagactccagggcccctcgtcctaagaagggaaagtaaagccagtgtacaggaaggaaaggggggaaaaagccagttatttgaatttgggccttagcagtaacctatcctttaagatacaagtacttaaaaactatcctatccagatacagcttttccaaagaccaaaatcaacttctgagaagagaagtgataaatccaagagtttgaaaacacaaagataaggcaagcaggcttgaaacttcatggaacaaacaccagattcttagggttatttccctcctaccaatggctctggccctacctctaagtgcgttaatgagctctaagaaatagtataaggaaaaagggagcttttaaattgtttttaccctaatttgttctggactataattctgcccattctccctcttactgttatacttttttttttaaagaggttacttaatatactgtatatactgccattatcttgaagtactctaaaggccaaaacatcattgaaaggccaacatgttggtatgctgatatttttctgggatccacactgttaatttgtggtggacatttcctaataatggtgatattgcatttaactccaaaatatactttgaaaacagtataaagaacaacaaaactataaacaggttaaggcaattcagtgaatgtacaaatctctagtgtatacccttttcttgaatagtaataccttatatcaaactgagaacaatttaaaaaaaaaagaaattgatgcaaatctaggctttcttagtcttagagtgctatattgaaggggtccagagtgaatggtgtagaatgcagaggtggaatgtgggaggaaagaatttataattgttctaatggaaatctgtgctgggagtttagcaaagaaaacaaggtatttaatctacagcctattgatattctgtgaaggctaccctccttcattcttcttcatcctattcagccatttgctaaggaaagcaaatattgtcacacagaagcatctgggtaaagctctccagggaaacaagcagagtcatgggagaaactgtaccctaggtttaaagcagggagagaaatagctcaagaatgtcaataagggcgaggtgcagtggctcacgcctataatcccagcactttgggaggccaaggcgggcggatcacctgagatcaagagctggagaccagcctgaccaacgtggcgaacccccgtctgtactaaaaatacaaaaattagctaggcatggtggtgcatgcctataatcccagctacttgggaggctgaggcaggggaatcgcttgaatgtgggaggtgggggttgcagtgagccaacatcgtgccactgcactccagcctgggtgacagagcgagactctgtctcaaaaaaaaaaaaaaagtcagtaagcacagaaccttactcaactatgacagataagggtagagagtgacagctctatttgtatcattaaaaaaggtttgagtctggtttttaaattctatatgattctatttctcagctcttattcttatcacctgccataattttgacaatcaaagtaaaaatagaagaataagactttgtagctctttgaagtgagttggactaaatggcctttgcttactataccttttattttaaaaggttaatttaatagtactatgaagattactggagggatgcttcaaatacctgagaattaacaactgtatttgaaaatcattcatttgtaaacattatatatatattaaaatacatttcttgttttctcacactgtttggaacacagtactgttggagttcctatagtctttttctttaaagagacacattttgaaacccagagatattaagtaacttgcccagcattatactactagttagtggcagagataaaaatggaatctaaatttcctgagattgacaatccataattctctactatcattataaagacaagatattgtatacctgtgtactactgtgggctggattggtcagacagagttttataaacctctagtttcaagctagaacttaaaagaatgagtaggatttagataggaaaagagagtgtgttaatccaagtaggaaactgaatgcacaaagtagagaagtagaaacaaatagtgtctagagaattagaaatgaacaagagattcaggtagaaggataagacaggtaaattgagtagaaatttgaaccagattttgaaaggatgtggagaaataggaacacttttacactgttggtgggactgtaaactagttcaaccattgtggaagtcagtgtggcaattcctcagggatctagaactagaaataccatttgacccagccatcccattactgggtgtatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcctgtcctttgtagggacatggatgaaattggaaatgatcattctcagtaaactatcgcaaggacaaaaaaccaaacaccgcatgttctcactcataggtgggaattgaacaatgagatcacatggacacaggaaggggaatatcacactctggggactgttgtggggtggggggaggggggaagggggagggatagcatcgggagatatacctaatgctagaagacgagttagtgggtgcagcgcaccagcatggcacatgtatacatatgtaactaacctgcacaatgtgcacatgtaccctaaaacttaaagtataataaaaaaaaaaaaatggctttgcaatttaggctgccaaactacccaattcagttaaatttgaagtttgggtattttttggtttgtttgggtttttgtttttgtttttgttttgccgaattgacataaaaaacaattattttaaaaagatcaattgacctagatttatcatataagctaatgatggagactggaaataaggagaacaatacaatttgtttactcattgtttaatcagtcaccaggaagtattgattgtgtacctgtgagtcgtctggagatcttattgaaaatgttgattatactttaacaaatctggggtgggctgagattttgcatctctgacaagctccaaaattataccaaactgcaggtctgtggaacacaggaagtatcaagaatatagtaagatcagtcatgcgtctgctatgaattttaagccaaaggctatggaagatacaaaattgaaacagatattgatcttacttttgaagaatcacaaattccaagcagtaaaaatattttagaaggttccagaacttaaactcaaatttggaactataagaagaaagagattaaataaagagaaatattgaagtctattatgtagaagagagcagtgtcactgttgaattatctttgtctggattacaaagcctcaaaatggtatgtgtatgtaaacacaaaatgcctggaaaagcaagctgttaggcctctttaccacaattttatattcctgtgtagcaacatactatttccatgtcttcattctccactcaaaatctattatttcttggcttttatagctctttttgctatgctcattcccctaaatataggtctccccgtggcttacccttggctttctgtccttttcattctgtatgctaatgactgactaccaaatcttatatccccagcccaaatatgaaactagtaaagcctagatattctgaattggcacaaatttatgtgagtttatatacttttaagcacaaccctatttctacttttttttttttttgagacggagtctcgctctgtcgcccaggctggggtgcagtggcgtgatctcggctcactgcaacatctgcctcccgggttcaagtgattctcctgtctcagcctcccgagtagctgagacgacagacacccaccaccgtgcccggctgctgtttctacttttttcccaaaatacattttatttgaaaaaagcaagttgcagaataacatgtttaattttatctcacattgaatagcaactgaacaaacatatatttataaatatggtatatgcatgggaaggtatttatatgtagaaataccctatacacccaagtgttatttctagtagtaagagtttgcatatggggtagaagttagagaattaaaagtgatggtaagggccagccactgtggctcgtgcctctaatcccagcactttgggaggccaaggcaggtggatcacaaggtcaggagttcaagatcagcctggccagtatggtgaaacgctgtctctactaaaaatacaaaaattagccgggcgtggcggtgggcgcttctaattttttttttttttttgagacggagtttcgctgttgttgcccacactggagtgcaatggtgcgatctcagctcactgaaacttctacctcatgggttcaagcgattctcctgcctcagcctcccaagtagctgggattacaggcatgcaccaccacacccagctaatttcgtatttttagtaaagacagggtttctccatgtttgtcaggctggtctcaaactcctgacctcaggtgttccacctgccttggcctcccaaagtgctgggataaaaggtgtgagccatcgtgcccagccacttctactttttttttttaatatttctgaaatacttgaatatttttaccctgaggatatactgtatttcttttgtaataaaagaacctcctaaaaattccccttatgcattattaaaaatttggtggaccagtattgacaactgtaatcaaactttccaaaacggacaaaagaggcaagcagctcatctaaggaatctgaatctaagtaagagctattaatactattaggtgtgtaatgccataaacatagtgataagtaggcaaattaaaaagaagccaaagtcttgctgcattttaagtaaaattataatattttgtaatacaacaaaagtttaaatcaaaagattatagaaaacatacttaaatgcaaaatcttaatgtctatattgactttgaattttatttctcatactattttgcaattgctcaaataataagacttgaaaatttagccatagtatatatttgtagaacttgacagataactaatgtaatagaaaccttagcctacctacattttgttttctccaagcataaaaagtatttcatagctatgttttgttttccagaacccatggtgataaactgttcatattagatattttcccccaatagatgataggttggcagcatcattgactagaaagaaagaaagaaagagagaaagaaagagagagagagggagagggagggagggaggaaggaaggaagggagagggagggaggaaggaaggaaggaaggcggagggagggaggaaggcaggaagaaagagaaagaaagaaagtctttaatgttacccttgacaaaatatcaactattttacctcatctagaattctacaaaataataatgtaatatattggctttgaattttcaacctctcattataaattctttttcttcattttcatgtcgttctttcttcttttgattgcacagtgcctttctattctttctgttcttttcactcaaatgcattctttatatatttacatattttctactttttaaattttagatgcaggggctaatgtgcaggtttgttacatgggtattttgggtgatgctgaggttttgagaaccaatgatcacgtcacccaggtagtgaggatagtacccaatagttaggttttaggccccttacccctctccctccttccctcctctagtagttcccagtgtctattgttgccatcattatgttcatgagtacccagtgtttagctcccacttacaagtaagaacatgcagtatttggttttctgttcctgcattaattcagttaggataatggcctccagctgcatccatgtagctgcaaaggacatgatttcattcttttctatagctgtgtactattccatgatgtatatgcaccactttttttttatccagtccaccattgaagagcattctatgtctctgctattgtgaataatgctgcaatgaacttaagagtgcatgtgtctttttggtaggatgatttgttttcttctggatatatacccagtgatgagattgctgggttgaatggtagttctcagttctttgagaaatctccaaactgctttccacagtggctgaaccaatctacactcccaccaacggtgtgtaaatgttctcttttctctgcagcctcaccaagatctattatttactttttagtaatagccatttggactggtgtgagatggtctctcattgtggttttgatttgtatttctctgtgattagggatatgttaaatgatcatatccctaaacatatgttcatatgtttgttggctgcttgtatgtcttcttttgagaagtgtctgttcaggttttttgcccattttctaagggatctaccttaaatatggaacagcagatgtcctagttttcttttccccgaggctggttcaataacctattagcctcctttagtcctcctagacagtgtgagctactgtaggggaagagttgaagacaaagaaatgtagatgggtaaataagtactgaatgctatatgtgctagccaagcagttgtggccagaacttagtaagatattggtcatttgagcacatatatttttctctgttactgctttttttttttcttttttctcagtttcctaataaatttgctttgagaagttgttgtcttgtatggcttaaacagggtggaaaaaggatttgtgagtattgggccagggttgttttctttcccaccagataagctccatgaatactaggacaaagtgtatgttggtaaacactatatccacagcacttagtagggatacattaaacagccctgccatcttttcctataccattctctctttccatgaaacctagaaactttcaattatacaacagtccagaagaatcttacagggccccttcaaagtaagtccaaaagccttgaccataggagcaggccagaaagtatggtactgacagtagagttgcattcctgagacacatccccaaaaaatgtacagtgtaaagctttgtggctgggtggttcattttatatttctgaagaaaagcatcttgggagaaattccaaatagatttagcaggcttttaatttaaaaaattgaggagcagctctctcaggcttgaaaagatcttacaaatttacttcttgaatataacaagcggtaatcattatccaaatagaatccacttggggaaatttttttaaataaatttcagcattaattgagtttatataattcctcaaactgattttaagtattgaataaggattcaactttatgacagctcagcaatatagcttctgaactgccaacttggaccttctagcctttcaaggcctgaaggaagggctgggaaattcccatcattaagaagatttcccccttctggaaaattgccatcacagaagcctgccccactcaaatcctgggcttacttgactatgtcatagattgatgttttgtatttgaactgcctcctcttgctgctgcgaatttgtgaagctacctctttatattaaagcaagaagcagaaggacaaatactgagatagaaaattgggttcttaaaaacctggcacatttagcaggaattatcaagatagacttaacagcacagtgattatttgggcaaagccgagtgccttacaacttccaatttgtgaaccaaacacatcctaatttttcattgcttacccaatgttcttaaagtaggagttttctaatcatcaacgataatttagatctgaatttaattggttcttgtcatttttataaactatctgctctccttatggcatgaacctccttttctgctcaaaatgcaaagttttcatttttgagtcaacataatagatttattttcttctttttttttcttttactcctagcaagctgggatagatttattttctgatcatttttcagcagaggtttctcattttctattggttaacaaagaacattctttctaccttaacaaacgtgtttaatgacgagaggttctttccgatctcagtgatagactttttatgtagctgttagagttgccctcctttatctttaagcgttgctattgcagttgacatttctgtttcttctatgaataacctctaggtattactgtagctttagacattgttttcctaccccaaactcataaaaagtaatgtcttccagaaagcctgtcctaattatctccaactaattctaatcattctatcccatttaccctttttgtcatttctttatattatatataaatatatgatatatattttttcattttaattaatgtatttgaattcaacagatgatattaatgtcattgcttatttcactcatttttctaactttttttcactgatgagttttctgcactagcttataaacttaaaggcaagaaccatgctttcttctttctttacatgactccatggtcccagaacacccagtgagactggaaaagaatgaaatgatggctatatgtgtagtatgtagtttgattccatacgtgaagtagacacccagaaaagatttgtagttaatgaatttatctttgacctctgaagaaactatgatatgataatagatgtcctcagctattttttgttaccttggtatgattaactgccaacattctttaatccacacatcctagactttttctctgtgtcatcttcactcatcttaaaatgatgcagcttgcagttggtgtaacagatgaaacaggaaactaattagcagctgttgtccatctgtgtgtttatattaaatattttaaaatagaaatgtatttgcattctgaatactgtttctgaaattcataaatcctaaacttgggtaaatgctgtaaaattcaaaaccaagacagagcctttaccatttatcttcatgataaagcaaaaataattttatgccagaatcaggattatagtaatttgaggcagatgtaaattttaaaaagcaaaaaaagtcttaacttttttaagttgctttggaattgagcccccaaagcaatcaaattgaaatctgaaaagatacagtgttcaaaagatgtcataccctctgaatatattctttcttcacagaaactgatgagtacatacacttttgagaaagctgcattcattctctgacagatttattttgaaacatgctcctcctttctctttttctacctttctattaagtgcgtggttctttgacatgtgatcaacttagaactctacagagagtgctattaatattggtagccatcttccaagttgaagatgaatgtcatggctttaggaagaaaagataccgttattcatttcactcaagtcaaataggcaaatgtttcttatgttcaaaaatgaaagggagaagagtattatctacaagacaagtatcaaattgcatcagtcaggtcagattggtgtttccctctatgcttcagtttatatgtgaaaagaaaatagtcattgtgtttatgtaactttcagtatttccatagaatcacagtatcttattctgatgttagctagtccagactttcacccaagggggtgttaaggaaaatctgcaacaacttagctgttaggtttttgtttgaattcttttagtgagaaagatctctactgcctcatgaggtagcacattctattgttcgatggctgttaaagtaagtatgtttttccattacacagagccagtctttcttcctgtgtctttcatctgttagccctaattctgccctccaagcaatgccaaataagttggcttcctcttttacatgatatttgaatatacagttgtttcaccttaatcccttctcaaagtactgtttatgattatatgtttagcagtatcttttctttcatcccagacaatattattagcctatgatattataattgagtaactaaactatttactcccaaagctactgtggatagactgacttgaaatcaagtttcattcagcccatttactgagtgcctacaatgtgcaggaatttggtgggacaatcaggaagtctggatgaaatgagacgctgtcttgtgagagagttgtatactgctgcatcacctttacaaagtttccttttatcacaatttgttgtgtctctttattcttttttttaacatcaaatcccgttttgacattaatattactactcctgcttttttgcttatttacatttgcctggtgactttttgccctacttgttattttctttctttctttctttttccttctttctttctctttctctttcttttttaatttttcttttctttcttttttcttctttatctttcctttctctctctttctttctctctttttttctctttctttctttcttcttttttttttttttttttttttttttgacagagtcttactctgtcacccaggctggagtgcaatggcacaatctcagcttactgcaacctccatctcccaggttcaagtgatcctcctgcctcagtgtcctgagtaacgggcattacgggcacctgccaccacacccaactaatttttatatttttagtagagacagggtttcaccatgttggccaggctggtctcgaactcctgacctcaagtgatccacctgccttggcctcccaaagtgctgggattataggtgtgagacaccatgcccagcctagatttagctatattttttataaaggactgtgtgtgtgtgtttcactactgttttctctcctccaacttcccctaccttgaagtctatgttctgaatcattttttcatttacagtcatttttccagaacattacttggtgatttgtcatctgaatctttgcattctaacaagtatcattcttccattttgattagtgaatgactggatgtaagatttgagggttgtatggcttgaagagatatgttgatgttaatttactattttctagtttttggtattgtaggtaagaagtccaaagccaatattactttttcctttgttagtaacccaatcttcctattaaatatttggtagcttgtaagattttctgtttatttttgaaattccaaaattgtaccaggacatatttaggtttatgtttttgttttgcttttttttttaaatcaatcttggctggaacttagtaaaccttttcaatttccaagtccaactcttctcaaataaataaaattttcctcttttcccccctatctcttcctttatttccttatggaattcctattggtagtatgtcagtctcttgctctgtcttcttattattttctgcatgacttctatcttttgcacttttgcacaatccttggagatatttctaccacttgatcttccaagcaactaattgaatttttgacaaggactgtaattaccttcatctactaaatcttaaaatttgaaaatcacatattttgttccagaacacagtgttaatgtcataattgaatctgtattagtgttttaattgcttattattgttattaaaattatctattgccccagaagttttatttctctaggtatcctaaatattatgctcattcttccactctccagttggttgttacttaggttgctggtattttcctctccctactgaaagttcgattcaccctaagggttctggaagctgctagggtactttgggcctggtgagaatggagttacagtgggaaagaggatcatgagtggcaaaaggaagagaagtgtcaattcctgaattagcaaagcacaaaatggcaagctgctagtcttctattaaagtacaaaaaataaacagtccaagcctctgtgcttcctggacggttttgttgtgaaggctggactttcccagcctttaaaggatagggcagtcttagtattttttcaagtagacttcagacttctgggtcaacctaaaaaaatttatagctttgcccttgatctggatcccaaccaaccacaaattcttagaatcagtgaatgttagagatgaaaaagacatactccaaatgtcctcattttatagataaagagaataatacccccttccccaaaaaaatgatactagtttttcaggatcatctaggtagttagcagtagagataaaacaggattctagactttgtgacactcaggtcttcaattaatggctttatcttctgttgcctagtacatacattcttagcattaaagcaattgtcttacagaatgttttcatgtaatattggtactctaagagaacaatggttaggtatttaattattcaaatgaaaatgaatgggaagtgttagtaaatcaagattcatgttagtattagaattatttttggctaggcgcagtggctcatgcctataatcccagcgctttgggaggccaggagttcaagaccagcctggccaacatggcaaaactctactaaaaatacaaaaaattgccaagcatggtggcacacacttgtaatcccagctacttgggtggctaaggcacgggaatcacttaaagccaggaggcagaggttgcagtgagtagaggtagcgccatgcactccagcctgggtgacagagcaagaatctgtcttttttttttgagaaggattcttgcactgtcacccaggctggagtgcagtggcacgatctctgctcactgcaggctccacctcccaggttcatgccattctcctgcctcagcctcccgagtagctgggactacaggtgcccgccaccacgcccggctaattttttgtatttttagtagagacagggtttcaccatgttaaccagaatggtcccgatctcctgacctcgtgatccacctgccttggcctcccaaagtgctaggattacaggcatgagccaccacgcctggctgactctgtcttaaaaaagaaaaaaagaattatttttcggccaggtgcagtggctcatgcctgtaatcccagcacttttggaggctgaggcgggcagatctcttgagcccaggagttcaagactagcctgggcaacatggtgaaaccctgtctacaaaaaacacaaaaaatattatccaggtgtggtggcgcactcttgtggtcccagctactcaggaggctgaggtgggaggatcgctttagcctggtatgtggaggctgcagtgagctgtgatcacaccactgcactccagcctgggtgatagagtgagaccctgtctcaaaaaaagaaaaaaagagatttatctttaaaggaatggctaagcaccatccaaattaaattaaaactgcagttgttaatgaagaaagatttaagtgatatcatgatatccctttaagatatgccactctttgtgaaaagggaaactactgatatatacctagaaaacttaatctgcttaatccaatagcccctctagtggcagtggtgagaataagtcaaattttagaagtacaaattttgtttctatcagtatttggtatatacaaataagatttatatatttatataaatgctgataaatagcttttatctgaaggtgttttatgtgtaacaaagtgtctttcataatgcaaatattactatatttagaagaagaatagagaaaacacaggatgagtttgaacctaatactacctatgtgaacctcagtgtcctcttttgtactgccttcctcacagagttgtgagattaacacataggtgtgaaaatgtattttttaaaaacattagtattgtcattaattatatttcttggatattaattgatcttatatgtgggaagttctgtcttaaatataaggtcagattataatgttttgtagttttagcctcctatcattgagaaaattaatataccctgcttgctttatgtgagaaaactgagaaaatcatgaactgttttctctctattatattattcatgattataacccttgttacctatttcctcttatcactattcagagtaatctttgagttttagaaagaaaactcagtttttatatgttaaaaatgaagagtctgggggaaggaatatgaagtaaatattggaaaatattagcatttgtcaaatctgagcgatggatacatgggtgtttgttatactgttatgttggaaatgttttataatttaaaatatagcatgaatcataaaaaagaaagcaaatttatgatgtgaataggcccttaagctatggttaaccaaaatcatagttttcatctgaacatgggattctgaatcatgttcatttcattccacagagtgatagtaaaatgttcacacatgcagttttctgctggttacctcagacaaatccatacctcttgccacagcatcctctcctttttttttttttttttttttttttttttaaattattaagagactaggtctagggccaggcacggtggctcatgcctgtaatcccagcactttgggaggccaaggtgggcggatcacttgaggtcaggagttcaagactagcctggcaaacatggtgaaacccatctctactaaaaatacaaaacattagccagccatggtggcggacatttgtaatcccagatgcttgagaggctgagacaggagagttgcttgaacccaggaggcggaggttgcagtgagccgagatcgcgccactacactccagcctggtcaacaaagcaatactccatctcaaaaaaaaaaagagagagagagactaggtctcactacatcacccaggctagaatgcagtggctattcacagatgtgataatagctcgctgcagtcttgaactccggggctcaagcaatcctctcacatcagcctctcaggtagctgagactacaggtgtgccaccgcacttggccagcatcctctctttctgatgattctggacaagggtccgttctcattagactctttcttttatggtatattacatgcctttaaaaaactacacaatcacttctgattaggcagggagtggaacaagcatttaataagaagccagagtttgtagtcctggctctgccatttactgctctatctacactttgcctctctgaatataacttgccttttcttaaaatgagcatagtaataccttttcagtctagcatacagatttgttgagagattatagcatgcaacataaatgaagttatagatcccctggctgttgtcatatgttggtacctgtctctctagtaaggcaggatgtctgatcaaatctccagaagccagaagcgtacaacagaaaggagagttacagagagtagcaaagggggatagagtatggcaggacccaaataactggcccagcagtgacaatggacaagataacatttacaactttgagattcaatgattttgtgaatatactacccacagagtacaaagtatcattgagcatattctttgaaacatgataaatttcagtaaggatttggaacaaaatccctttcagctgatttctgcaaattagaaaatttcatgtagagaattgatgtctctgaggtttcacaaaataggaaaaaaacatgtttcccagataacatgaaaataatgagtaaggctggcacggcggctcacacctgtaatcccaacactttgggaggccaaggcgagcagatcacctgaggtcaggagttcaaggccagcctggccaacatggtgaaaccctgtctctactaaaaatacaaaaattagcctggcatgttggcaggcacctgtaatcccagctccttgggagactgaggcaggagaatcgcatgaacccaggaggcagaggttgcagtgagccgagattgtgccattgtactccagtctgggcaacaagagcaagactccatctaaaaaaaaaaaaaaaaagtacgataaagcactgaaaagtacttatttatagtaatcagctaggctccagaacctttatccccctacagagatgaataccatgatggtgtgcatctcactgctgctttgtttacagtagctttacaataattctatagaatcaacatattgtagttatatattacaaggtttgtaaaattagctaatatctttttctactaacataaaattatatttgttgatagtattcattacccagtcagtattttgaaccacattccatgtgatgctgtgtttgggatgttttttccatttactccatagtaaatgaggaaccattggcttagcataatgataatatgatccagcaaggcaaggagcccagaactctgggcatcaggaacccatcacatgcatattgtgtagtatttcaatacaacagaataatttgctgtcttttttcctaaatcgaaatgaaaaggatagatgagaaatctgttcaaaatacataggtcaaaaatacgttaagtacaacattattcaaaataattctgagatgtttgcccaactagtttaactttgaaatttatgtcagggtttttttttttaagtctttaatgttttacacatagattctaccttcagttaatacctgggcacttttttggctgcctatgcaatgactgactgaatgactttaaagggtctctatgttggtaggctgaaccttatatgagccatttttcaaacttttacttttggcccttctccttgggagcttgcttcccagagtcagagcttgtggacaggccagtgctagaggaaagggagaattttacccagaccctgtaagagaacctcatagtaaatgaagctattcaggttggaaccaggcctaccttgccatttggacctttcatatttagctctgtgaatgtatttaagtcccagtctatgattttcttgtgtgttactcatgagtattttccagaataaaaatcccaagcatgctatagtcgaactttgccagtttgttgggtatgtttgtgtgattaacttgttaacatagcagcaatagtaatgacatatgactttcttgaaaacctagtttgttccaggtactattccaagtgttttatatgtattaataggatgtcatttaatcctcataacaaccctattatggctactttacagatgaaaaactaaggcaaagagaagttaagcaacttgtgcatggttaaacatctagcaagcagtggtgctaggatttccactcaggcagtctgactccagagttcacattcttaatctctgtgctatgccacctcctgactagcttatctcttatagagtctgtgaaggttgtgtctctggtaggtctcaagttctgcctacctctgtcacacctggataaaaattgaaattatatcctagttacaaatcatgctatcttgagtcactaactttccttcttcctctctcatcaaatagtgcattaaggtaagggggcatgaataaacttcactgccatgagatatttgtgagaacatatgctgtctcgttgagagatcatttgttttcaagttaacaaaaacctgctgaagctagtgcaagcaaagaagacatttatggaaggatacaaggttatctcatagaacccaagagcaagaatacagctgggcctcaagggggatgaaaggcaggtagccagggttactccctttttagttgttctcattagatgtccatagggaagaaagggaaaggaagagtcaggcggtataaataggtaagaatttttcagacaacaagagtatggctagatatatactcctcaaaaagtatattttctgtactgcatcaattgaagggaaataccaattacaggtcgcattgcccagtagatttgtatggatttaaagtaataactaaacaatccctttcaactattcccaatcatcctgtcccttcataagtcttgattcttggcattttgtttattctcacttgatcagtctcaagttaggacttttcaactgttctgacacccaaagataagacccctgttttcatctcttctccccagaccttcaacctgtaccatcaaagagcctgttgcacttgccttttcaagtgacagtcaggaacctgcctagcttccattcctaatattaatatcctatatgagtagttcataccatctctgctttccttgtccttttccccctaccttttctcttcccaacattatgaatacctactggcttttcctatttctagggatcctcccccctccatttcctattagataaactccaaattcatcagcttgagggttcttcaaaatcatgtcccatcctaactgtcccagtcattcccactcaagtccttcactctaagcaggccattttccacagtgacctagaaacagcacaggcttaaccattattccaagcctttgctagtacagatcctcttgattacaaagctctttcccattcctttcctttccacctctctgaatccagctcatttctcagggcctcacctaagacattctctctaaagagtcctatgtgatctttccaacacctcaggtaaccaattgtccaggattgccttggattcctaggacatctgactttagtactaaaacaggaatattcctaggcaaaccaggatagttagacatcctccaacatctcattgtctcctttcattatagtggcttgttagaataaaaagccctgtgaaatcgccagtagccactacttcagcatgtacaaggtcctttctccataataagacttaatgctcctgttaggcagagacccttttgattcccacttcatacagaatatagtgctgtactcatgttaatgcctattagtgaataaggcgatgtagttttaagttggcactatatctaaaatcttttccttgtgtgttaatttctttgtctttatttttttccagcccagatgacttactcaatgccttgaatgagggtatcagtcgtgctgatgtcatcatcacatcagggggtgtatccatgggggaaaaggtatgaaagatagggctcgtgaaaatgtatctgctgtaatgttcttgcatatggtcgattaactgtggtctggtaggcatctgatattcataacgaggctcccacaaagctgaaaatccatggggcttcagaaattactggtctctttaaaagggatacaatgtgggtaggtcagggagcttaccctcaggagcaacctggagaatcccacaacttacagaatggtttttgctattcctgtggaaacttctgacctgtttctcactctattttactacattaggacatcctttatgcatgatatttaccaccagggtaaaactctaagatccttccttctactcaaatttaaacatgactccccaggagccaaccaattcacccaccatatattccaaatctaccaagaatgcttagctccccttccccacaaggaagaaagggaggattaggcattccttttgctcctccttacaaaataatataataataataatgaaaatatggccaggcacagtggctcaagcctgtaattccaatactttgggaggctgaggtgggtaggttgcttgagcccaggagttcaagaccacctgggcgacgtggtgaaaccccatctctacaaaaaaaatccaaaaattagctgggcatggtggcacgcgcctgcagttccagctacttgggtgctgaagtgggaggatcgcttgagcctgggtggtcaaggctgcagtgagctgagatcacaccactgcactccaacctgggcaacacagcaagaccctgtcttaaaaaaaaaaaaaaatatatatatatatatatatatatatatatatatatacacacacacatacacaaatattttataggactaagtgtatttgtagatggtatatacttgttcctataaagaccacaatttgaatatttcagtaacactaagtttacatttcttaatgaaatgtgttagtttacgatgactattgggtctactgaataatgttataaaagtaaaatattgtttactaaataaccaagcttaatttttggctcaaagatatttcagtgtaaaatgttttgccagctgataatccttttccatgttttctctcacattaatgactaaactgaaaaattacaaaaatactgtcatagcaatttttaccaaaattcatattttctaagagtttgatttattttaaactagatcttacgtatatgattgttcttgatctctgtcctcttgtagctataaaactgcctaaatttataacctgactctttggacagtgaactctgttggctcggagaacaaatgtcagaacttagcaacctgaacagaagaatgcctgccttccattcacaaactttagtgtcagagcctttcagaatagcactgcagatgctaaaaagtttggaagaaaaaaatctcacattacatccaggagtgaaagtgttgtagtgtgtgtaggtgttcttaaagcagacaaattgctggattagtgttccctcaaagtctcccagagtctttagccccaggtagagcaaattgccgcagagctctcctgagatcacaaaggctaggggctgagatctgcactgtagtacagctgaaagaaataatttgcaacttgtctgttttcattaccatcaaactgcctgtggtactctcaatattacaagagcaaaccatgaagtcaggtctatttaaatgttaaatttgttatttccagggtttgtgtcttgttataatttctcttagtttctgattaacctaattgtgggataatagctatttggcagaactaaaacgtttatcttttctagtactctggagaggtaacaaactcatagcatacataggcttggcaattgtggctcaattgtggtaaggacagaacacttctcaacctaaccttctttattagtgctaacaaagatgtcagttatgccagggatttgctcaccagtaaacaaagccaatatagttaagcatattggttttattttttttactctctgtataataagatacttacactaaacctttaatttactaggaaagaaattttagaaactgggcatcccacggtattccttaggagctgctaattgtcccttcctacctccttgagtgggaatgagatgatagaggaaccaggaagaaagagataaaacatacatgcagcaaattcctgccagcaaacaagttttaattccaaaaagaatttagggtacctccatagtagaaagaaaataataaaagacagaacatttgcttcagcccaggagctaagcctgaaaaccagttactaaaaagacagggaaatcaaggaaaaattcagaagtattatgtagcaggcatgaatattaagtgcagaacctcaggtatgcaagaaatgtatttaattccatttaaattatactctaagtgcctatgctacaggactggtgggaaattttattaagccacaactggagcttactatctccaagaattatgacaaggaacctgaaggtacttaagcagcaccaaagcatcagggagacacagctggtcactggtctgcactggatacatctagagtattcttatagtaccattagatctcaagtctttgctcctttgggccatgctaggagcactaagatcaggtagaggctggaaacctcagagcagctagcctctttgggtgtatttcacagccatcccttctaaagtctgaccacttctccaacatactgcatgctaaacagcgaggaaggggccctgctgcttgttggactcatagaccagtaccttcttcccagccaaggagaaatgattcttccacagttacttccctaaagatctctcccctccttcacctcaccctgccctacatactcttttcaaagagtttcatttttacaaaacactgaaagcttgttaaatagttaaacagtatctgccttttgccatgaaaactaaagaatcatatgcattactataagttttcttcgacctacaaaattattaaataactcaaagacaatgaaaggtggcaataatccagaaggatgcactaaactggacaccagtgaccttttttgctcatttctaagtctcttaagttttgctaatagtgtctccaccaccccttatgatcaaagtaatcacatagatgataaccgatcacaaaaaaggctggtttcatgaggtttgcccagttatttagcaataagagtgttaattaaccatgtaagctccttgatttgttttgtaagtctagagccatgtagccttagaatatttaaaagtaattggctgggcacgttggctcatgcctataatcccagcactttgggagcccaaggtgggcagattgcttgaggccaggagttcaagaccagcctggccaacatggcaaaaccccacctctactaaaaataaaaaattagctgggcatagtgacacatgcctataatcccagcttcttgggaggctgaggcacaagagctgcttgaacctgggaggtggaggttgcagtgagccaagatggcgccactgcactcctgcatgggtgacagaggaagactctgtctcaaaaaaacaaaacaaaacaaaaaaaactaatcaatattccaaacatacacataaaaaaattttctttaatatttcatttatcctacatcattcttgttctgctaaatgttgagttagcagtctgctttcctgaagccatcagctttgatactacataaaagttagctaagctatatcacctcagaagcctgtactcaagaggttattgtttgatatctcaatagcaatgttaaagtgcctattactctccttttccctaatgctctaaatctgtctctgtttcgggcataaactattgactatagcttgtagcaaagccttcaggcaagcaccagagtaaaacagaaattctctgtggatgacaaatacttgagagctgtgcttaatttgcttccataaccaataatatcagaatagaagataagtgacattctcttttgagatacatatgtaagtatttcacagtagggttttttgttttgttttgttttgttttgaggtttttgttgtattttgttttttgagacaaagtctcactctgtcacccagggtagagtgcagtactgccgtcatagttgactgcagccttgaattcctgggctcaagcaatcctcttgcatcagcctcccaaagtgctgggattataggcgtgaaccaccatgccagcctagaagttttaatcagcgtttcctctgagggtaaaacagcaaaggcattgtcaaatttccaggaacttcccgtaaagcaaacaatttctgaaatatttctattaataacagtttacctataagaacctaacctagggcagactgagtatctcttctcagatatggcagctcctctcatgaaactttaaacaaatctaattattcccagcatttctttttatagatgaaaacaaacctgggattttctagaggccctctaggaaattttaaagatgagttttggtaagaaaagcacattttttcctaaattttggtctgatctttaaaaggcaaaaatcaaaaaagttattaaaaaagaatggggcacttgatgaagacctgagaaactacttggttacctaatttttcaaaacaataaaatatttgaaaatgaacatagaaggtaacatgactgtaaataaccttggctcaattcataaataaggaacctttgttcttcgcttttttatttctttaaataaagataaacagcacaaaaaggcaaattacacaaaaagaataacctttcttattgtaggacaggcgttaatcagtaccaaagaaagaagcacatcaaaactcagcaaactcactaaaattttaatatgtttctcagcttcacttcaaacacagttactagaaaccagggcaaatacaatctcatgaaagtttgtcctttattatgctcttttatattctggaacaaattgacactttagagcaaagaatagtcttcataaccgtaagggtccttgagaccttttaagaggacctgcaaggtcaacactattttcataataattttaagactttatttgcttttttttttttttttttttgagacagaggctcgctctgtcacccaggctggagtgcagtggtgccatctcggctcactgcaagctccgcctcccgggttcatgccattctcccacctcagcctcccgagtagctgggactacaggtgcctgccaccatgcccagctaattttttgtttttgtatttttagtagagacagggtttcaccatgttagccaggatggtctcgatctcctgacctcatgatccacccgcctcggcctcccaaagtgctgggattacaggcgtgagccaccgcgcccggccagtttgccttttttattccacttctctcattctctttccttttctcatgagtgtatgcttgagttcttccagcagctaaatgatgagtgatatctcatcagattgagtgaatcagatatgagaatctgacttctggtaacccagaagttaaagagattttcaaaattataaaacaacgcattgaaaataaattactgggctgggcgtgtggctcacgcctgtaatcccagcactctgggaggctgaggcgggtggatcacctgaggtcaggagttcaagatcagcctggccaacatggtgaaaccccgtctctactaaaaatacaaaaattagctgggcgtggtggcgggcgcctgtaatcccagctacctgggaggctgaggcaggagaaccacttgaatccaggaggcagaggttgcagtgaccccagatcatgccattgcactctagcctaggcaacaagagtgagactctgtctcaaaaaagaagaaaagaagttacttatgttaacatgaaatggctttattgttgttattttcaaatgaaccaaatgtttttttaatttcttagttttaatttctaatatagtaaatatccatagctatagctcacataaacaaaaactcttagggatccttaatgaattttaatttaagaatatgtgaaggggtcttgagaccaaaaattctgagaatcgggccttaagaaaaaaatattatttttccttgaaaaacaaaagaacacttatagttatacttctctgtcattattgttccttatataattgcaactacccatattaattatgatgtttaagaaaataactaatatctgtgtcatagagaaaactagggagcttggataattgagaaataatatgtaaccattttagcagactagcaaagctcataaacacaaagaacacaactttctactgcgggacacatcccttttacaccttagtgtagcaaagatgaatcaacacattcattaacatgacccaaaaatacagcctttccagcaaaatatattcaccttaagaagtacatagttactaactatatagttttaatttctatataattaataactatattctttttaaaaagctaataacttaaaatgatgcttaataataaatgctctaatactctatcttagaaattaggtatcttacgatgatttattaatcaattcagtttaatatcaactcaagattttaagtaaataaaaatcttaaattattttgaaactgacatactataaaacataataactattaacattgtaaggttggccgggcgcggtggctcacgcctgtaatcccagcactttgggaggccgaggcgggcggatcacgagatcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaaaaaaaaaaaaaacattgtaaggttttcagaataattatttgattttgttgatcacagttttatacttttttataatcttaaatattatataggaaaaatgtgagattatttgataaataagcctatagaagtttaggaaaaacccaagtgaaataaaatgtatacttgtgttatacttaagattgatgtaaataagagaaagaacatggctgaggtttttttattattgttatttaagtttggggtttgttttttttctttgtttatatgtatgttttgaggcagggtctcaatattttgctcaagttggtctctaacttctgggcttaagcaataatcctcctgcctcagcctcccaagtagctagcattataggtacacgtcatcatacctggcttttgggtttccttaataactggaattattaagttagtctcatttgctacagatttatcctaattatatgaactcacattctcaaaattataagtagaatattttcagtgtagcatatttaaaatattgtaagttaaaattatttattatctaggaattttagaaatattttatataagaacttactatctctctcagccagttagaacagggcatctttaagagacgatataatttatgaataccttacagaaataggaaggcaaacacttcacactcacaaaatgaggtaaatgtttttctgtattacagacacgtgaacacacagacagataagaaacacaatagcttcagttctacttacaacttgagctgtaagtcaagagtaaacacagaaccataaatattcatcagtccactcataaagagctattttctttcctagagggcacaaaaatcttaattgatttggcctcagaatggacaataagagaaataaacaagaaagactaataagccagattctctgtcttctcttaaccaaacaaaatagatttgtatcatccttttacagagatcaccaaatgattagaccataaaaccaaatccctaatcattcctgccacaaggggcaataccttattggccgtgtgcagaaacaaaaacagaaccaaaatgaatacggaggccaaaatagagaaaccaaaagttaccaaagttacagttttattgctgcttggaattcactccaggaaccaaggaaagatgtaccctttgtttgtttgtttttgtttttgtttttttgagacagtgtcttgctctgtctcccaggctggagcacagtggcatgatcttggttcactgcaacctccacctcccgggttcaagcaattcttatgcctcagccccacaagtagctgggatcacaggcgcatgccatcatgcctggctaatttttgtctttttagtagagatgctgtttcaccatgttggccaagctggtctcgaactcctggcctcgagtgatccgcctgcctcagcctcccagagtgctgggatttcagacttgagccaccatgcctggcctgtacccaggtttaagccactcataaagtgtacttctctgccaatgaagtttaactggctctgtccaatgaatcaatggagcatctcagtggagcctctggaattgttaaagtttaactttttatagataaaatcattaatcttgattttgtctcctttcttggcttactcactgtacctcgtttttgtaaataaatttagttgtttcataagtgttcatagtatgtataacttctatattctacctagaagtgatattaccacttcgtgtatagcataagaatcttacaatgatatacttctgtttttcccctctcaacatctgtgctacacttgccataaatgtcatatttacatatattattgaaccttcactatatcattatgatttttctttaaatgataaattacttttagcaaatgttatatgatatttaaaaatcttacatatttgcctatgtaaaaaaattatgaatctcataaatatataaaatgaacatgtttccaagactttatttaactcaacaacgagcaaataagatgctatgacctattcaaaggagaattcaaagaatatacccatttcagcattcttgactacccaggtaatcaggtaatcaagaatgctgaaataatttgctaatagatgcaaaactgatctatacccaccacagaataatcaattacatctccactgggcagaattcatttgcatttctttggaataaaattatgttcactggcggggcgcggtggctcacacctgtaatcccagcactttggtaggccgaggcgggcagatcacgaggtcaggagattgagaccatcctggccaacatggggaaaccccatctctactaaaaatacaaaaattggctgggtgtggtggtgcatgcctgtcatgccagctactcaggaggctgaggcagcagaatctcttaaaccagggagtcagaggttgcactgagccaagattgtgccactgcactccagcctggtgacagagcgagactccgtgtcaaaaaaaaaaaaggttcactgtcttagcttaggctgctatttaaaaaataccaaagtccaggtgcagtggctcacgcctgtaatcctagcactttcagaggccaaggcgggcagatccttaagccaggagttctaaaccagcccaggcaacatggcaaaatcccctctctacaaaaactataaaaattagctaggcatagtggtgcttgcctgtagtcccaactagtcaggaagctgaggtgagaggtcaaggctgcagtgagctgtgttcacaccactgcactccagcctaggcaacaaaatgagaccctgtctcaaaataacaaaaaataccataaaatgggtggcgtaaacatttatttctcataattctgaaggttgggaaatccaagatccaggtgacagcatggatgggttctggtgagggccctcttccaggctgcagatagctgacttcttttaccctcacatggcagaaagagagctagctaactctctggcctcttcttataatggcactaattctactcatgagaactccaccctcatcacctaattacttcccaaagcccccaccatcacattgggattggagtttcaacatatgaatttgggggtggggagggacatattcagtccattgcatttactctcagttttattcagtttcattgctgtaaaatagctgaaaaatacaaataaccagaaagtgggtgttgcactggacacccagtattcttttctgcccatttcaaagttttgcacaatttttctgaccactggtgtttctccttacctgagttgaagaagagacttattccttcatccattcatttttcttcttctcatatgactctggggttcagaatatcagacaaagatccttgctgcttcaataggtaaacaaaaatataagaacaatgatgattctcagcctttatcactatgtctggtacaagttttctgtctgtcacaggagcatgaagcacttcttcatgttcaaaaagaatgaaaagggctatttttaaaaacaattttttgcaagaaaaataaaacactttcattcatttagcaaatatataagcatctgctttccaaactctgcatcataaccttcaaggccctgcaactctggcttctgcctatctcttcaaactctgcttatacctctctcctactcattcactaccatccattgccttttcagttccatgcacgctttgccactttggaagctttcatttgtatgtcccttctctggaattctcttccctccacacttcacatgcttgaatccttcttatccttcaaggcttagctaatatatcactacctcttctagaatgacctttcctattccccacaccctcatcattttctatcccagcacctgcttatttccttcatcgcatgtaccacaaattataattattttatttgttggtttacttgtttttggctatttctctccagtaaaatgtaacaggatatctttgtgtcagggactatgtctttcttctgtaccatgaaatgcgtagcacatatggaattcctaatacataataggcactcagaaatgtttggtgcactaacaaatgaatgagtgaaaggtgtatgctattcattaaggattcattatatagatatagatatatatagatatatataaaagagaagtttcctgttctcaagaactttatagtttaacaaaggatacatatcagctatcaaagcagttgctctataacctaagtgcataatgttagaagcatttagtgctataggagcatataagaaagacctgaagatttctgcttctgctatgatagaatagcatatttggaccaattctcccaccaagaacatctataaaaactatgtaaaattttttaaagaaaagcaaaagcagatgtctgaagaaaataaccaagacagccaggattccgggcactaagatcccagagaaaaagtgaaccacagagaagtaaaactggaattcttcaccatatttttcctcaaagcatttactaattcctaagccaggagtgaggtggggtgagagctattaatactacaggaggcaaagaagccaagcataaaaaagagtagctaagaagctaatgaaataagcagaattttcatgagtcttatgagttcaggacctgttatagaggaggggccctggtaaatatctcaggctttcagcttgaagggctatgctttaggaataaagacaatctgcagataaactagccttcacacggactgaaattcagcatcaaactatctcaatccctgattagatcaagataatctgagttttccttaactgccagaagacctcaaattctttttggaggaatatatcattgtccaaagccttttcaattttttcatacctgatatttgggcttcaatctgaaaagttgccagacatgctagagatagagcaaaatgactaaaaattaagataggaaacaattgataaagtagacctaaaaatgatgctgatacttatattgtctcacatggactttaataaccattatatgtttaagaaaaagggatgacaaagtgggaaatttcactagaaaactggtatctattcataagaatcaaattgaaattttggaaaagggatagaaaatatagaaatgagcataaaagacaaatgggatgtggtgaaaggtcaaacatatatgtagatgaagtctaagaaggagaggggagacagagtgagcaaaacgatatttaaaatattggcggatagttttccaaaatcaataaaagacatcaagccagaaattctaggagctctactaatctcgagccggataaataaaagaaaccatacctaggtaatcagcaaaactactgaaaactaaagacggagaaaattttaccagaaggacacattgccttcaaaggagcaacaataaaactaacaaatgatttaaatggaaatgatggaacccagaaaacaatggactgggatttgtaaaatgcaggaaaaaaatactgccagtagggaactctatagtcatcaaaaatgtacttcaaaaatgaaggtggagtaaagacaatttcagccaaacaaaaactgtgcggacctagactaaatagagtttttaaggtggaaggattatggaagcatggaaatgcagaaaggactaaagagggttaacatgtcagcaaatgtaaatgagtgttgatcatgtaaaataataatgtcttgtgaggcttaaaatatgaatactatatagtgaatatataaatatcaagtatatattgtcaacatagtatatgtagaaaatatatacaataaataaaatacatatacttaaaatataaacatatacatgcacatacgtatatgcttaaaatgcatgtaaaatatatacacacaatagcatgaaaggtagaaaggcataaattgagttgatatgttttaaggttcttgtattgtctgggaagtgatttttaaaaacccagttatgagtagactgtaataagtcaaggatgcatattgtaaatctctaaaataattactaacataataatataagaatatgtaactaacaagctaatagaggggaaagaatattaaataaaaaatatttcatgaatcctaagggaggtatagaagaaggaaaaaggaaatcaaagcagaagtgacaaatggtacagtgatagttttaaacccaaatatagcagtaatcatactacatgtaggccaggtgcggtggctcatgcctataatcccagcactttaggaggctgaggtggactgatcatgtggggccaggagttcgagaccagcctaaccaacgtaatgaaacctcgtctctatacaaaaattagctgggtgtggtggcatgtgcctgtagtcccagctactcaggaggctgagacatgcaatcgtttgaacccaggagacagaggttgccaacgtgagccgagatcgcgccactgcactccagcctgggtgacaagtgagactctgtctcaaaaaaaaaaaaaaagaaaaattatactaaatgtaaatagactgaatccttcagttaaaaattgtcattctggatttttaaaaaaacagctaatcatatgctgcttataagagacacatcttaaatattataaagacatagaaaactgaaagtaaaagatttgaaaaagttacaatgaaatatagctggtgtagctatattgataacagagaaaattctttttcttttcttataatacatttttatgtagagcaaatagagaaaattaaggtaaaaaggattactagatattaggagggacattttattattttaaattagttaattcatcaggaatatgtaagtaacatttgcaaatttactatatctaataatataacctcaaaatgaaaaatacgtgaattaattaattaataatcaacatttcatctagtcccccagtctttggagttcagaggaggctgagaagatgactgagactaagataaaggtgggatagacagtggggtagaaagagtattcaaggcagaaaaaagattttcaaagactggaggcaatagcttaagaaactggccagatgcggttgttcacacctgtaattccaacactttgggaggccagggtgggtggatcgcttgaggccaggagttcaagaccagcctggccaacatggtgaaacgctctctctcctaaaaatacaaaaattcgccgggcatggtggcatgcacctgtaatcccacccagctacttgggaggctgagggacaagaattgcctgaacccaggaggcgaaggtcgcagtgagccgagatcatgccactgcactccagcctgggtgacagagagagaccccgtctcaagaagaagagagaaagagaaaaagagagagagagtggcggcgggggtggggcaggggagaaggaaggaaggaaggagtcttgctagaatgtagacggagagaaagattgataggaatgtggctgggtgagatggatgagaacaatgattgggggggctagaaaatataggaatatttgatatttaaaagatgatatggcctggtgcagtggttcacgcctgtaatcccagcactttgggaggccgagacgggtggatcacctgaggtcaggagtttgacacaagcctggccaacctggtgaaacagtgtctctactaaaaatagaaaaattagctgggcgtagtggtgcatgcctgtaatcccagctactcgggaggctgaggcaggagaattgcttgaacccaggaggaggaggatgcagtgagccaagatcgcaccgttggactccagcctggaggacgagagcaaaactccatctcaaaaaaaaaaaaaaaaaaagatactttttcctaaaaaccagcaacttattaaagtattatatagtcacttgatcaaatttatctcagaggatctctgttactactgtggggagaatgaattggaggagggtggcactattggcaaggagacctatttcagcaatcccggtgagatgatgttggctgaggctgtagagatagaagggaacacatttttacaaataaaagtacctaatagtttgtgaaatatttaaaatgtagacaggttactggactcatttttagattagtaaaccaaaaaatttagtaatagacctaggtttttattatttaagagaaatgttaaggagtgcaatttttttctttctgtctacaacaccagctgcagagctgtgttatatttcatttccaaagatcagattttgtaatatcactgtgggttggtcatagccacaggttagttttgtttttaatactagaatataaagttggagtagttaaaactcccttgactttctgttttagagttcctttcctgtttttcattttagttgagctatttagatttgacaaatctaagtaatctgtgggcatatgttcaagtctctcttcaaggaatgtatatggctttaagatcattaagcagaatggtgtaggatacatacatgtaggtttcttgcccgggtacaacttaagacatatttgttaacatccttcttcagacataaaattctatcttagaagagaaacaataacgcaccagctaatgatattatacattaatgtagttgttttgtttttatctaacttctcctactagaatgtactttctgtgaggacagggatgttgtctcttttgttcaaggctgtatccccctacacatagactggtactcatcatataccaagtgttaagtaactatttattgaatgaataaatggataaatgaagaatgaaggaatatttgtgttaagcaaatcaactccattaaaataagaaagatgtttcttttcatttcaatcttattaatttaatgttcatttaaagtgttgaaagtctaatattaaaatgtttgaaagtaaagtgattatttttaatgtttgcaggactatctcaagcaggtgctggacattgatcttcatgctcagatccattttggcagggtttttatgaaaccagggtatgaaaatcatcttgttatctcatatatggggttggtttggcttgctttaactaacaaatttttaaatgccttctttttacatttcctattatgaattaactattccaaaaaaaaagaaatatagtattaggatcctttgcacaagtgcaggttctaatgaaataggaattcatcttccttatgagtcaatgagtttggtataaacaaaacacagcaactttccaaactttttctcctttttaattctcatccctagttccttcttcctctttttctctttttccccaaactgcttctttatctgtttttaaaaataattaatatgagaactctgaaatatacacaaaagtagggaacgaacccccaccccaccctgccttttagttgggagggagggctggtttgtttaaaagcaaattctagatatgtcattttggtatacatctgaaataataatactaacaacagcattctcttacctaatcacagtagtattatgtcatctaacaaaataaataatactttaatatcatctaataccctgatcatattcaaatttctcccatatatcaagaaaaagaatgcctttttataattgttttgtttgataaggattccattaaggtcgactcagtgtatttgtttgttaagtctctattaaatgagaacattttctgcccccaccctttttgttgttgttgtgccattgacttgctagagaaaatggatcatgtttcctgatgaatggatttggctgattacttccttaggttatgttcctctgtctctgatatatgctataaattgaaagatataaaggcttgattaaattcaggtttaattttttttttcctttgcaagaatgtttcattaagtaggctttcacactgtttcctactggcccctaggaggaaagaaaaataactaaggaaaataaccatgaatttgcacatctcttaaaaattaataatccctaaagaagggctgatggaggtcctgaagtcagttataaatcctcaaaggttgccaaacgttggtattagtgaaagatatggccatatctttaagaaatagtctatctgtttagacctttgctactctatgaacctatgatttcctgtgcagagacctcaactgtatggctgagagttccagcccacctccatgctgtcagggacaacagtaatgatgctttactgtcaatgaaccctaggagagaatggagtagaggcttctcagttgttgtaagtgagctatgggtaccatcaacaaatttcaaaagcctttaaagtatcaagctagccctcctaataagtacctcatgtcagttctaggatagagatcaggctttacctccacgatttggccatttttagtatagaattaagattattcctaaagctttgtccacaatttgatagaattcttggctttgtatttctgtagttgcatgttgagcatgccccaatatggctgctgctgatagggcctttttattatcgaaactgttgaattggggctgggcatggtggctcacgcctataatccccaacactttgggatgctgaagcaggcaggttgctttgaactcaggagttccagactatcctgagcaacatcgagaaaccccatctctataaaaaatacaaaaattagccgggcgttggtggcttgtgcctctagtcccagctacacgggaggctgaggctgaagaatcgcttgagctgggaagcagaggttacagtgagccgagatcatgccactgcagtccagcctgggtaacagagtgagaccttgtctcaaaaaagaaaaaaagaaaagaaaagaaagaaactattggattttgtcttacgcaaatattgttatgctattgggtataactgcttttttttttttctgagcccatgggcagtactaatctgattaggatacagaggatatcccaaaagcatatcagtgtgcttctcaaaacctcaaaaattgaattgggccgagtgcagtggctcacacctataatcccagcattttgggaggccgtgggggtggttcgcttgagcccggaagttggagaccaacctgggcaacatggcaaaaccccgtctctacaaaaaatacaaaaattagtcaggtgtggtggcacatgcctgtagtcccagctacttgggaggctaaggcgagaggatcacttgaggcggaggtggcagtgagccatgatagcaccactgcactccagcctgggcagcagagtaagaccctgcctcaaaaaaaaaaattaattgattgttctatttgcagagggaaagaagccaacacgacttgcccttacctctagagaagagttatttgtgtaatatctatcatttaaaatattctcagtgcctgtgataacttttatactctttttttcaatctgttatttaccactcacttcaactttagcagttcatcaattcctaacattttatttcctcccttaaaatcataacactctgacttcagccattgtgtaaatgctgttatagtctgagctcaagaggagaactgaataataggttttgagttccaaggaaatggcttccagagcttaaaaaaaaattcacagtttagcaataggacatttatgatagccatgcataataacaaaatatttttttgcaatggaatccttttttaaatgagtaactttacagaaattacattacctacctgcaagatgcaaaagattgcttaaattggccctataatttcaatgggctttaaatgcagtggaaggaagaaggtgttatacattctctcctcattcttattatctgtaggtttgctaaaataaagtagttttgaagtttaaatgggcttcttttagttcaccagaattttatgcttgtctaaaggtaataagaacttaaaggtaattgctacttaatattagaacaaaagaaatataaaacacacaaatacaatctggctttgctatttccacgtaacagtgctttcagaatgcaattaagctctttcattttagagacaaagatactcagaaaagcatttggagtatcagcaaccagatctaccaatcacggtttttattgcgtcatctacagtgagcatagctgttattaagaacaaatctttgaaattatttgcatcacacactaataatcattgccaaataacctatccataaatcagtatcaaaatcgaatctcatttttctaaaacagcaaagaatcaggaagtatgctaaagaaaagcctcagagtagccaaaatagatgtccaaagatcatgtactaacgctacataaccatcctgtgagatctttatccacatatcagctaaagttagaacaaccttggttcaaatctgtgttcctccacttagtagctgagtgacttggaccacattgcttaatctctctgaatctcagtttccatataaactgggattctaattgttaccttataagcttgttgtaagacttaaatgaaataattaatgtgatacatagatgttacttaaaaaatagatattttagccaggcccagtggcccacacctgtaatcccagtactttgggaggctgagacaggaggatcgcttgagctcaggagttcaagaccagcctgggcacatagcgagacctcatctctattaaaaataaaaaaaattaggtgggcatggtggtgcatgcctgtagtcctacctacctggaaagctgaggctggaggattgcttgagcccaggagatggagactgcagtgagccatgattgagccactgcactccagcatgggtgacagatcaagaccttgtctcaaaaaataaataaataaataaaaatagatatttttattattactgttattatgttcattctaacaatataactattgctactattctctggttctcaaacctaaaaccagctttaatggtcaagatgatagcaatctcgcattacagggtgccacaggaaaaaaaaaattgggaaggaataaaaaaacagaaacaagaactatagaaacatagcaatgtggggttatggtttatgggtgaaaacaacccatagtactcttgtgacctaacatcactgtattacagcagagtagtacacattaataatgatggctataaatcatcaaaagaagtcagtgtcactgtattattgcaaaaggtaaagagtgagagatctatttttgaaagatcaacctccaaaaagagtaaaaataaaacaatgtgagtgcttaaaaggttaatatttcatctgtatgaaaaaagtatgccctaagaattctgcattgcttaaggttcattaatataatgagatttattagctaaaattctatataaagggtaattaatagaaaaaaaaaacactattctcaactgcccactctatgccactcactccttccaccccacctcctatgataagagttcatgtcaaaatcttgaggaagtgtaatttgagaatatttttaaattactattaattgtggctgggtgcggtggcttacacctgtaatcccagcactttgggaggccgaggcaggcggatcacctgaggtcgggagttcaagaccagcctgaccaacatggagaaaccctgtctccactaaaaaaacaaaattagccgggcgtggtggcacgtgcctgtaatcccagctactcgggaggctgaggcaggagaatcacttgaacccgggaggcgggggttgccgtgagctgagatcacacccttgcacgctagcctgggcgacaaagagcaaaactccatctccaaaaaaaaaaaaaaaaaaaaaaactgttaattttgttctagtcatgatattttatttattttgatatttcaaaaataatgtcttgataagagggaagtgtttatgtctatgctaaggatagttttaaaaggctaatacagaaggagcaggattgaaagaaaaaggttaaaaaatactcattttgaacaataggcaactgtctgatagacatattatcaggtaatctgctttctttttttttgagatggagtcttgctctgtcgcccaggctggcgtgcagtggccatctcagctcactgcaacctctgcctcccaggttcaagcgattctcctgcctcagcctcccgagtagctgggattacaggcgcacaccaccatgcctggcaaatttttgtatttttagtagagacagggtttcaccatgttggccaggctggtctcaaactcctgacctcaagtgatccacccccctcagcctcccaaagtgttgggattacaggtgtgagccaccatgcctggccagtcttctgcttttaagaatgattgttgtaaatcgccagcaaaagtagtataaacattattaactagaggggtgggaaaacttggaaactccaagatttggagtacatttctatggcactggcaagaaaaaaaaaaaaagtaagtagttttctttaaaccagaaagtgtggttacttgaaaacaggaaatactaaaaacaaacttatttaagtgtctgtggaatacttcagagtataaagatgtaaaggcaagtcaacagaaaagtgttttttatatgataagtgtatggattacaaaaacactggagtacttaatgtattcatcatattgcttagcaatcactaacaagtgactctttttttcttctagcttgccaacaacatttgcaactttggatattgatggtgtaagaaaaataatctttgcactacctggtaagaataacaaattgtttcctttcctttttctggaaaaatagccaaaattttttggacttctcatgtgaccacctggtttgaaatctgaaagacctgggctcaagtctcagcttttctaaacgaccaatcacttaacctctctaggaagtttcttcacctataaaataagactaatatctacttcatagggttggtgtgaaagtcagattagataatatatatcaaagcacattccaaatcctatcaaagcacattccaaatcctaagatgatcatcaagtgttagctgtcactagatctttctggagcacctgctttttccttacaggaaattggtcgaagttagcagccgaatacctctcataaccagaagtattgtgctctagaggccaaaatgccttgagtcacccaagcaaataccaaatcaaaaaatacaaagctgcctctggtccttgccagatttgggctggttgaggggagggggaagaggaaaggccaggctactggaactagtgcttctcagccaaatcctactcatcatcagtctacaacttccccactcccacccttgtcccaacgtgagcagaaactcacatgttcagattatagaaagagcaaagcaggttcagttcacgatgattttcaaattcaaattttttgtgatttggggttatataaagtcatggtgaatcttgataaattttaaaataatttattgtgcatcttttttttaactttaaaattatcttctgatcattctgttcagttctctattttttggcacagattcctttagaaaataacctatttctttaagatttacaaatctcatggcttttggatctttgtttgttttttaggtcaagtatatctcaaaatggaaatgtaaagaaatggaagcaggcagaaaaatgttaaactttgaaaacattttaagcccctatctataagcataaaagagattagatttctatcatgtagaaaattttcagagagagaacatttaagtaaaatagtcctcagaatgtatctgtaacatgaaacgccttaggacctttcataattccttggatgctctgatagccattgtataaagaaatgtgctccttttcctagcttcatttagcctggaagagcctcttttgtctacggaagatatgacttaacctacagaccatcagtgatattataacaaagaatgttactgtgggagcctatttcaccattatgccaaagatgttataaaattaaaacctgttttcaaattcctacttttaatttgaaaccttatctgctcagcctgagtgaaccaacagagggcagcagaaactcacatgttcagattgtagaatgtgcaaagtggttccatttacaaggattttctttcttgtttttgttgttattggttttgtttgttttttgtgttttgtgttttttgtttgtttgtttgtttgtttttgagacaaggtctggctctgtcgcccaggctggagtgcagcagcgcgatctcagctcactgcaacctctgcctcctaggctcaagccgttctcccacctcagcctcccaggtagctgggactataggcgcttgctaccacccctggctaatttttgtattttttgtagagacggggtttcaccatgttgcccgggctggtctcaacttctgagctcaagccatccacctgtctcagcgtcccaaagttttgggattacaggcatgagccaccatgcgcagctttacaaggattttcaatttcaaaagtgtatttctgctttcctgtaggccatgcgtttaaagccatccctaatctcgacaagttttaaatcaaagttttgtatatttacttgtttttttggacatttttaacattgctagagtgacacatgctcactattgtaaaaatcagaaaatatagataagcataaaaaagtgttaaccataatcccccaacacccacatatggataaaccactattacaagttttttatatcagtccttccagtcctttttcgtacatagcaagaccctgcctctaaaataattagagcacttcattttttatacagtaatgttataaagtggtagtattacatggattttataatccttgatttacaatggcttttttatttgttggtttggggtttttttgcttttccagaaaaaaatattctatctacttgtattttgaagcaagggaaagtaattgattctttttaagagtctgctattctgtgggcaactcatttttccatcgaaactattagtatcacttgtcactttttgcaccttaaaaaatctattcttaagcacttttgcaggtagaagagaattggaggtatgattatagctaataataggctaaactgaccattgccttttgacttgatgatgcaataagcagtgtttagccatgccaagggaacctaaaaatctagtagcccattccccactccaggttatacattcatgcttacatagaactgtataaaagtattaaaacaactgaaattttagaaccagaagagatcttgagaatcatgtagtccaaacctttcatttcatagatgagtaaagttagactcaaaaaactttggaacttgccaagatcagacagcttggttagataataatgccacacaagaaatcaaatctgttatttacagcccagtggttgtttgcttcttcacagcccacccttcctcctttgaagtgtacgacacacctagatttcttcttggagtgatatagtggaattcctcaaattcttctcataactttaaaagaatgtggtatttgtattagtctgctcaggctgccatgacagaataccatagactgggtagctgaaacaacagaaatgtattttcttacagttctggaagctggaagtccaaaatcaaggtgccagcaaggttggcttctggtgaggcctctctccctggcttgtagacagcaaccttttcactgtgtcttcacatgatctttcctgtatgtgtgcagactcctggtgtctcttcctctttttataagggcaccagtcctattggattacggccacatctttatgaccttatttaccttaattacctccttaaaggccctatctccaaatatagtcaatcatattggagttatagctttatcatatgaattcaatccataacagtattcatcttcaggtccttaaaacacttcttaaatcatttggtgtttttttttaatttaaagaaatatccaggtagagaagattataaataagtttccttatgcttatctatgttttctcagtttgggaaccaagcttgtaatactatagtaatttttaaatgcttaaaaaatagcaaatagatatataaaacttgtaaacggctttaaaacaagattagtaatgagtaatcttgataataagattagtaatggctttcagctggctctcaggaaagcggaaataaatggcgttaaacagcttctgggcagcagaattctccattttactgaaagacgcaaatgtttacaccccctgtggcatttagttgactatacctctgttctggttggattcaaggtgattcagaagaggaaaaatagtgcctagtcacttccgtcacattctgatacccaaagatatagacagacataattatttggcaaattgttacacagtgtattataaataactgcttggttgactttcagggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctattagttttgatggaaaatgtgattatattctccccctgtgtactagaaaatgtaggagaaagggtccctttaattctcctacttcatgacttctaaagtgaatcattttctccagatagaagtccatatacgagtccagagagcacggcttaaaaacttgagtgatacttaaggacaaaacagtcaataggatatatctggctctaccctaacactagacctgtctggaacaagggagaattttcttttccccatgcaaactcagagggacagcaattaacctgctcactttttctgtgacttcaacgataaattttaaacaattcagaagaagacaaaggactacaaagagaccctggtgattcagggaaagggtaaccatattgtttagaagagaactgctaaggctgagaaatataccatggtaaaagtcacctggaaattaggtctccttctccaccaacactaacttcaatgtgatttactactactcaactaattatgttatacactttctctgtgactaatgaataatgttcttagcagtataaactacagtaccaaaccattactttccaagtgttccgaagtaaattcaaatatggcagaatgctatgattagttgacaggaagagcaaaaaacataaaagataaaatattaggccaggctcaatggctggcgcctgtaatgccagcacttcgggaggccgaggcaggtggatcacctgaggtcaggagttcaagaccagcctggccaacgtggtgaaaccctgtctctactaaaaatagaaaaaattagctgggcgtggtagtgggtgcctgtaatcccggctattcaggaggctgaggcaggagaatcgcttgaacccgggaggcggaggttgcagtgagccgagattatgccattgcacttcagcctgggaaacaagagcaaaacttcatctcaaaataaaaataaaaagataaaatattttaaaaaattacactgagaatacataggataaaaacattaaaaaaatctaggctttcaatagtcttaacattgactgtttaaatgctaagaactttgtggactaggatatgaaacaatctccttttcttaaaatttcatgaaaaatttaactagagtttttttcattaatcacagtggtaatcaaatttgaaattaagtggaaaaagaaataaaaaccatccatgaacaaaaagtattctgatcaagtcagaagtcagagtcataaagcttagatttagacagtcaaaccaatagtactgaatttactatcttcatatttactaaattaaggaaataaaaattcacattattataagagagagagaaagaaggcttccctttgactttgcagatctcttatgaattctttcacttatttctcattgtaacatccaccatctcttctttaaaacagacatagcagccatctattctgacaacaaagatgagatggtactttgtaatcagactgatgcttgatatgttgttcctgatggtgtccatttcctgtcagcaaaggatgttaagaagtggtcaaaaaatcagtcaaatgcctttctcccacagcagtgtcactgggactgccagtatgggtcatcagtatgcttggctatttgtttcttttgtttcttagctttccaaatcatccccacatcagtactgacacaactgccactttaaagcataaacatatacttccttgaaacgtgataagtcttatctctcctttctgaccataaaagatgcagcttacacacaccacttattactgttcttcagaatagatgccacagtcattgcctttaccaatgcttgctgctttcaggaagtgggagtcagtgttaaatgctgctgttggtaaatcatactgttggactctgatgtggccattctgtgtgtcagtgcagaaaatgtcatccttgctaggcacagtggcactcgcctgtaatccctgctcctcaggaggctcaggcaggaggattgcatgaggccaagtgtttgagaccagcctgggcaacatagcaacaccctgcctctaaaaaaattaacaaaaagaaaatgtaaaaaaaaaatgaaaataaaatgtcatcctttcatatcaaagcattcagaagagcatcattttagaacaaacatttcccttatttccttggtcacttatggttggaggtgaaaatcttctcattttcagtacacaataagaaacacttccaaagcatctggtaaagaaaaaaaaaaagaaaaagaaaaagaaaggaacacaatcctagcaattcatcaaatagaattattgaccccgtgtttccatgcaaggaccttctatcatgtgtttccttaatatcccattaaagcactctaccacccttgttctcagcttttttcgctagaaacatacctggagtaactcccattagtattaacaacttatctcaagcagtgattaagagacagaaaagggggaaagcatgttctagaggatagccaactataagtccctcatgcccatccccccctcacaaacacagccagaacaatgaataaataactgcattttaatgaaaaaaaactgaagaagagcagcagagtgtatccgtggagtaacagaaaccctggtgagcacagaaactcaggatggtcacatcgagaacagaaggaaacaccaggcctccaccatcgcatcccccagctggatcagctgggaaccaggaagaactcccttggcaaggaattaagcagaggatcccagcaacccccatcaacactttggacacctacagacctcacaatgggaaaccctgcagccctcacaagcatgaagcccagctgaaggaactgcctggagtccacagagctatgctccccccagtaaaggagtcaacgctatgctccaacctctgtggcctgtgcaactactgcactacaccatgttggaattggaactatggctagagtttttcttgctctgggagcaagtagtcacagcaccccttcatccccaatgctaccccaacactgtggcctaacatccacaggctgagatgcaagcagctgttacaactttcccagtggagccaaatagaggtggagctactccacccagcccgccgcccgccgcatccccctcagccagagctaaagccatatacggcctcctaggaaaacagtatcttggctgctcagagcagtcatgcatccctaagttcagtcatgtactagcctaagttgagccagcacccagcatcccaggaaatgatgcttttgctgcccaaagtaatcatgcactctagtacctaagctaaagcagcaccctctatcccagagaaaaagtgccagagccacccagaacagccatgtccccagggcctgagctgaagcagcacatagtccctaggtgccctggctgaactgagcagctgggcatccagaactatgccgatgtagtacccacaacccagggaaacagagcagtggctgagctgagacacctcatcctacaggtcaaacaacttcctactctcctttcctgaagctagactacccccctagtgtctgagcagctgagaaacacctcttcctaggaagtgcagtcattgctatgctatttattgcccccaccccagggcccaaatgacagcagtgctccaccagtctggattacttattgctgctgcacctggctgcacaaagtctgggattctaccaagccccaccagcacagggtctgcagtcactactacatgctgcctcatcccctgggacctaggttgccactaagccctattgactcaggttcctagatagcaacaatagcctactccccagccccaaacgtccaggggcaacccttcttctctggagtcaggccagagctgtgccctgcccgccaggggcagaatcatagctacaactcagccacctgaacccaagctgctaaggggtacccaaagtcacagaccctggctctgtggacaacctacactcaaaactaccacaggaaaaaaacaagcaccccaagacccaggtgccacaatgggttcacaagacccttagcctaggaccctggccccacatccactctaagcacctgtaccaggaacccggtgctgcagtaggccttcttgaaggccatgtcagatttgacacaaagagggatctccctaggctatatcttcccattgtggagaaaataagaataaggaagacactaaaagcccttaacactgaatattagcaaactatgccaccaccaccaccacttccacaaacttctgtggactacgtaactgaggcacccacagttactgctcgccctgaaagcacctgaagatgctgcatggaaactataccactatacctattgaaaaagtcaccacacccttcccagctggcacactaaaacccaactgcaaatgaaagactttttctatggaaaccagaaagattggaagaaagaatagttctaccaggtgcacagattcatgcaggcttacaagaaacacaaaaaagcaagcaaatataacaccgccaaaggaacataatgggtctctagtaacagacccaaatgaaaagaaaatcaatgacctgctggaaaataaatgcaaagtaattatctgaaggaaattcaatgagatataataaaaaatatatacagacaagtcaacagaatcaggaaaacaatttatgatataaatgagaaattcagcagagttaggaatcataaaaaaaaacagaaatcctacagttgaagaattcaataaatgaaataaaaatgcaatagagagcttcaataacagactttgtcaggccgaagactttctgaacttgaagataggtcatttgaaattacccactctgaaggggaaaaaaagaaataacaatgaaaaagaatgaagaaggcctgtaagacttacgagccatcattaagtcaacaaatttttttattatactttaacttctggggtacatgtgcacaacgtgcaggtttgttacataggtatacatgtgccatgttggtttcctgcacccatcaactcgtcatttacattgggtatttttcctaatgctattcctcccccagccccccaccccacaaccccccgacaggccccagtgtgtgatgttcccctccctgtgtccgtgtgttctcattgttcaactcccacttatgagtgagaacacacggtgtttggttttctgtccttgtgctagtttgctgagaatgatggtttccagcttaatccatgtccatgcaaaggacatgaactcatccatttttatggctgcatagtattccatggtgtatatgtgccacattttctttatccagtctattattgatggacatttgggttggttccaagtctttgctgctgtgaatagtgtcgcgataaacatacatgtgcatgtgtctttatagtagaataatctataatcctttgggtatatacccagtaatgggatggctgggtcaaatggtatttctagttctagatccttgaggaatctccacactgtcttccacaatggttgaactaatttacactcccaccaacagtgtaaaagtgttcctatttctccacatcctctccagcatctgttgtttcctgactttttatgatcaccattctaactgccatgaggtgatatctcattgtggttttgatttgcacttctctaatgaccagtcatggtgagcattttttcatatgtctattggctgtaataaataccttcttttgagaagtgtctgttcatatcctttgcccactttttgatggggttgtttttttcttggaaatttgtttaagttctttgtagattctggatattagccctttgtcagatgggtagattgtaaaaaattttttccattctgtaggttgcttgttcactctgatggtagtttcttttgctgtgtagaagctctttagtttaattagatcccatttgtcaattttgacttttgttgccattgcttttggtgttttagtcatgaagtccttgcccatgcctatgtcctgaatggtattgtctaggttttcttctagggtttttctggttttaggtctaacatgtaagtctttaatccatcttgaattaatttttgtataaggtgtaaggaagggatccagtttcagctttctacttatggctagccagttttcccagcaccatttaataaatagggaatcctttccctgttgcttgtttttgtcaggtttgtcaaagatcagatggttgtagatgtgtggtattatttctgaggcctctgttttgttccattggtctatatatctgttttggtaccagtatcatgctgttttggttactatagcattgtagtatagtttgcagtcaggtagcgtgatgcctccagctttgttgtttttgcttaggattgtcttggcactgagggctcttttttggttccatatgaactttaaagtagttttttccaattttgtgaagaaagtcagtggtagctttatggggatagcattgagtctataaattactttgggcagtatggccattttcatgatattgattcttcctatccatgagcatggaatgttcttccatttgtttgtgttctcttttatttggttgagcagtggtttatagttctctttgaagaggtccttcacatcccttgtaagttggattcctaggtattttattctatttgtatcaattgtgaatgggagttcactcgtgatttggctctctgtttgtgtgttattggtgtatacgaatgcttgtgatttttgcacattgattttgtatcctgagactgctgaagttgcttatcagcttaaggaggttttgggctgagacagtggggttttctaaatatacaatcatgtcatcttcaaacagagacaatttgacttcctcttttcctatttgaataccctttattgctttctcttgcctgattgccctggccagaacttccaatactatgttgaataggaatggtgagagagggcatccttgtcttgcaccggttttcaaagggaatgcttccagtttttgcccactcagtatgatattggctgtgggtttgtcataaatagctcctattattttgagatacattccatcaatacctagtttattgagagtttttagcatgaagggctgttgagttttgtcgaaggccttttctgcatgtattgagataatcatgtggtttttgtcgttggttctgtttatgtgatggattacgtctattgatttgcatatgttgaaccagccttgcatcccagggatgaagcccacttgatcgtggtggataagcttttagatgtgctgctggattcggcttgccagtattttattgaggatttttgcatcaatgttcatcaggatattggcctaaaattctctttttttgttgtgtctctgccaggctttggtatcaggatgatgctggcctcataaaatgagttagggaggattacctctttttctgttccttggaatagtttcagaaggaatggtaccagctcctctttgtacttctcatagaattcggctgtgagtccttctggtcctggactttttttggttggtaggctattaattattgccccaatttcaaagtctgttactggtctattcagagattcgacttcttcctggtttagtcttgggagggtgtatgtgtccaggaatttatccatttcttctacattttctagtttatttgcatagaggtatttatagtattctctgatggtagtttgtatttctgtgggatcagtggtgatatcccctttatcattttttattgcatctgtttgattcttctctcttttcttctttgttagtcttgctaagagtctatctattttgttgaccttttcaaaaaaccagctcctggattcactgatttttttgaagggttttttgtgtctctatctccatcagttctgctctgatcttagttatttcttgccttcttctagcttttgaatttatttcctcttactcctctagttctttaaactgtgatgttaggatgtcgattttagatctttcctgctttttcttgtgggcatttagtgctataaatttccctctacacattgctttaaacgtgtcccaaagattctggtatgtcgtgtctttgttctcattggtttcaaagaacatctttatttctgccttcatttcattatttacccagtagtcattcaggagcaggttgttcagtttccatgtagttgtgtggttttgagtaagtttcttaatcctgagttctaatttgattgcactgtgatctgagagacagtttgttgtgatttctgttcttttgcatttgctgaggagtgttttacttccaattatgtggtcaattttagaatcagtgcgatgtgttgctgagaagaatgtacattctgttgatttggggtggagagttctgtagatgtctattaggtctgcttggtccaaagctgagttcaagtcctggatatccttgttacttttctgtcttgttgatctgtctaatattgacagtggggtgttaaagtctcccattattattgtgtgggagtctaagtctctttgtaggtctctaagagcttgctttatgaatctgggggctcctgtattgggtgcatatatatttaggatagttagctcttcttgttgaattgatccctttaccattaagtaatggccttctttgtctcttttgatccttgttggttatcagagactaggattgcaacccctgctgttttttgctttccatttgcttgttagatcttcctccaaatgtttattttgagcctatttgtgtctttgcatgtgagatgggtctcctgaatacagcacaccgatgggtcttgactgtccaatttgccagtctgtatcttttaattggggcatttagcccatttatatttaaggttaatattgttatgtgtgaatttgatcctgtcattatgatgctagctggttattttgcccattagttgatgcagtttcctcatagcatcaatgatctttacaatttggcatatttttgcagtggcaggtaccaattattcctttccatgtttagtgcttccttcaggagttcttgtaaggcaggcctggtgatgacaaggctcccagcatttgcttgtctgtaaaggattttatttctccttcatttatgaagcttagtttggctggatatgaaattctgggttgaaaattcttttctttaagaatgttgattattggcccccactgtctcctggcttgtagggtttctgctgagagatccactgttattttgatgggcttccctttgtgggtaatccgacctttctctctggctgcctttaacattttttcctccatttcaaccttggtgaatctgacgattatgtgccttggggttgctcttctggaggaatatccttgtggtgttctctgtatttcctgaatttgaatcaacaaatatttttatcatcagagtccagaagaagaagagaagggaaagaggataggaaatttatttaatgaaatactagctgaaaaacttcccaaatctgttgagagatatagacatccagatccaggaagttcaaaggtctccaaatgtattcaacccaaaagatccttcccaatttgtcaaaagttaaagacaaagaattataataacagcaaaagaaaagcatcaagtcacatacaaggaagtccacattagactagcagtagatttatctgcagaaaccttaaggccagaagggaagggaatgatgtatgtaaagtgctgaaagaaaaaaaaaatgccaaccagaaatactatatgcagcaaagctatccttcaggaatgagggagaaataaagcctttcccagacagacaaaagctgaactccagcttcttagccttcttttctcttttcaccagagcaacccaacccctagacttcctgtattaagaatataaggtggccaggcatggtggctcatgcctatgattccagcactctgggaggcccaggtggcaggatcgcttgagcccaggagttcaagaccagcctgagcaacatagcaagatgccatctctaaaaataaaaataaaaattattcaggtatggtggcacatgcatgtggtcccagctactcaggaggccaaggcaggaggatcactggagcccaggaggtcaaggctgcagtgagctatgatcatgccactgcactccagcctgggtaacagagtgagaccttgtgtcaaaagaaaaaatacatttttaattaaattttatttaaaaagaaaaagaacataaggtggtagtgacagcaacgacagaataccaaggttagtctccatgtccactgtattctttgcacaacccctactatcttgtatttttgtgagatgatcaggtgaccaagtttgttttcttttctactttattctgtagttatcatgtgatgtaaaacttgatcctcgtccagaataccatcggtgtatactaacttggcatcaccaagaaccactaccttgggcacagagtacaggttagtcattcacatctacagatattcctagacacctatcctgttaaaacacaaacttatatataatcttccttggttatgactgattttgtaattattatacatttttctttttgaaaagttagatgagttaagttattcctaaacagtatagcaaaagttaaaaaataactattagaagtttacttattttattgagccatattttctagataaacatttagaatgtccacatatcattgactaatgtcctgtaataaatctggaattacagaagatttgatatgtttgttcaaccaataagttctgagtataactttgtaggaaaaggaggagattctagctataccatcttgaaatgtgagatgaaagcccaatttataatttgattctctgtagcctctaccatacgctagttattggtaaatttgaagggcagagaaatcaatattgataatgcagagttctacagtaaccttcactagactttaaactgttattcccaacttccctactcatattttgcctaatttttgatgtgactccagaaaagttgtagtactctttaaacaaagatcctaccaagtgaaaacgtcaactaacagcgactaagttcatgggctttgccatcagagagaactgcattcaaactggccaccaacctacttagcaggaccctaggcaagttacctaaaaattttttgagtcttgtgagaatcaaataaggtgtttaagtaaagtgcctagtactttggcactcagtaaagaaatggtagctgctaccattattgtcattattattttaatactttttttaaagcctcccttttcagacacgcataacatttcagcctgaattgagaaattctatggcattttgcataatgctataaaatcctggttttactctttcaagcaagaatttctaatgtttatttttaaagtttgaatgagaaggtggtaggatataatagcatggccacctgaaaaaggtactggaaagtttgatcatcccttctcctcttgaagacccgcatttctgtctgtttacattttgaaaaggtctacaagggcccaactgtatacgccatgatgcttatgctgctgtaataagagtatttctttctaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattattt

SEQ ID NO: 38628 - DNA, 503221 bp, Homo sapiens; identical to SEQ ID NO: 37778
  misc_feature (106498)..(106499): n is a, c, g, or t

SEQ ID NO: 38629 - DNA, 32949 bp, Homo sapiens
ggccaggaacgccagccgttcacgcgttcggtcctccttggctgactcaccgccctggccgccgcaccatggacgcccccaggcaggtggtcaactttgggcctggtcccgccaagctgccgcactcagtaagtccccgcgagcgggcgccgggagtgaggttcaggcgggagcacgcacgcgggtgggtttgcatccctgcgtgtggcagtcggattcccgctccctgccttgagtcccctaggcgctttgcatcagcgtgcacagcgggatcagcagctccggcaagcgggcttcgggaagaatgcagttggtgaggaagctcggcgaggcgtgcccgtgcagctgcccctggccctgactgctggtgcgaggcagtgcacgactcagctggccggggcctgctgtcccgccggtgccacgcacctgcagacgcccgggctgtgccatctcctgggccggtccgggggctggggcggggcgaaaaagaaaaagctctgatctctgccttcgcctcgcgcagctgtgcggcgagcccgggcagtgtggagcggatgcatgaatggacatagtgtgaatgagtgatgaacgggaatgaaccgatgacaggttttgcatatgcagtggatcacgttagctgaaagggattgcaaacttaaaggtccgcgtgtgcgtgcccccctacgccttacaccagtgtttgctttagccagcacttaggaacactgcttttcagaaatgtaaatttgaaaaccttcagtccagctttcccctccttgtcccccatagaacctaccctttcctaaagcctttctccccacccccctcctttttttaacctgcttgtcccctaaaggcgttcgagtattctaactctggtagactttgggctgcttaacccaattccctgttcatttcgttctggagtaaaccgagtgattgaattctctcccgggccacaatcagatcttgctggtggaactcactctctgccttcccaggccccagcccggctcctcccctcccccgccaaacccaccgtccccagccccacccgcagtgaagaaggcaaagtctccgatgtgccttgagcccattgtcaggcggctgccgccgccgttagatttttatttttctaaccaggatagagctgataatatgttggagcagcatgaggcatagccaagtattttacaattatcaattgttgagcagagtagaaatctccctgggacagagcctcctctgtgttgtggtaagaacagagaatccaattttaaaggggaaaggacttcttacttttctaggggcagcgctcacagtagctgagaggacagggcttattttttctcagtggttacagttcattttaggcgagattccctgctccagctgtggagatgtttcctgtagcctcctcctgcaccccccatgttttggagtgttcccaacgtttgttccctatgtatttcgttattaatttattactataattgtaatggcaattgtcatcagtaatacaattatttgttattaatttttctgggaggatttttgcccttggactgcatgtaacctggggggcaggagggtgagggggcaggcagatgttgctttttatgtatttccttgatttagttgaattgtaaatattagagaagctttcaaacttcttttgactgtaacctacagtgaaaaacatgtttacaaaatgacaaagtatacacattcaattgtaacaaaaataaatgccttatgaaatgatgtgtagcctaattacctgtgacatacactattttgtattctatcctgctctagtctgttctgtttcattaaaaaaattagtcgtgagctgggtgtggtggcgcacgcctgtaatccaagcaactcaggaggctaaggtgggaggatctcttgagcccaggagtttgaggctgtagtgaactgtgattgtcccactgcattccaggctgggtgatagagcaagaccctgtctcttaacaaaaaaaaaaaaaaaaaaaaaaaaaaaattggttatgatccacaaaagcaatgcattcttcaactggaaaaaaaaaaacctactggattagggaggtgtgatttttcagtaggagtctttaaaactgtttgtaattattttggttataaacttttatagaactattttcaatgaatgctgtctataagaaagatacagtctcaggagcaagttcaaagattattcacagatgaatgtttctctttactaaaagaaaagattcactctattttatttgatcagctggtgctaacaagcatccaacatttcagaaaacaataacacattcttagacccagtcgtcaaggcagtcttttttttaatctaattcttttttttttttttttttgagagaagtcaagctctgtcacgaggctggagtgcagtcgcttggtctcggctcactgaaacctccgcctcccgggttccagcgattcttctgcctccgcctcctgagtaactgggattacaggcacccaccaccaagcccagctaatttttgtatttttagtagagacggggtttcaccatgttggccaagatggtctcaatctcttgacctcatgatctgcccgccttggcctcccaaagtgctgggattacaggcgtgagccaccacgcccggccttgtctaattctttattgttaaaatactgttttttgagacaagttgcaatccagtttaggttatagctgtgttttaatgatgccctccttagcaagcatcttaaaaaaaaaggtgcctcctatctgtagaccttctctggctggttgcttttgcacttattttgtgttcatttttaaagcttttctttttctctttattttttattaagggaatcctcacatacacaaagataaaagtagtgtaatgaacctccaaggacccatctctgagactcaacaattatcaacattgtgccagtcttgttgcagcaccctgggacgaatcttattcacagcaggctcttccttcttcctgcccaccccacgcttcccagtctagcaccttagaccaaaagagatcggaaaattgagttacctgtataatctgggcataatttttttatcgttgtccctttaacccagaactttatgcattctttactttagctttaggagagtggtgaatgagatttgtgaaggggacattttctagggaatcggtaaattcgggcctttggaaaaagtgtatcaacatcagtcacattgcctaatttcatgcttaccttgtgtgtaagttgcataatcgctggctttgtggacatgggaaggaaggagactggctgtgggtggggatggaagcctggggacctcactgtagacccttccttgtcccctcgtcaggtttgtatgttcagagggaaagcagtgcagaacatatttaaataaccctattttcctttatttttttctaggtgttgttagagatacaaaaggaattattagactacaaaggagttggcattagtgttcttggtaagatttacttttgaattctgtgaatgtccatgtttcaaaggaagcttttttttttttttttttttttagaggcagggtcctgctctgtcacccaggctggagtacagtggcgtgatcatagttcactgcagcctccaactcctgggctcaagtgaccctcctgcctcagcatcctgagtagctaggactataggtacacatcaccacacctggctaattttttttaaatgtttaaaacattttttaaagatcccatgagatgggatctcactttgttgcccaggctgatctgaaactcgtggcctgaagccatcctcccacattggcctcccaaagttttgggattacaggcttgagccactgagccctggcccaaagggaactaatttaaatgcatcaaatatagaattacagggcctatagggtcttcctataggcctttatagatacatttttaaactttaatagcttgggttgcatgtctgatagaaaccattttgaaaatagcataaatgctggtgagaggttctgacatctcagcttaccctgtcataattggtttttgctaatcataggatttaggatcagaagatactgtatatttgcataacagtgcctccaaacatttataatattgctttacattcaatttacagtttttattatacttaaatacaacctcattaaagtttaaaagtacataagccttttatgaagacctcgcacattgataatcttattaagtttcccctatattttttgggaagaggacctctgcattctaaaacttattttcttttatttttggcggttctgaagactgcatggtattaagagaccatagggttaactatattgcttatttctgttaaattttgctcctgttggtttgggacatatacttagatttctgtgaagtgagatcacagcatggaattttgtgctccagacctaaagggcaactgttgcacatggattcctgtttgtgagaaagagatggtaagaagaatcacagagagcatcacggagtgatgaattaataaataacttgctcagtgaatgtaccacttgaaaaatccttctgccatgactataaagctaaaatgtttgcaatttgaaaatcagtttgtatggtcccctaaactaagtgagccttggcccacaatttgaatgcagaataactgaaatttccctgtattgttgtttacttgcaaatttcgtaggtatttctgttcatttggttttgagctggaatatttgttattgttgtttatctttcctttcacagaaatgagtcacaggtcatcagattttgccaagattattaacaatacagagaatcttgtgcgggaattgctgtaagttttaaaaagaccaaatcatgttacttttgttagatacttcctaaatctggatgtcttccagtattttctacactctattgtttgttcagaatatttcataatttaaaataatccttgtaagattctctccaattcactattagtacctaacgctttttatttgttccccatcccgtgtttatatgtttttgtttttattttatgtgatatttccaaagatttgaaatcattgtatctaggaatgatttttcagcactgtggcagttaaactggtgtgaaagagatgtaaatgacacagaaatggtcatctttgtcagcataattgactataaactagttcaggtgttctcgaagtttgagtctcatacgatctgtcagagtcacctggttagggggaatattaaaaaattcaagtggggccgggcaaggtggctcatgcctgtaatcccagcactttgggaggccgaggcgggtggatcgtgagatcaggagatcaagaccatgctggctaccacggtgaaaccccatctactaaaaatacaaaaaaagaaaaaattagctgggcatggtggcgcatacctgtattcccagctattcgggaggctgaggcaggagaatcgcttgaaccagggaggcggagtttgcagtgagccgagaccgtgccactgcattccagcttaggtgacaaagcgagactccgtctcaaaaaaaaaaaaaaaaaaaaaaaaaaaatcaagtggtgggcaccacttagtcctgctgaatcagaatctctggagagactttatttttaacaggctctttgggtaattgtaagagttctgaactgtaggaactactgcttagacgaaatctcctgggttatctgtactgcctttcctatccagagaatcccttattcttaaatagattgctatttaaaggagagatttttatatattatataaacatgttcacataaacctacgaatatagcaagtttgaaagcataccattttttttcctgctcacagaaataatgcacatttatggtaggaaaaacactgtagctcacaactaaactgaaattaactttaaccccactaatcagggataatcactaatatgttaggacccattcttgcattattacattaacaaaattggaattatactgattatttcaagttttctttttcaaattgcttgataaaatgattcagatggggcaggcttggtgatatttctgtgaggagctgtagacgctaattgcaatgtgaatgttcagagctggtagccatctgcttggcttctctcgtccattggcctgctgagtatcatgtcacattcataggacaatcctgtccttcatggagtgggtatttggaacatcagcctgggagagatgacatttgaccacatggctatgaacttcctctgactggggtcccagttcaatttaagggcctatcttttcttctcctaacctggttcccaccttgtatacctgtacctagacctcggcctggtttctttccatctaattcttggccttgttaactgccctgcatctgaataatgtgaacctggaactctgtcttgggttatcagtcttcccagctgctaagaacctcatggccagagtctcctaagacctgctggttgcttgctatcctactaagcactgaatataggccatacatctttcaggacaagatatttacactcctaccaccccattccccaagaccctgccacattgccctgccctttattaatttacctctgtatctttgctggagctctgttccctggccatctggcttccgtacacctattcccaggctctgaccttactcagtggcttgggtccagtttccatggccttgtccttttggagctgggcttatttctactgcctgtagccattctcatcattatcttactttttcatcctggagtcaaagaattttgctttttattttgatgtataatagatacatgatttcatgggtaggcctaaaacattatcgaaaccccctgcccaacatccacctggttcatagcatgttgcataacacaggattattggttgcaagttataggacccccaactcactggcttaagtaaaaaagaaatgtattatctcacctaacagataaatgcaggagaatttaggtgcttctaaatgactgcaggaaggtgattttcccccatcttctggctctgctttcttatgtgttctcttcattgggtggccaccattggttgcaggattagctcctacaagtttcttctttccctcaatagaaacagctttccttacctagaagtttgagtaaaggtctcagtaccaaattccattggccagcctggggcaggtactcatccccttgagccagggttgaccacagttgaaccatgtcgactgagagtggcagaggggtaatttcctaaaggaacatcaggctgttgtcactaagaagaggaggaagagcttcaggtcaaacagtaaccctaggctttcaacacagtctccagtaaatagttgtccaaggattgcataaataaatgagtgaattagggaagacaaagtagtattgtaacattaccatatttcttgtagtaaatccacccaagttaaagcacttggtagagcatcacttgttctcaatctttgaccacatgagtttatgtattgactgttacctatgcttctgcccagagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaagtaagttctgggagctgagctgggtggtgacgtgctcaatggtgggttaccccgacccagggcaatctgtagttttcaattattttctccccttgacagtgttagttcattaccatttagattgggtggctgtactagctaagactagagcctatgcatactcttactttattttattttctattttttttctagacagagttttgctttgtcacccaggctggagtgcagtggtgcaatctcagctcactgcaacctccgcctcccaggttcaggcgattctcctgcctcagcctcccaagtagctgggattacaggtgctggccaccacgcctggctaatttttgtatttttagtagagacagagtttaaccatgttggccaggctgcttttgaactcctgacctcaggtgatccgcctgcctcggcctcccagagtgctgggattacaggcgtgagccactgtgcctggcctatgcatactcttcttgcagaagctagtcagtagttagtagtagtttttcagctaattagctgaaaaagtccaggggctggtttggctttagatatggcttgatcaggggccccaacaatgtctccaggacctggtggctccacaggcagaaaaagctgtccctttcttgaaaggtggctgcagctgctcctgaccttatattctcccaagtttcaatgcctttatggagcattcccagtaacggtctcatgtcctgtgccccattctgaatcagtccctgtggccatgcctgagttgcattctacctctgggctgtaggtttcattggctcccctggaactacgtgggctgagagtaggtgagggctggggttccaagaagaaactactagtccatcaatggatgtaggatagatggatactgggcgacaagtaaaaactcagatatctcccatgccttttgaaaaaatttactttattttattttgttgagacagagtctttctgtgttgcccgggttggagtacagtggctcttcacaggcaggatcatagcacactgtagcctccagctcctgggctcaagtgatcctcccaccttagcctcctaaatatctgggactatgggcacataccaccatgcccaccttcccatgccatttttgaagatgatttgttcccagtaaaagtcgaaaggttggatcgctcatcctctcaggatgttgataacgatggtaacaaaggatgaggctgggaggttgctttcactcgtgcaatgctttggagtcagttagtctttccctgctaggggaggcctgtcagtctcctggttgactcccatctatgtaaggaaagaggagagtgaaaagtgcaaagtctcaaacttgtcttctgtgatagaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaaggtagagtataaaaggcagggtgaggggaacccactgactcggtgtctgcagggacattttaatatatacaagagcgggaagaaccatgggtgtttgaggcctgcagaacccctgagccagtgcagctgccagtgagcaggctgccaggtgcgaattcccagctgttgcagtgcctgagtcctgctgttcccagcctcgtggtgatgtttgcctcacagggtcccactcgagtccttggggaactacctgcttttgagagtggttcttagaaacgtgtttggtcaacagacggggagagacttgtcttcaagagcagatgcagattatcccgagcccaggggacctatgtgagggagcttccccttgcctggtacccacctccaaaagcatcaacaggataccgttttatgagtggcttgccaaggcagggcagtgggactggcgctgtaggtacatgccccagggtgcgatgcgggtagagaatctaagaacaacagttgaactgactgagtggtattctgcctttttaattgggataaaatataacaaattttaccatttaatataaaatataccattttaaccatttttaaatatactggtcagtggcattgagagcattcacattgttgtgcaggcatcaccaccatccatctccagaacttttacatcttctcagatgaaatctgtacattaaacactaactccctctctccccaccgtccagcccctggcagcctccattctagtttctgtctctgtgaatttgactactctaggtatctcctagaagtgaatcatgtactatttgtccttttgtgtctggcttattgcacttagcagaatgtcttcaaggttctattgcacttagcagaatgtcttcaaggttcgtccatgttgtactgtgtgtcagagcttcctttctttttaaaggctgaataataattgtttagatatactgtatttggtttatggtctgctttttattatcaccaggcactggcaattttaaataactataaattactttcccccacccccaacttcctgccaacgctcaattttcctaagggtttcatggagagaggcatgggagagggttctgtatcttgcacaacagaattacctaaagtacctttaagcctctgttttctataatttcttctccctcaggcagcttgtcccatcccttctctttgtcataacagtccctttctcagcaccttctgactgttcttttatacaaatgtaaatagattaaaaaatctgttttggccaggcgcagtggctcaggcctgtaatcccagcactttgggaggccgaggagggtggatcatgagatcaggagttcaagaccagcctggccaacatggtgaaaccccgtctttactaaaaatacaaaaattcactgggcatggtggcacacgctgtaatcccagctactcggcaggctgaggcaggaaaattgcttgaacccgggaggcagaggttgcagtgagccgagattgcgccactgcactccagcctgggtgccagagcaagactccgtctcaaaagaaaaaaaaaatgtttcttctcttggtaaccagggagagttagaggccccacgttaaagactcctttctactttgggggtagaaaggaggtgtgcagagcgaatgtgaatatgtgccaggactttgcagtgatgggcttgggttagccccatccaggtgaggaccaggctgacggatcatcctcaggctttggaactctgagtatgggtttgctgtccacatggagattgctttagagcatgaactgctccctacacaggatagagtcatttccttaaaaaaattgtgcttcgggaagagttgggaagtttgcatacatgtatgaaaaatggccaaatccttcttaagcagcatgtctttctctttttaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcaggtaactctgggagtcagtcttgtggacccagggaggggtctcactatttttcatcaaagcggaggttacattttaaaataaaacatgtaagcctgggcgcggtggctcacacctgtaatcttagcaatttgggaggctgaggtggatggaccacttgaggtcaggagctagagactagcctgaccaacatggtgaaaccctgtctttaccaaaaatacaaaattatccaggcgtggtggcacatgcctataatcccagctactaaggaggctgaggcaggagaatctcttgaaccggggaggtggagattgcagtgagccgagatggcaccattgcactccagcctgggtgacagagggagactccatctcaaaataaataaataaataagcaaacaaacaaacaaataataagtaaaataaagtaaagcatgtttccaggagccggtgatcaaatgccccagatatcctatcagattctctgcccagctcacctctccctctgcaccatctctttaccatttgatcagcttttcctcttgttcttttctggggatgttgttttttgtttggtcttggtaatccaggatccggtggttcaccattaacccaaaagctctctatacatgaggtgctgtggcctgcatctcaaacagccagtgcagctttggagaagaactttcaaaagctgggcctcccctgccttcatttctttctctgtcgggcctgcgggaagctggctgcctgacagaacatactggcttaaatacctttctgggttttgttgttgttgttttttgagacggagtctcgctctgttgccagcctggagtgcagtggcatgatctcggctcactgcaacctccacctcccaggttcaagcgattctcctgcctcagcctcccgagtagctgggattacaggtgcgtgccactacgcccagctaatttttgtatttttagtagagatggagtttcaccatgttggtcaggctgctcttgaactcctgacctcaggttatccgccggctttggccttctaaagcgttgggattacaggcatgagccaccacaaccggccaacatctttctgtattttagcctaatctgaaggggtccttttagcctggctctcattcgctgactgggggctgcgttgcagcacttcaggaagagcagggttgccctgcctcaggatcctataactcccaaacttgggtattttgagaaaatcttcatggctcttaagatttacaattgcctaagagagtctagtatttactagctgtgtgaccttaggcaagtcacttaacatgtctgtgtggtaggttctagaagtaataatagtacccctttcactgggttgctgtgaagattaacatacatataaataaatctgtgtatatatataaaaattttaaattttgcactgagtacctggcacttggtgattgataaatattagctgctatgttgttattgttattgtgagttctcagagcctcagcaggagcagacacaagggaagagctggagtttgtagatttatctttctagggccactatgatgcagaatggtgatgctttatgtgtatgaccgtttaatcctcccaactaccctagtaggtagccagtgttatgatcatgattcccattttgcaagtgaggaagccgaggtcatattttaggaagtggcctggctggggtgtgaacccaggccatctgactctagatcctgggtatgtacattctgccattagtgctctctcttcaccagcaaaaggatgagtgtggatttgcgtgtgtttgcaggattctgccttaggagaatagttcactgttggagtccagctcttctctcaacaggattttcttgtcttggtggaagttctcttaaaggagcgtaggaaagagggggctcaggctggtgcagttagtggttccatctgggccaggattttgtcagagcttcccctcctccaggtgctgcttagggaaaatgtcttctacataatttactatggaaaggaaagaattttttttttttttgacagaatcttgctctgttgcccaggctggagtgcagtggcgtgatctcagctcgctgcaacctccgcctcccgggttcaagcaattctgtctcagcctcccgagtagctgggagtacagacgcctgccaccatgcctggctacttttcgtatttttagtagagacggggttccaccatgttggccaggctgctctcaaactcctgacctcaggtgatccacctgcctcggcctcccagagtgttgggattacaggcgtgagccaccgccggaatttttttcaatgttagaattctggtgaaaattctgctgggtttctgcttggtcacacgatgcagagcagcagctcctcacattgtgtctcccactttcctcaggggagtgttctgggatgcactctcctggtcacctctaaaccctactgtcttttaccttggttgaaatgtttctaaaatgcatggtagggatgggagtggggctgagtcttacctcccactcgcctgtcttacctctggggaagcaccagtggtcactggccaactgggacacaagaactgggcaggctgagcggtgagggtgcagctggggacctcaagtgctggcctccgggggaaggggccgagatgtcaggctgcacatggcaggtagaggtacaggaggctgtccttacctgtttggagatggggccagggcctgccttgcagctagaggaggctttcagaggagcccaagaccatcacccatttcagaagtgagaaggtgggagggggcagggaaagagtgctgttcctgaactgtcccacagcctgtaggccagcaagttgcgatcagggtacagcttggggcagggcagacagtcactctctggtaccttcttcaagggttaccttgaagagcatttttttaaaaaggaatgaacacggccgggtgcggtggctcacacctgtaatcccagcactttgggaggccgaggcgagtggatcacaaggtcaggaaatcgagaccagccagaccaacatggtgaaaccccgtctctactaaaaatacaagaattagccaggcatggtggcgggtgcctgtagtcccagctactcaggaggctgaggcaggagaatcccttgaacctgggaggcagaggttgcagtgagccgaaatcacgccagtgcactccagcctgggtgacagagtgagactgtctgaaaacaaaaacaaaaacaaaaacaaaaacaaaacaaaaaccatgcaaggttagaaaatcattgctcacccaatgagaacaagctgcaaatggagacatcaagatgtgtgcaaaatcccctccccagtccgtgatgtgaggctgatggggtacctggagcccttcagaactttgtatcacatagtagagttcttgaaaaggcctcacttttgaaaagacgcctttttttttttttccccacagagtctaatgaccataggccctgggaactttgatttaattgtgctggataaaactgccttcaaatcgttgctccgtagccctgagtgatgaactagagtggaataaagaacacactgctgttctctttaacccttcagtagaacacactaaccccaattagtgcatagagaaaaagatccctaaacttcccttctgactgcacaaaatattttttacttaccatgactaactgaatacacaagcatacgtttgttttagctgcagtatgaggtgaagtaactaataaaaatacaaaacaaatagaccattaatcttaggccacctgttaaaagaatgagaacaggccaggcgcagtggctcatgtctgtaatcccagcactttgggaggtcgaggcaggtggatcacctgaggtcgggagttcgagaccaccctgaccaacatggacaaaccccgtctctactaaaaatacaaaaattagccaggcatggtggcacatgcctgtaatccaagctactcgggaggctgaagcaggagaatcacttgaatccagggggcagaagttgcagtgagccaagattgtgccattgcactccagcctgggcaataagagcaaaactccatctcaaaaataataataataataaataaataaaagaatgggagcatgcaaattaagtttgtgggcctgtttggaaggcttcactggtcccagactaccttctcccagtgggatggggatgcctggaatcctggaattcacagaggggtgtgtagtggagccagttttgggagctttcctctgggaaaagtgctcaactcagtggctacattcaccgattcctgagaaaactgtgccataacatcaacttcagaacctcatctgcagagctggagtcttagaacagccagggagagttttccaggggactttctggtgtccttttctaagccctggtgcacagggactattttgtattgctttaaaaaatttataacagtgatatactcttaggctgggtgtggtggctcacgcctgtaatcccagcacttcaggaggccaaggcgggcagatcacctgaggtcaggagttcgagaccagcctggccaacatggtgaaaccctgtctctactaaaaatacaaaaattacccgggcgtagtggcgtgcacctgtaatcccagctactctggaagctgaggcgggagatcacttgaacctgggaggcggaagttgcagtgagctgagatcgtgccactgcactccagccggggtgacagcaaaactctgcctcaaaaaacaaacaaagaaacaaagaaacaaacagtaacatactcttagcaaagacttgcaggtgggcagagtcaccagggtagccactgttcactgcttgctttgtatcctaacagactcttaactgggcatatgcaaatatacagagtcatatatttaatcatgcaaatggaacttgaactttaccatacaaattgttctgtgaattctatttttccactccacaatataccatgggcattctgctatgtcagctcaaatgcctatttttattttttacttttaaattttatttttgttagagacagggtcttgctctgttgtgcaggctggagtgcagcagtgtgatgatagctctcagaaaccgcaaactcgtaggctcaagtgatcctcccacctcagcctcctaagtagctaggactacaggcaagtgccaccatgcctggctacattaaaaaaaaaatttatggcgacagggtctcaatatgttgtccaggctggtctcaaactcctggcctcaagctgtcctcccacactggccgtccaaagtgttgggattacaggcatgagccaccacacctggcccttttttgttttaaaatatatatggtgtcctgtagaatggacatacctcgatttatttaatcatttaataggcagagttaggaaccctatcctgtgtgtttgcaggtggcattttagaaatgaaggcataagtcttaaaaatgtcacactggtagtgggaagaattgagaccactctataagctgtgtaagcgttttagagcccttgtgttttcaagattttagacggtatgggagttgaaacatgagttaataaagaactggaagccacgagggtcctgtgttaagtagagccacaggggctagacatcagtgctctgcagagggctgggtgggaggggaggcaggacctcctatcctgtgttaagtagagtcacaggggctagacatcagtgctctgcagagggctgggtgggaggggaggcaggacctcttatcctgtgttaagtagagccacaggggctagacatcagtgctctgcagagggctgggtgggaggggaggcaggacctcctatcttgtgttaagtagagtcacaggggctagacatcagtgctctgcagagggctgggtgggaggggaggcaggacctcctatcccagggatgtcttcagtcttcaggacagcttgcttgcttctgagttgtctgcctcttgtttaggcttcatagagccaagttatgggtgctggctccaggcagcccctaaaagtgggtgagctttctgctggccttgcctcctcagatcccattaagaaagccagagatcatgggcggcgagtgtgagcacagcagtcagctaggggttcaggcgtcggtactgaggtctggctaggacggtggacctgacatgggccttgctgcactttggatttagacaaaccaaatccacagtgcagcaagggcccatgtcagctttgaaaccctgggctaacacagagcttcaggcaaaagggaagcttggtcacctggaagtattgttggtgacctgggctctgcttggattcaatcacatggcagggtgtgtttctgtggttctgtgtggaggtggggggtgaacaggctgcaggtgtgggagaggagcagttggaagtgaagtgggaattgcagagcatctgatgaacagagggctgggcagcctcgtgtctggaatgcacacccacgtgcatgtgtgctgtgtgctggacttggccactgtcactggtgtgtggtgatagctctgcagtcccactcgcaggggagctagtggctggagccctgcagcccctggcaaagcagagggcctgcatacttgtgggaagagcttgcattcttggagtcagacaggctagagttggagtcctggctttaagctgcttgccagatgacttgaggcaaagttaacctctctgagcctcagtttcctcatctggaaaatgggatgacggtggctctaacccgaggattattgtgatcaataaagataggctgaggccacagtagacttcaggaagtactcattcccttctcttactttctctcttctgtctcttttgtccctctgacttcttggacgttagccagagagctaccgctgaggctgtggatattctcaggggctgtttcctcttcctccctgccttccctttctgccagcagccactcttgctctttcttcccagtgctgtctggggaggtaggctggggaagcttcaggagaggttgttggatgtttgtggctgctggctgctccctgcctaaggcccctctgggcagcccggtgttggcttttgccaacatgagctggcatgagccactgcacccaggccttgggtcccacttgagacagtgaatgagccagttggtatagggggcttccctgtgacaagctgctggctgttagagcattttccagaccccataatgtcccctcctgttaataaaggaggaagcagctgggtatccccaccctagatcttagctgagcattgactcccagtaaatttttgcacaattcccataggggatctttgattcacacctctggagagggcatagttggcagctgacctccagactcccagctcaagggagatggtgtcttccctgggcgacctctcctcctgtgccctgagcttttactgagtacacgtggagcctttagcaccttcttaaggagaggggttttcagactggggaaaaccatgcaccgctcctcagtgtttcatattttcagcttaagtttgaagggactactgactgccatttgtgtggcccacctgccacgtgccaggccctgtgctaagcgttggtctggcaggaagaagttgaaatacttggttcagaaagggatggtcctgagctgcgggaagggcccaggtgcagctggacttcctggaaccagggacacaaatcctcctccatctgctctccacttctgatcctggcttctctcagcgggaatgttggcttcattttcagatgggccttcttcagatgtttcctagaaacatgatcccctagggctctcatctcctgtctcacagttgcactaatattctgccgctttttctgctctccccactctttctccccacacccaattcagaaaatctcagggaaggccctgattggcccagttaggtcctatgccgaactctgagaccagggagccaaggggccttgctggacctgcatactggctggagggtggagttgggaagagcagggtggataaaatgccaggtgtccaccacaggtaggtggatctcccggttccagatgggaaaaccgaggtgactaattctgggtagtctgttagtgagtggctgccctacaatgggagtcaggactgggagggggagcccgtccttttaacccctcggccacagtgctctctgctggctggaaggcactgtgctaaggatgtgggtagaaaagatgaacagcgtgggcttctagccttccaagaccacagaggccaaacaacaggcacacagaaacttaaaagagcaagtggaaaaaaactatgcaggtaatatgggcaaggcgctctgggagttcaggaagtgaagagctcgctctgggtaggggtgggattggggtctgctgatgccttctggtggagataaggaagtgtgttctggctctcaagaagagtttacattagggcttaagctggacaaggagggactgatatgatgtttagtgaaaaatctgattaaacctttttctgaatggccctcagggatctagaattgggttgaccctagtccttgcttgatgacatgctcttgttcacatgggccctgcttttgtcttgtgtattttctttctttattttttttggagacaggatctcgctctgtcacccaggctagagtgcattggtgtgatcatagctcactgcagcctcgaacccctgggctcaagcattcctccctgctctgcctcccaagtagctgggactataggcacatgctatcacacccaactaatttttcaatttttatggagacgggtcttgctatgttgcctaggctgctttccaactcctggcttcaagcgatccttcggcctcggccttccaaagtgttgggattacgggcgtgagccactgcatttgactatcttgtctatttcaaataatgtgtttaagtctgttttaatgcaccttcaacagcagtttgcttgaatatagttctacttttgcaaagatgagctaaacggattttttaaaaatcttcattttagcatctacgtcatgggcttggttctggagtggattaaaaacaatggaggtgccgcggccatggagaagcttagctccatcaaatctcaaacaatttatgagattattgataattctcaaggattctacgtgtaagtcaatggattttatctcctattttgcctcttgtgaatttaaaactgtgtatatactgtgtacctttgaaaagtggacatattcacctttctctgagacattaaaatactggtgagtgtgtgtggtcctgggccccatgagcaggggagtgggtggtgagttcttccctcctgtacctcaccctggggctctcaggctttgggacctgtgtcccagtgggtggtgatgtttctcacaccaaagacatcgccctggggaagaatctcagttcactccctggggtaggtcccgtctactccctcctttgtatatcttctgggaaaaaaacaaatgtactttctgaaatgtgtcaatttaaggactcctgttagcgatctttgggacaaatactcctgtcctcctcttctgcgttatttccctttttaagaaaattcactcctttccttattataagacagatgctgttatcccagagtctgtgaatggaattggctttggcatgggctgactccagtttaaatattcccatgaacaaatgattaatgagtatgtcttaaccactgcccctgcacctgggaattctgcagaaaatgtctgggtcttgtattagtttcctggggctggtgtaacaaagtactacagacttagtggctcaaaacatcagaaaactgattctcactcttctggggccagaagttcaaaatcaaaatgtcagcagggttttggtccctccagagagccatgccttgcctcctttagattctagtggctcagggtggtccttgatttgtggctgcatcactccagcctccacatctgtcttcacatggccttctttctgccgtgtcttcccttctgtctcttaaaaagagaggtctttggatttagggcctgtccagataatccaggatcatctcatctcgagatccttcacataatgacatctgcaaagtcctttttttccaaataggtcatattcacagattctgggggttaggacatgcgcataccttttcagggtcaccattcaatccacaacaataggcccttcaccaaaatgccagatgggaagcacctagtgcggtgccttggatgcagagaagtgtaacaggtggtatcttcatttgcttttccctttcccttaaggtggttacaggtatacaaagaccagacttcctgctgtgtacatgtatgtgcgcctacacatatacataaatgcttaaactcaccaaactgagaacccccttcttagtggccattgctctttggggttcagtctatagtaacaaaaatatctgcttgatggtaagttggaaatttgccctctctcagataattcagtggccacatgggaccgacaaaacgatgcctctgtcctaacttaggattgtactttttagccaagacttaactaacacatctccataaccacccatgggcgggcagtgctggtgtactttttggatggcatgctgctgtcacctttgttcttgcaatgcttgttgcctgtttctgtgagctcttgacatgcagtggccctcctccagctgcaagcccagggggagttaggcttggcgggatgccttggcctttgggctcctttcccaggcaccatctcagggaaggggtacacactctgcattactgcctgttctctggttctgtgcaacagagaagcaagtgcaggctgggggctcagtgctggggaagcttccacactagaccttgatgtgtgagtttggaggccaggataccctgcctgtgctcactgaagccatttaaagtgcacgatcagcagtaggtatccaaagatttcatagccaagggctaaagaatgtggcatgagcctggaaaagggggatactctttggttggagtgaagagagggcttttgcatgagcttattatgagccctggtcatgagtggaattaggcagagaagagggcagaagtacttttagaaaggttagaatcatccccgcaaaggcactgagggaagagtgtacagtgtgtttggggagcagaacatgggctgcttgaagggcatggtttatgctgggattgggaagaaggtccgtggaagtgtgtgagggcgtgtttagtccacctatttattcattcattcatctactcacccacccatccacccacctacccatctatccatccactcattcactcattcattcattcatccatctgtctacccattcatctatacattcatccactcatccactcatccatccaccattgacccacccatccatctattcatctaccacctgcctacctatccatccatctacccactcactcatccatctatccatccattacccacccatccttccacccacctattcacccatctacccattcacccatccacccatctatccacccgcccattcattcacccatccactcatccagacatccatctgtccacccattcatccatccatccattcatccatccactcacctacccatccactcatccatcaatcttccatccatccatctatccatccatccatccatccatctgcccacccatccatccattcacccacccatccacacacccacctatctatccatctacctacacacccacccatccatctatccatccatcacccacccatctattcattcacccttccacctatctacccatctatctatccatccatccatccatccactcattcatccacccgcccacccactcatctgtccattcacccttccacctatccgcccatctatctacccacttgtccatccatccatccatccactcatccattctcccacccacccatccacccacccacccatccatctatccatctgtccatccatccaaccgtccatccatccataaaatggctcctgaggacctgctctgtacactagccttgttctaggctcctggaagaccgagaagaataaatcatcttccctggctccctaaaaagtgctgagaacctgaatgtgagtaaaagcacttggtgggtatagtggacgggagaccaatttttctattagcttttagctctatacatttctcaggagatgtgtagacatgatgttagaggacagaaagaacggtgataccactgggaaaaaaattaagggcatcaggaacaaaataagaaagcatagaaggaattctgggactctcctgaatccccccccgccacgcctaggtcctttaactccaagcactaaacctgggcctctcccagaaggcagcctgccaaactaatgtggcaggcaggtcatctcctgggcaggtcatctcctggggaatctggtcatccttcacacccagagctcttcactcatttctgaactgccttgacccaggacttccagtccttttaagaataaacctctttctaggaactcccaccaccccctcagttgcctgcctggaaagcgtcatcccaggcacttggtgttctgtgggaccttgttactggagtagagaggaggctgtactctgtctctcctctgtttatagctggagactcccaggctgtgcctgaactcacttagattttcaggaaattcttcttttctttggaactatggaaatagttgagcaacatggccccatgggaggtggccacttttaaagaggaatacctagaattagaatttgcaatttaccaccacctttgctcctcatttttgtctctgagaagatgcaccccctccccacttccatgccccctgactcgtaaaccagctccttaacatagttccaggttgtttgctgggggtttcaccagccctgccagtgaccttggcagggaattctgggactagataagacaaccatcgaagcctccaagttgattccatagcccagtcacccacactgtgctgactgaccccatgttgagcccacgtgggccgtttagcaccttgggcttagaagccccattttgccacggtggtgcgtgtgacctcgtgcaaatgacctaactgctctaagccacagttttctcatctgtacaatggaggtaatgatacatacttcttaaaattgtcaagagaattaaaaggaaatgcttctgaatcaagaatatataatataaggattgagagcatttttacattaaggattgaggactcttgtgctggttaatttgtataaagtgctagaaacagtggttggcacacaggaagcattccttgcatgttagctcttaatatcattatttgtggttattgttatataaagcaattatgatattcctgacacacagtgcttatataagcttatgtaatataattaattatataagtatataatatatattaattttattatataaggatgtccaagtgacagattccatgtctggatctgaggtcacctttatcaccttatgtgggtaccaggccttaggaaagagaaggaggcacgtgatgggtctagcgaagaccctaaaataaaatgaagcaggcagagtcctaggcaccttacacatgtgaatgcattttgttgtcatcacaaccctgtgaagtagacattgagcctatgcagcagaagcacagataggacaaggatgcagctggaaagtgggaccagccaggctacgaacatgggggtggaaggctcattccagaacctctgctgctgtctatgtccaggagtgcagaaggccttaaacatacaactcaagctataaagtaaaagaatgacgtatttaattacatgaaaattttaaaattttatatggcttaagacatcataaacagaatcaaaaatgacagaatgagaaagattttgtagtatattaaacataaaggttactatccttaatttaggcaagaacccacagatgaatgaaaaaggataaggaaataaaagtgggggtgtggtggttgctaacagtatgaggaaacaactcagaagaaatgcaagctgcctcatagacaaatggaaagatgccaccttcattagttccttaggaaatgcagattaaacccatgagatatgttttgcctttcatctgcatacattaaaaggattgataacatctggtgccagcaagggcatgcacttttggtgagagtataaatctggacaaatttggagcaaagattgcagcgctcattataattcaaaacttacatgggctttgaccaaggattttgatgtctacagatttacccttccccagcactctgcctgggtacagtggtgtgcacaaaattagggaccagcaagtccaatgtaagatgtaatggtggaaatatgcagttgtgcccatcagtaggggtctgatgaaaacaatgaggatctgtgggtaatatggaatgactgcattgagaaggatgaagcgggtctcttagcagacatgggaagatgactgtgttatgtcatcagaccaaaaggagcaagagcaagtgtaggaaaagacaaatctattagtctttaaaaactacaacaaggccagggacagtggctgatgcttgtaatcctagcactttgggaggccaaggtgggagaattgtttgaccccaaggagtttgagaccagcctgggcaacatagtgagacctcgtctctacaaataataataataataaaaaattagccgggtgtggtggtacatgcctgtagtgccagctgcttgggaagctgaggcgggaggatcgcttgatcccaggaggtcaaggctgcagtaagctgagattggaccactgcactccagcctgggtgacagagtgagaccctgtctcaaacaaaaacaaaaacaaaactacaagagttatatatacatacatatttacacatagacacacatacatgtatacatgcatatgcacacagacgtacatgtgtatatctaaaatgatcttcaggaatgcacagcagaccattagggtagccacctcttgtgggaagaggggtggcagatcttcatatttttattctagattttcataatcatgtacaaatttaaaattaattttttgttgacaaaaccaggcagtaaggagaggcctacatagggttgcatttggtaggcttctcttcacatactcttctttctcattccctgtgtatctgacacatcctttcagaggggcctgactgtggagtgatgtttcttcactgcctgctcatctcctgtgactttcttgcgttcccttctgagccttaccaccttcgtgggatgggtgtccctggctgaaggtgtacctctgccatgttcccctcctccagtaccttggaaagtcccggtgtgtccctgagcagcgtgtctccgaggggactgtctggaactctcatccccacaataggaagggtttttcagtcatgggggaacactgcgttcctgtctgacctcctggggttcctcatttacgtggtcggtgagctgttgagaggcttcaggaagtcaggagtgaggaggtctgcctagctctgtgaatgcagctttcctaagtttctctggccatggaaccactttcccagaatgcctgttgacatcttcgtgctccaccaagatgttgggaagtgcggctctttccctggttcccacttggactttctccttaaatctttgcagccctgggatttccagctggttccatgcccatccatagcccacatagcctctcagtctgccttggccccttctcctacctcggccctcaacccattcaaacaacagacctggtcacctctgaaatttggtgttaactccagggattgattgctcactggggagcaggggctagatccagcccacagtggtgcttgacggggtcacccatgtttaaaaacacaacttgagccaatattgggctcttggaagatacttagagatctggtttcttattccataatccatgtgcctgtgaaaatgggaaaaagaaactttgacagggatagccatatgtttcaggaaaaaaaaaagggagagcctctttttcagactagtcctccacgtttaaaatgtgagagagcttgtttgcaccttccacaccggcccgtcctactcatttatgtgagtggtgcggggacatgctggcttagagtttgccgcccatgcttgaagctcctcggtgccggcaccttggtacaggccctagttcttttgacctagaaagctttttttttgtttgtttccagccatttcctttttttaatttacagtttgcgttcagtgcaaacccatagcatgagacattactatgaatcaaaatgtaaatacacaaacacaatatagaatccaaaacagaggtgcagctttcaggaatgaagcagaagacaggttcattcacatgcacagtagcttcagggctgtgtgatctggttgttcccatgtagcttcctaaagatggaaaaaaatgattttggtcatcaagactactgtggccatattagatactggaaccgtagaaagttcttcataagagctttccagcaggtctgtgcgttcccagtttcttcaccccccagtctctcctctgtgtgctgtaattatttttctaaaacacagaccgcattttgttgtggattactcctcattgctcaaggatccagtccagttcccagcagggcactccacagccccggccctgtaggtcttccagccaccccagccaggaagccagtgctccagttaagtcagcagacttgccggaagcctttgtgcctttgcagatgcagctgtctgccagatgccctttcttctcatctgttggaaccatgccttgtcccctcccctgaaacctgtcaaccttgccgctgctgaattccttatctggcttctctgcctttgcagcccttggctgttacagcacttcctacgtataattgtgattccctccggagccatctctctgtagattggaagcagttaatttcccttaatctttttttctccccccagccccatactagagacactctcccatgggtagtgcataaatatttgttgcatgacaatttagtctttaatttctcacttttatgacattattgctttgtgatatcttctactttcatgataggatgggtaaattgcagggagaggaactgtaaatacggatgcttaattcttcctgctttcaatttttttctgttaagttaaatgtgctttttgttgctccacctctctgattggagcctcacattgggagcctgaggcagtggaatatcaaaagagggtagccgttgaatgtttattttcaatgtcagccgtgaaacctaccacttcgaatagtggggcctggaattcaggctcaaagtcttttccccatatttgtttccccctttggcctctcttttgcttgaagctgtgtactagactctcattaactttaacaagaattacagatgtgccctcagggggcctctcacactgcctttatttgctgtaattttaatgaattccacccgtagaagtgtaagaataaaagaggatatacttgagcaaagggaaagagagggttattacacattgtacctttttttaaaaaaattgcagagtaatgtcagctattcttccatttgtctcctttggttgccagtgaaaaataattttggctgcttattttccaaagcagaaactgaagtcaaacacgaacctttcctagacaaaaattcactcataatcatttttgagagtcgatatgtaccttatgcaaagtgctgggaataaaaagatgaatttattcccataaatatgtacacctactatgtacccagaaaaatttaaaataaaaatttttaaaaagatagatgtattaacaggtacttatatagcatttaatatgttgcagacatagttttaaattgtgtcagttatttgtttctgcatcatagaacaccttaaaacttaagtgactgaaaacaaccaccattcacttgctcgtagttttttgggtcagcaggttgggctgagctcagctagggggttcttctgctggtcttgggatgcctcattctactgaagtcgtcatctggttattcatttggagccagatggtctacagtggtttcacatatctggcagttggtgctggctgttggctgggacacttatctccagcactctagctcaaacatgcttaagtgacagcaatatatatatatatatatatattttttttttttttttttgagacagagtcttgctctgttgcccaggctagagtgctgtggcacaatcttggctcactgcaatctccacctcccgagttcaagcaattctcctgcctcagcctcctgagtagctgggattacaggtgtgtgccagcacgcccagctaatttttgtatttttttttttcagtcgagatggggtttcaccatgttaatcaggctgatctcaaactcctgacctcgtgatccacctgcctcggcttcccaaagtgctgggattataggtgtgagccaccgcgcttggccatgacagcaatattttaagagagcgggaggagaggctgtaaggtcttttgagacctaggcttggaaggtgcaaagagtctgttgtaaactcttggccaaagccagtcaaaaggccagcccagattcaaaagatggaaaactagattccacctcttcttatttttaaatgggccacaaaaattctctataaagactgacttatttaatgcttacaacaacttgaggtggttgaggtaggttcctctattattcccactgttcagatgaggaaggtgaggcatagcagagaggttaagtaacttgctcagggtcacacagcttggggcaatacaccatggtaagtcctttggaagttgctgctcattatttttgccttacagccactataggaccaacttattatttctctgcagccttgcagagaaagaggtcactcacatttgccgtgcagctgccatgtgttggaagcttcatatatgtagtaccactaaaccgtcacaactagtctgaaatggagatattattattcccagtattcaggtgaggaaactgaggctgatggaaattaagtacaagtcatacaaggggatgataacccactgttccatatgcaagagtttgttttccctaagtaaacaataaatgtgctggggcagattttttgttttttgttttttaaaaaatcttctgcttgcatctaggaagtgttaagaaaaaaaaatctgttgatttgtttatgacaacccatacatttcagaaaagtagctggaataataaacatgtttttcagttgtccagtggagccccaaaatagaagcaagatgaatattccattccgcattggcaatgccaaaggagatgatgctttagaaaaaagatttcttgataaagctcttgaactcaatatgttgtccttgaaagggcataggtgagtacatctgcaatgcacgagcttggcaaagaattagcttagtttttcaaatgcagaataaaacaaatctataggagcctgcttagcttggagtagcagttatgtaatttgttgggccaacccagctgttataaggatgtgccttcttcctgttgtttatggaaccctttgcataattccccagctgagagtataatggagctccatcttccatgagggttttggcaaaattacctttgaaaatctcttacactgctcgtatagcacagaggttgccattccatctctgatgaggccagcaccactctgttctggaggtagagaatcattattattccaactgaacatcaaattagtagctagtcttgcatgctctatgaaaaataaatgtcctcacatgagaatagcagcagggaatgtcctcacatgagaatagcccagccccgatcttgctggcactgtcacgacaggctcatgaatgttgaacagaatcgctatcttcttccaacttaccttttcttccccacatcttgcttgctttctttgccaagagtgaatagttcgaatgactctaaatgtgagcatggtgaaccttcacagcttaagggagaattttctgatgactgagacgtgtgaagctctgtgccaggtgtcgggagtttttaggtaggagaccggaaatgatggtctcaggtgctgcaactctcaggagccagtggctagaaaaaggtgttttgatgcgaaattagacgtttttgttctcaatgcctggatctttggtcattctaggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatct

SEQ ID NO: 38630 - DNA, 11375 bp, Homo sapiens
gaggttcgctacccaccgatcctgcactgtgccttccttggggcccaaggcctcttcctggactgcctctgctggagcacccttgcctacctggtgcctggcccccctggctccctgatggtgggcgggctgactgagtctttcatcatgacacagaactggctggaggagctggtggggcgactgcgctggggccctgcccctctgctgaccccccgggggatctgggaggctgaggtgacccgggcctttggggccctggtctggatccgtggtgaccagcatgcaggggacctactgcagctgcccccagcggtccaggagctgctgctgagcctggtgcgggatgctgcgggcaaggaagacatcatcgagtggctcagccgcttcggcatctctgactcccactccgatccggaggttctaatctgccctccccagcagcagaaggaagccccagccatggtgtccgtgggagagagtcctggaccctttgtggacatggggaccctccagaacaggggcccagaaaattcaaagagattatctagcctgggagccactgggtccctgatcacagcccagagcacaccgcaggaggcagcaaaccagctggtacggtaagttctggagaatgagcctggcttctctgatcctacccctgctcccctaccctaaggaaatagtaatagtttgggaccaaactggccttccaccttttcaatgaacttgggcttcctccagggtcggttccaacaaccaagatggtatggacagtgctcaagaggaagggacagtgcaagccaccagcagccaggactccacgaaccacacacaagccttgttgaagcaaaggcaggtccagaagatagaagataaactcctcttccaacctccagtatcagccctgggtgtgtgcccaccctggaaggcctggaccccggggccagcctttgggccattgtggccgggggctattgctgcaaccttctggaggatcaatgagctgcattctctacatctggcctggctcctgtcccaggcgtgcttcaatttccccttctggcagagacctctgggccccattcagttgaagctgccagggcagaatcctttgcccttaaatctggagtggaagcagaaggagctggctcctctgcctagtgcagaaagcccagctggtagaccagatggggggctgggaggagaagcagccctgcagaattgcccaaggccagagatttccccaaaagttacgagtttattggtggtccctgggagctcagatgtaaaagacaaagttagctcggatctcccacagatagggccacccttgacctctacaccccaactacaggctggaggtgagccgggggatcaagggagtatgcagttagattttaagggactggaagagggacccgctccagtgctgccaacagggcaagggaagcccgtggctcaaggggggctgacagatcagtcagtacctggagctcaaacagtgcctgaaactctcaaagtgcccatggctgcagcagtgcccaaagctgaaaatccctccagaactcaagtgccatctgcagctcccaaactgcctacatctcgaatgatgctggcagtgcacacagagcctgcagctcccgaagtgcctttggctccaacaaagccaacagctcaactgatggccacagctcaaaaaacagttgtgaatcaaccagtgttggtagctcaagtggaacccacaactccaaaaactccccaggctcagaagatgcctgtagcaaaaacatcacctgcaggtcccaaaacacccaaagctcaagccgggcctgcagctacagtttccaaagcacctgcagcttccaaagcacctgcagctcccaaagtacctgtgacccccagagtctccagagctcccaaaacacctgcagctcagaaggtgcccacggatgcagggccaaccttggatgtagccagacttctgagtgaggtccagcctacatcaagggctagtgtctccttactgaagggccaggggcaggctggaaggcagggtccccagtccagtggcaccttggccctcagcagtaagcaccagtttcagatggaggggctcctgggggcttgggagggggccccaaggcagccacctcgccacctgcaagcgaacagcacagtgaccagcttccagaggtaccacgaggccctgaatacacccttcgagctgaacctgtcaggggaacctggaaaccaggggttgcggcgagtggtcatcgatggcagcagtgtggccatggtgtgagtagtcacgggcgtggggtgggctggggatgctgtggacctggggcagggcatccctgggggacagaatgtgggcatcccttcccaaccttcctatgggcgacatggggaagagatgggagggaagtggtccatccatgttgaatggctcctgcgtgccaggcagtgtgcatggaatcctcatagcagccctcaagggcaggtttctggtttccctgtctgatagatgctgaagcaggctcagaggtgggaaatcttgcccaagatccctgagccagcaaggggtccagctggccttttggctcagatgtgtccactgccaaggtccatgcccttcccaggccagcttttaaacttttagcccaaacttcaaggcccagcacagatttcttttcctgactctgctggcccttagcgattgcccttcctccacagtacttactgctgtagaggtgttagcataaacatgtgcatgccacataatttgccacatgatagagtagttatctgtgcagagcacactcccagcacactgtcggtggccagggaatttttgtttgctttaagccctcaactgagctctctgagtggaggggctgccttcttcctcttgccctcaatgtccctacacacatgcgtacacacaggtacatgcacacacacacacacatgcacgcgcacacacacagagtttctggcagtgccctgcaccaagtaggtgctcacagaatgtctgagtatggagggaaggggagagggcatcattggtgtccttggtgctggcattgcttgcttgctgccccagggctggctctgagggaggagtggtgaggcagggtctttccttgtcccacgaccccacaggcatggcctgcagcacttcttctcctgccgaggaattgccatggcagtgcagtttttctggaaccggggacaccgagaggtcactgtgtttgtacccacctggcagctgaagaagaaccggagggtgagaggtgaggtgtcccctgcctgcccagcctccacagtgtcaccaagctttcttctctctgccttgctgccccgaccctctgccaccccagagtggccatttccacttagccctcccttgaccatttctgtcttctgcctttcacccccagagagccactttctgacgaagctacactcgctcaagatgctttcaatcacaccctcccagcttgagaatggcaagaagatcaccacctacgattataggtgtgccggtccccaggcctgccctcctgggctcagggagttgggcctggctggtgtgtcaggtggagtccggcctgtcttctctggggaaatggaggcaaacatgttgggggtgtcggttgtgcagagggtggggtggagcacgggcatctgtcagcagagggatgggcacattgaggaaagggcttgaggttggctctccccaagcccggagttgtttctgactttgggactctggagtccgtctgccttagctaacaggcattcttcccccatgacctgtgaacatcagagaggttccccagggttttgggtgcccgtttcggttgaggctcatgtctccagactgctttagtcttttcctccctcggagccccggcactggtggaggtctgtgcatggctgatgtggatggagccctgggcagggctctggaaaaggagagccctgaatgcctaaaccctgaatgcttgcctgcttgtcaatcctaagcgcccacccctcagcatggctgcaggacctctgtgctcaggggaagcctgtgaccctgcctctcttagggcagggaaggccctggcatagtcactggtcctgggttggagttgatgctgggcggacagagatcttggtttcacataggcaactctcatgccaggcagggagaagttctgtttctccacactcttcccaagacctggcacccaaccaggcctgggaagggctgggcagagaacctcactcatccctccttgtagagctggtcccctccattgagtcttcaagtgcctttaagttcaggcgtgggtttgatggaagatggcttttccgcagaccgtccctctgctgggcacttgaagagtagcatgctttggggagcccgaatggaaagtttcagggactactgagaagtaggtagcctttgctttctttcctggtcacagccctctttagaggagaggtgatccttggaaaagtggatttgtttattcaggtatgtgtgcttatatgtgttagcgtatatatgtctgtatgtcttggcatgtatatgaatattatgcattggtgaagcattataatggaatatttgtgtgtgtgctgtgtggccggcacttacctagacacttaaaagtattatctcattcagtttaatcctcacagcaacatggggtaggtattttatctctgttttacagatgcaaaaaacggaagcagtaaatacacctgtgtgaatgtggacgaatgtgagtttctgtgtctgtgcttgtctatgtatgtgcctatgcgtataacaggggtgtgtgtttgtatatacagctgggaatgcgtgcatccaaggtcacccttggatgaccttgatccctatcagtgatctcacatggctgcatagagaaggggatgggctcgggggtcctggatttctgagtaggaagggcagtgtctttgtctgacacacctcaatgtgaagctgcaagtttattttcccagatgacccaggaagtgagggggctagttactgggtcattagtgacttcccctctccctgcaggttcatggtaaagctggcagaggagacagatggcatcattgtcaccaatgagcagattcacatcctgatgaatagttccaagaaactgatggtcaaagatcggtaagatggtccccagaggcttgagccattccttccccttggatgtcaggcagcccctggcatgggagggattagggctggaagagaggccttggagtagtgcccaccagcacctgccaggatgtgggtctcagcgccatggagaagccaggcgacaacagggtgtgggtgggtcaagggctcacagtgactgtgcctcttctccccctgggcccagcttgctgcctttcacctttgcggggaatctcttcatggtgcctgatgaccccctgggccgtgatggccccaccttggatgagtttctgaagaagccaaacaggtaataggtcagacctccccagcctcccaggccctcctggggctgatcggaaacttccccttagtgttggccaacatctagtgcgtaataatgatcagagtgatctgactttttcatgtctttatacttgtgccacatgtttatgtgttcataaaccacttacagtaggttttaatacatatatgaaagcacatatgtagaatgtagttttaacattctacatgcatccttccaaactggcatttgtgctcaatgatttattagttttttcagatgtatcctatgctaattcatgtagctctgtttaatggtcatatagtgttccattacatgagtacccaatagatttttctgttttcttgttgagggccatttgaccacttccattatatgctgttgggtccgaggctgcagtgaacagccttgctcttattctttgtatccaagggaagctgtgtctagagtattcaccaagtaggatttttttctatgtttatcgtctcattcgatcctcacaacttgagttatatgtaaatgaccactgtcttcattttatagatgaggaatctgtgactcaagtgacttttccaaggtcacattgctggtgccagcacaattggtttgcagtaacttggatcctctgctgcccacctgccagttccctaggcccagcagggaacctttgtcaggatcttctgggcagagctctgcttcctggggccagatcccccagtcttaccttgccaatttggaaaaaagtgatgtggatgaggtttgtctgctgtgtcctcacaagctccttgtcaggctctccttcactttggtgacactgcccccccttttccaggattgctcatcctgggttaggctggaagccgccagtcatctcttatcaaaccactggcttacagctagtttaaatgttacttggtcagtgaagttttgattggatgagtcttcaaggcacaaatgaacctctaatactgggggtctggcccatgcatgaggtagaggaagtgtttataggcaggggcccaattgtgcctatgccatgcaagttgttggcacttggcccagcctcaggacactttggaatggggtttccacagaggtgctttccctttggaggattgctcacgatggggctgcccttccctcttccatctgttttggtgtaggttggacactgacattggcaacttcctgaaggtgtggaagacccttcctcccagctcagccagtgtcactgagctgagtgatgacgctgactctgggcccctggagagtctgccgaatatggaagaagtcagggaagagaaggaggagaggcaggatgaggagcagagacaggggcagggcacacagaaggcggctgaggaggacgaccttgactcttcgctggcgtcagtgttcagggtggagtgcccgtccctttcggaggagatcctgcggtgcctcagcctccatgatccccctgatggggccctggacatcgacctcctgccaggggcagcttctccctacctgggcatcccctgggatggaaaggctccctgccagcaggttcttgcccacctggcccagctcaccatccccagcaacttcaccgcactctccttcttcatgggcttcatggactcccacagggatgccatccctgactatgaagccctagtgggccccctgcacagcctcctcaagcagaagcctgactggcagtgggaccaggagcatgaggaggccttcctggccctgaagcgagccctggtgtctgccctctgcctgatggcccccaactcccagctgcccttccgcctggaggtgaccgtgagccacgtggccctgacggccatcctccatcaggagcactcagggaggaagcaccccatagcctatacctcaaaacccctcctccctgatgaggagagccagggcccccagtcagggggtgacagcccctatgctgtggcctgggccctcaagcatttttcccgctgcattggagacaccccggtggtcctggacctttcctatgcctcccggaccactgcggaccctgaggtgcgggagggccgcagggtttccaaagcttggttgatccgatggtccctcttggttcaggacaaaggcaagagggccctggaattggccctcctccagggcctgctgggggagaaccgcctgctcacccccgcggcctccatgcctcgcttcttccaggttctgccgcctttctctgacctgtccacgttcgtctgcatccacatgtcgggctactgcttctaccgtgaggatgagtggtgtgctggctttggtctctatgttctatcgcccaccagcccccctgtctccctttccttctcctgctccccttacacgccaacctatgcccacctggcagccgtggcctgcggcctggagcgctttggccagtccccactcccagtggttttcctcactcactgcaactggatcttcagcctcctgtgggagctcctgcccctctggagggctcggggcttcctctcctctgatggggctccactccctcacccaagcctgctctcctacattatatccctcacctctggcctctcatcccttccgtttatctaccgaacctcctaccggggctctctgtttgctgtgacagtggacaccctggccaagcagggtgcccaggggggtgggcagtggtggagtttgccaaaggatgtgccagcccctacagtgagtccccatgccatgggcaagaggcccaatttgctggcattacagctgagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagtccccatggcccctcaggtcgaccgccccctggtcgaacctgcagatcgaggtggtgggcccggtcaccataagtgaggagggccataagcatgtacttattgtggctgacccaaacaccaggtgggtggaggcattccccctgaagccctacacacacacggctgtggcccaggtgctgcttcagcatgtgtttgcaaggtggggtgttcctgtgaggctggaggcagcccaggggccccagtttgcccggcacgtccttgtgagctgtgggctggccctgggagcccaggtggcctccctgagtcgggacctccagttcccctgcctgacgagctcaggggcctactgggaattcaagagggccctcaaggagttcatcttcctgcatgggaagaagtgggcggcctccctgcctttgctgcacctggccttcagggcctcctccactgatgccacaccgttcaaggtcctgaccgggggtgagtcaaggctcacggagcccctgtggtgggagatgagcagcgcaaacattgaagggctcaagatggacgtcttcctgctacagctggtgggggagctgctggagctccactggagggtggctgacaaggcgagtgaaaaggccgagaacaggcgtttcaagcgggagagccaggagaaggagtggaatgtgggtgaccaggtccttttgctgtccctccccaggaatggcagcagtgccaaatgggtgggtcccttctatatcggggaccggctgagcctgtcactctataggatatggggcttcccaaccccagagaagctggggtgcatctatcccagcagtctgatgaaggcctttgccaagagtggcaccccgctgtccttcaaggtcttggagcagtgagcgggagcagcgggggtgccccctgccccagggccgtgggtttctgctgctaggcctccccctgtcccagcagtgctctcagtccactgggggccctcagttgtgccttttgtagagaacttgcttcataaagctttgctgaattgccttgaactagggaccagcatccccatggaaacatccccagtttggggtacttggagaatttgccaaaggctgtcagatatgggtccctggcagttttacactgggaaatggagtgctcctctaggctataccaggctcagtgtcttctccccaagtatcctctttccccttcacatgtaggtgtgtggtggtgtgcacacacactcacgaaagaatctatcttggccatgaaactgtggctgttgaccttggaattggaaccacagtcctttcccatacagaaaccccaaatgtgggctcctccctccaacctgttcttttggggaccctttgcccttagagctgtcacagatgacataagcctgggcaggctgtggggaggccgctgcctcctagcctcacggtcagctttctcaagccaggtgtggcctgcacagctctcagggcagggctggccatcctcccaggcctcaagggcagtgtcttggagtgggaggatggccagccacaagccaccagcttgtcagcatgggaagggcaagggggaaatgggttggcctacctcatttgactccagccaatggagacaattcctgacccctgctttgatggtgttgaccccacaggaatcaaggatcttgatgccaagtgtggcatctctatctgaagagctgcttctgttagacccaggggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaaatgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctgtccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactgg

SEQ ID NO: 38631 - DNA, 64360 bp, Homo sapiens
gaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgcggggccatgagcgaagccggcggccggggctgtgggtccccggttccccagcgagcgcgatggagactagtggcggcgacggccgcgttctgcctggtgtcggccacctccgtgtggacggcgggggccgagcccatgagtagggaggagaaacagaagcttgggtaagggtgctggcagcctggggtgggtttctcggtgaggctgacaacaggaggggtgcctgtcattgcgacccggtcgcgtagtggcctctcctgtcgcgattggaacggctcttcccgcgcgagaaccctagaggggtggacagggtccggggaggtgggaaccgccgcccgcgacctgacctcgggggagctgacggggtgtcgccctggccgccggtgacatgtgcaggctccttgaagccaggcgcggtgtgtcaacgcggctgccatgtcagtggcccaagaagggggctacagcccgcatcgctgcgcgctggagttctgcggttggctgcctgtcgaccgaagcatggttagctttctcgcgcaagtgagcttccaactgggaaaatgttgctgatctcacagtagttaaggaaatgatgtttacacctgttacggaaaagggggcgttcattggaacttgaactttacacattttactatttccttgcagtgttttcttgcactgtattttcataatagaatgtttggggggaaattattcaaaagtctcaagtatacctattcagtagtttttatccgtcttggaagtgtgttaaaattatcaattctatttacaccatttaattcagagtaatacatacacgaggtcctacacatgaataagaaaaaagcgaagaaccagtaggaaatgggagaaaggcatgaacggttaagccagaagaggaaatggaagtggtaaataaacatgaaaagttactcaacctccataaacgtaggagatgcagattaaaacgaggagctagctggtttttgcccatcagattagtaaatataatacaaaacacaaggatacggttctggttagttaaggaatagaaaaaaaaggcttagtgagagtgtaaattgctgtaacttattggtagtatctactaaaatttaaattgtgcacactttgattcatcagttctatttctgagaatctaccctaagaaaataaaagcactcttaatgcagagatagatccagcctgggcaacaagagcgaaactctgtctcgaaaaaaaaaaaaaaaagtgcattttgaaagaacagctcttccttggaggaaatggttcaatagggtacgttcatattatggaataatattgagacattaagaagaaggaagtacgtcactggaagcctatccagaatatatttccaaaacaaaaaaaaatgcaagttgtagaataatatgtatagtatcatcccatgttttttttaaaaaagaaaaaaaaaatctgagctcagaaaaaaagtggaacgaagattatctcatggggttaggctggaggggtggtggaaccatcaggtcttactttatgtactttaaatcattgcaaagagtcttgtattcgtttctaaatagcaataaaggtcacttgatggaaaaaagctgaagtatcaaccatcaaaataaaattaccggtaaactctaataaatatcttacattttctctcatatgaatttaatgtatcattgataagttttaccaaatatctcactctgtgaatactttacatatgttatctctgtactccttcctatttcccaatgaatatgatccacatttgcaaatgaggaagttgagacccaaggttgacttgttcagccacaaagctagtaattggtagagccagcattcaaacccaagcctgtctgatcccagagccaggctctctccagtatgttgcacgttcattagacttggaagagaagtatcaagtctgttaagaaccacaagaatcttatttgactatcactaccctttcttcattttttattaaaaacttatttgtaaaagagtcattggataaatcatttttgaccaaaattagtttttaactggaaaagttcaaccaaattggcttgaaatttcagctcaaattttgagatcatttatgaaagtgaaattacaattatttaggcttgttagattgctctacccttgagtaagggtagggtaagaatctagagctataaacgacaaatacacaattatatgactgctttctctgggaattttcagaaaactgaactttgattcattaggtttacctgtgcattttttaaagcccaaataatgattcatgataaaaagcagaaaatgccccacccctttccctccccaccaacaaaccaaatagttgataaagactggaattgtcatgaatagtaagcaattgctcaataacttacactttgtggaattacttagctggttatatgtagtcttatccttcatggaataagctttttggttttgtttttaaaattttgcaacagggtattttgttaatgttatgttttcattaaaaaatgaagtagaaaacaatccagtttctatagcacgtgggcaggagacgtaactttagaaaaagccgacttggcctggcatggtggctcatgcctgtaatcccagcactttgggaggctgaggcgggcgaatcacctgaggtcgggagttcgagaccagcctgaccaacatggagaaaccccttctctactaaaaacacaaaattagccaggtgtggtggcgcatgcccttaatcccagctactcgggaggctgaggcaggaagaatcgcttgaacctggaggcgaaggttgcagcgagcagagatcgtgccattgcactccagcccgggcaacaagagcaaaactctgtctcaaaaaaagagaaaaagccgacttacagaaattactgaagagtggtgtaatttttgaactgggtctgatttccaatacattttaatccagtttttgaatagataaaacattatggaaatttttttttctgttcagtatagtaattattataccattctgtatttaaatgtgactttgttaggcttctatgtgtaagagcaatgatattaaatagctccactttgaaatatgtgttctaaaatttgctcatcatatgctgcataaatgtaaggattggaaaatagtgtattctccttgtatgcaatcatgatttacttacagtcttgaaaattgaatgcttgtaaagttgagttagcaagttaaagcttatgtcatttgtaatatacatgtctaggcactaccattgccaattataggaatttctacttcttggtaataatctcgtattccatttcagggaaggaaaaaaaagaggacttccatcttccattcattgatatgagttcctgaaagggacattttaaacttttttttttctgcttaggacaggataagagtctagagctgtaaaccacaaatataaaaattatatatatataaacatatatatatatgtaaacttacaaagaattagtgctttagcaaagtggtggtaaggtctttttttaaataatgaaatgtttttaagtggttattattcatatgttgtcaggacttaattcgttcacaagtttgagtgtacttgattttgttggtgttcatagtcaggatctggaactgaggtcttttctgtttgctagctctattattaccagtatttcataatctgtgattatagttttaaaaatgacaattgcagtataacaggaggcaaataaaaatatagtcagcaatttctttaacacttttttcaattcttgccatcagtgattggaactttggtaaaagaaaagttaataggccgggcgtggtaactcacacctgtaatcccagcactttgggaggctgaggcgggtggatcacatgaggtcaggagttcgagaccagcctggccaacgtggtaaaaccctgtctctactgaaaatgcaaaaattagccaggcatggtggcagacgcctgtaatcccagctactcgggaggctgaggcaggagaatcgcttgaacctgggaggtgaaggttgcagtgagctgagatcgtgccactgcactctagcctaggtgtgacagagtgagaccctgtctcaaaaaaaaaagaaaaagttaataaaaaattgttaagctgtgttttcctttgctaattatttggccttgtctggtcatacaattaacttgtactttttcctgtagtcctcaagtccctgaacttgagagtgcttaattgaaaggctgcttcctcagtcgcaaccttacaggttttgatttagtaaaattctggtgtagtgatcagacatctccattttaaacagtggttacggagattttgtgaaacagaattcgccaaaacacacaactctctttttgagcattagttttctcattttggaagtgaatactatttatttgatttttgacagtttttttagagtagagcacatcataaaaagtatcttttgaaaatatgacaaacattaataaatatgtacttaaactaggcattagtggtttattcaatgtaagtgcaaaggcagaggcttcataaagcgttgttatttcatgtcactacacacctgtgtacctctctcttagtagaacatataggggaagcaataaatggcaataataatggtttttttaaagggctgtccagcaaaacccccgcttcaagacagatacgttaaataattgtgttaagaggtcattgtttttctgcatcagatttccttctctgatgatggcatctatcattcatcagttttcttaggaaaaattataagatgaattgtacataaattactagtaatcattaaagtttggctcagctctgtgtggtgagttcatgaaagcttgtctgctagctgttgtagtttctgattctgtttatgtccctttctacctaaatttttcttttgtttttattggtatattttttatgaggaagaattaactttttgaaagataataaatagaatatacttacctttttttttttttttttccatttctgctcttttaaaattaggaatcaagtactggaaatgtttgatcatgcttatggtaactatatggtaagtaggaagcttatctttacctaccatttatgtgagttgattattatgtgagcacagtcaactgggaattttgaaacctacaatacaattacattttttaaaaggaagtttttaaaaaacagggcaaaaatagtctttctggtagtggtttttagggaaccagtttattgaacagataagaataaattgaaattagattatgaaacttcattatttaaacagcttccttgggtgccatcaacaattatcattgagtgctttatatagctagatattgtggatatatacatgaagatgttatctctggtcttaagggagattattctcttaatttaaaaaaatgtttacaatatttatacactgaagaaaaccattgcttaaaagagaaattgttacttagcctctgtcctaattgtatcctcatggactctgcactgaatatattttgctttttagtttgctgattcatattatttaaaaatgttttagggctcacttaagattaaatagcagtttcagttttacaagatgaaaagttctggagatctgttgtgcaacaacgtagatgaaatagcaaattctggaattcaaaaaaaattttgcacataaattgtaatttgaaaagagtttaagcatattatcctgaaacttatcccttataaccttgtttttacattttaaaatatgtcagcagattttcttctatgattacaacgtataaaatgtagttgggaaagtttggcagaggactagctttagttctgcttaaaatatttttcaactgattctgtgaatccattttttatcatatattaaccaaatatcttcatacactaacatcattgttatctatgaacatctaaatatatgtaatttatgcatttttagttttaaaacatgttttatatttgacagtcctcgttctcttttatattgtaaatttggagagagcacattttgagttcttaatgtttttaggatatgattttttttggatacatttcaacattaaaaacacagtttcaaatttatttctcaagacctcagtcattcccttaatgttttttttgttttttgttttttgtttttttttttgagacggagttgtgctctgtcgcccaggctgtggagtatagcggcactatctcagctcactgcagccaccacctcccaggttcaagtgattctcctgcctcagcctcctgagtagctgggattacaggtgtgtgccaccatgcctggctaatttttgtatttttggtagagatggggtttcaccatgttggccaggctggtctcgaacttctgacttcaagtgatctgcccacctctgcctcccaaagtgttgggattacaggtgtgagccattacacccgttctgttttttaattaatttttttttgtcacccacatgtcaacccttatttctttcaaaatcatttatccctggttaattcagtttgggcaaagcataatttaacaaatctaggctaatgattttgagatggccaagtggttccatcctataccctcagaccttagccatctcataaatgcgtactgatgaatgcagttccaaagttaaataaaatagcatatagctggataagttcagtttctcacaatgaataggatcatctctttataaagcatggtatctttaatatcttgttctttttaggtagaacagttatatcaatggcagaaagttatatcaatacattttttctaactatagaatacacttagtaggtttgtgacagtgcaggtactgagggcagctttcagaggactttctggcctgtgcctattgggacctaactgagtaactttctgctacaattaactacttaataagatttaagagagaaggatttcagcttcaaagactgggaactcttgaaagtaacattgtcttatatatttccagtgggaccatacgtgtccactgtaatatgtattttaaaatgttcaactattttacaatgtgagtgactcttgctgtgtacttcttctatattcaatctgtgtgaggtctgtaacccaagatttagtctagaatttacacttcctcttttcaagttctcaactaacatgacacagttctaaaatattaacgagaatacagttgccttgtatttgttatttgaagtcagttggaaatttttttccggtccctacactcagaaacacttttagctttctgtagggtaaaagtgtataggttttggagttagaagggcttgagttcaaatcctgtctcagctatttacaggttggaccctaaacaggttatttaacccatctgagcagtgtctttctatgtaaaatgagaataattgcaaagagttattgtagactatagatttttttttaaagaacaggaaccaatttctttaatttttaatacattcaccttttttatatgtcttgtgcctggtacataaatgcttagcaaatttttttgaaagaactgaattgaattcttgtgaagatgaagtaaaataatgtttttttttttttgcatttgatcattgtgatatatctttgtgtttaaatgcaaagaaataataaacttaattaaaaatacaagtttaaggtgaatttcagggcctgtaagtcatttacttttttgtagtcagttgcctactatcctaaaatataaaatgcctggtacatggcaggcttttaataaatgttgaaagtttttcctcatttctcactagttctttctaatactactctccagtctggtctacagtagaacaattcctttaaccttcttgcttcccaggaaagcagtggtgttttccaaagacaagcaatatagtattattaagagcaagaactctggacttggagcaggacaccctgagatggctctgccacctctcatctgggttacaatgggaaagttacctagtcttcctgagcctgtttcttcatctctgcaaaatgaagacaatggtttgccagcctcacaatgttgttagaaggattaagcaagttaatataatgaaagtgcttagaactaatatctggcaaataggaagcatgatgtaagaatttactgctgctactgataacgactactactatcattattatttatttcctgcctaaattgaaattgccctcctaaaatccacttagcctgtaactcagaacttgttctccagatagtacatagaacttgcttaaagcgcatacattctttcctgttcttggcatgtgccctttgaacttactttctattaatgtaatagaaggttctattaatgctatttcttaatagaaatgtcctgccagctttaggtagattactacaactctgccatctctggacttaaatctagggatttttgggtttttaacacttattggcatgactattaataacgactatgtttgacaaatgtctagccccagtcagtctgcagtttacccacagtgaattgcacagatggctttctcgtttaccaaatgacatgaatttgatgtttatcttagcagttcttgtgtgaccttatttaaccccaggccacagtcactttagggcttctgttagcatgttttgagtatttgtgttcagtttagtttgcagattaatttagatgacaaaatgacatgtatttgggccatccaaatgtagaacctttttggagctcccagtgtttttcctgtctgtgttagacaactcaaactgttacaagcaaaaactatattctggtaagagccctaaacattaaaaataagcttggatagagttggtaagcacaatttcctttagtagaatcgtacctaataaccactattaagcttgattttgtgaaagcaacagtagaatagtctttattaatcaaaccaaaggaactctttcaaaatgaacttcctgtgcatttctagatttatgtacatttttttggagtgcctctcccctaccccccaatgtttaaaaaaaatttttattgttgtaaaatatacataatatgaaatttaccattttaaccatttaagtttacagttttgtggcattaagtacattcatattgttgtgcattcatctctagaaattttttcatcttcccaatctgaaactctgtactcggtgtttctctttaatggttcattcatcagaaacagtaattctgtaaacaaagtattttaggcatggtactaatgggagtaagggagatataaatttatatttacctttttttgtgtagactgttgtgggactatcatctatgagtcattgttccttggcctttgctttcagaacatcctaaaaccctaccaaaattacacaagaaattctatagtatcctctcaaaacattttgtaatcacactctgatactctacatagaattttaattcagtagaaccagatcgttcagctaattcatcttttttagatataatttacagacaataaaatttcaaattgagtgcacaattcttttttgacaattgtatacagttgtttaaccaccatcacagtcatgatacagaacattttcatcaccccaaaaatttaactcatagttatttgcagtaaattccttctccccacctctgacgcctagcaaccttgatttgtgttttgtcactacacctttctctttcctaggatttcatatatatggcatcatacagtacatagtcttttgatttactttctttcatttagcatgatgcttttgagatttatccatgttgttggagatatattgtaattcctatttattgctcagtagtgttagttgatttgctagaacacaatattggagatatattgtaattcttatttattactcagtagtattagttgatttgattgaacataatttctttgtccattcaccatttaatgagtatttgacttatttttggtctttggctattattgtattaataaagctgctgtcaacctgtgagtgcaagtttttatttgggcatacattttcatatatttcccacctaggaataggattactaggtcatatggcaagtgtaagtttaacttaataagaaatgccaatcttttctaaaatggctataatattttgcatttcccaccagcagtgtatgagttttaattattctgtgtccttccacttggtatttccagtcttactaatttcagccattctgttgggtgtatagtggtagttcattgtgattttaatttgatttttcctgatgattaatgacattgaaaattttcccatatgcttatttgctattcatatatatatatatatatatatatatatatatatatatatatatttgtcatttgttctgttattactgagttataaaagttaatatgttctggatattagtcccttatcaaatatatgctttggatatattttctcccagtctgtgctttacattctaattttcttaacaggaacttttgaagcacaaatactttaaattatgatcaatccagtttattatttttctcttatgattcatgccttttatagcctacctaaaaaatatttgcctagcccaatgtcacaaattttttcttgtttttttttcctagatgttctataattttagcttgttcattagatctataactgattttgagttaatttttgtatatgatgtgaggtaaaggtggatttatatatttttttaatgtggctgtctagttattccagcaccatttgttgaaaataatatcctttccctactgaattattttgaaatatgtgtaaaaaaattggtttatcatgtatacatgggtgtgtttctagactctgtattttgttttgttgatctatctacccttatacaaatatcacattgtcctgattattgtagtttaatagtgggtcctgaactcaggcagtttaagtctttcagctttgttgttcttttttaaaattgctgaagttaccagatctaggagcaaagagtcagtttttgatgctgctttgacttgagtggtttagagcagaagtctgttacctcaaagccctagtaaatttagagtctgatatggagggtctattatgatttattttattttattttattttatttttgctctttcagctaggcacatgttctacttaatttatataggactctcatcatctgagttttatttctgagtgataattattaaatgtttctcatggctctgagtcatatcaatatgaattacgtatccctcaacaataaactgtgaagagagaggaggtattactgtgcctcaaaaagccaggatgtttgaagcttgataaggctgttaatttgccacgtatgcattgctctgaatttgtgcaaactgtctgtagtttgctttgtggttaacccaaagaaaaaggtgtggttgtatttttattcttaatcttgaaacaaagagacaaagtatttttacacctggtttgaaactcccttatttgattattctgggttgcaattgctattaatatttttattatctagattaatttcaggatttgaatggcatatttaatttagagtttgaatttatattaatttcagacagaggtatgtgtgtgtctgtgtgttagaaaaccctaaaaaacagcagtatgaagttttctatgcagtgtttaaaatagtaaggaactgtttacaacctaattaacatttgaatgatgttttacaaagattctttcaaaatacattaggaattttaaaaaatttttgtatttcttctaagtgttgtttatatgtgttaaatataaaactataaagcaataaaaatgtacattctgggaaatcagttctgttggaattgacacataaaagagtagtcaggaatttgacacatgaaaagatacgtgtaaaagtaattaggggctgggcatggtggctcacgcctgtaatcccaacactttgggaggccgaggcaggtggatcacctgaggtcaggagttcaaaaccagcctggccaacttggtgaaaccccgtctcttcaaaaagacaaaattagccaagtatggtggcgcacacctgtaatcccaactattcttgaggctgaggcaggagaattgttgaacctgggaggcagaggttgcagtgagctgagattgcaccaccacactccagcctgggtgaaagagtgagactccgtttcaaaaaaagtaattaggaatttatgctgaaatattatatataatattaaaattacatggtattgaactcagaatttagtagctgtatgtggattctgatgctatcaaaacatgtgttgcctagaatcctctacccaggaatggatcattacagagcacgcaattttctaaatgtctgaaaggttgccatcttcaatgcaaagtattctttaacctgctttgaaagttatttccccccctttctgtgtgtattttttccttccctttcctatgtgtttagtgttcctggccactagtctgtatttctgctgctaatttgctatgagtttggaatctaaataagttgactgagaggcagtaggagagagttggacatggaattgggagtttttttgctgaatttcaagaactaagaatcatatggacattcacataataaaaacaagtcatatacaagatacaaaagaccactctagtcttagaaactttgccatagcaacacccagcaaatgcaagaagagtatagaactgtatcttcaaacttctgaaggaaaaaaaactgttccagccattttataaccattcaaatttttcttccaataaggcaaaagacagcctaacccaggaatatcagagaactacaatacccgttatactcttattttaaaacaaataagcaataaaatacctgagtatatcaggcaatcaagagatgaacaaagtaaaaactaagaaattggagaagccttagaaaaatgctgtgcatcaattccacttgggttctaacactagcaacttggggaattatggttccagaccagaatgtagatgttataaaccttcaaagtctttgtcaaagcatcaaaacttttctttctgatggttataaatataagaaaaatgaaaaaaatagcaaaactattatttactatatggtaattaaaaatattagaaacattgaaatttaaggtcatttcattttattttttattttttatttttatttttttttgagacggagtctcactcttgttgcccaggctggagtgcaatggcgagatctcggcgcagtgcagcctctgcctcccaggttcaagcaattctcctgcctcagcctcccgagtagctgggattacagatgcctgccaccacacccagctaattttttgtatttttagtagagatggggtttcaccatgttggccaggctagtctcgaactcctgacttcaggtgactcacccaccttggcctcccaaagtgctgggattacaggcatgagccaccacacctggccttattattattattttttaaacaaaagactcattaagagtagtttaaacagtgctttctttgctgccttctcattgtataacttcagttacagaggaggcatcttttctatacttggtgaattggcatactcctttctaaatttggatcagcttcaaatattttgtcctttgctctttcagtgtcatgaaatatctgaggatttctttaatgggaagtttttttgtgggcatagctttttctgtgacatcttcaacctttatgtcacaaccactttcttaatgtgtgtcaataacttggcctttattaagtttctgtggctgcttatctgtagtctcttgaatggagaaagtgtcgacattcccatggtcagctaaaatttgttgataacctcatttatgttcaattcaaatttcacttcgtgttgtcaccttttatttctttgccagactctcatgtttgttggctaattctcctttgttcatttttgtaaactattacataggattatcacggggcgactaggaggcaacatacactcacctctgtgtgaactgagtaaacagagtgatcattcacttgacagactttgaaagaagtaatgtgattgatcactgatcatgatgagcatgttatttacatagtgatttgtggactaaagagctagcatcaaagtttgtgttttacgtaattacagttaatatatcatgataactgaaatttgaaccatgttgttgggtgtgtaacaaatttgtagtaattgaaacttgtgtatagtgagaccgtacaaagtgagactccctctaataacataactgacaaaaatcctatattgagggggagaattatgagtatgttaatcctattattcttggtgcagggagttagtattacctaaagttgaaacatgtacttaacacgattctaacctcaaaatatttctcataattatattttattaattttagaggaatgtttcagaaactgtctcttggtgaaggaaatataaagatcagcaggtctttatggtttttattcttttctgttaagacccgtggcaagtaggtagaaatgttctagtccagtttcacaaaagcaaccacccaacttaaagagcctagccctggctcgtggccatgtatgcagggccaccagcatcaactcctatgtcctttgggcattaacataactcccgctaaaatctgtctttattcctaatacccatgttgtggtcagtgcagctttatcttctatactccaccgtttaattttggtacttgaaaatttcttactctcaagctcaactatgtgttaaaaaataatttataacatttatttagcatttcattgtgtttgtagtgggtagggaaggaagattcctccatgtacttcattaccatctacaccagaaatgatctgtcatggtcattattaaaataacaaaaatcccagtaatccaaactataaagtacctattaataaatattaagaaatatgtgcaacctataggatgaaactgaattcataaaagaagatctgaattaatacagtgacctactgtattctgagaagggaaggctcagttgctaaagatatcaattctccccaaattcagttcttccaattaaaatttcagtaaaatttaaggaaatatcaaagttctccagaagggtaaacttaataaaataatttttatataataaaataatggtttattgattttaatgataaaataattaaaatttaatttaatttttataattaatgatttaaattattacttttaatcttaattattttaatgataaaatagttattttaataattaaaatgaatttaattaaaattaatttaaatttaattattttattaaaattaaaataattttaatgataaaataattaaaataatggttttggagtaggaataggcaaatagatctgtagaatgaataaatactacagaaatgtgttcgcaaaaagtttagaactaatgaacccaatatttcaagccattggggaaaggatggattgttttaaaagtagtatttagaaaattatctatttttggggagcaaatgcagttacattcctatttcatattataaatgaaaatagattccagatggagtaaatatctaaatataaaaaaagtataacagtgctattttcagaggttcagggtatccttttaagcatgcttgaaagccagaaaccataaggtgaaagcaagataaagttaaaagccaaacaaaagagaaaaatgtttactgtgtgtgacaaacataatgtatgagagtctcttgtggccaaaaaaagcaaccaatggaaagatgggcaaaagatcaacagacatttcaaaaaagaaataacaatggataatacaaaaagatgtttatccttattagtaatgaatctttagataccatcttttacctaggagtttggcaaaatgtgaactattgatcatttcctatgttagtgagaatgtaattgagtgtagattggtgtcctcaatttgtagcatttaccaaaaattagttacacatacctttgaccctaatgggtctatttttaggtatctgatacatagaaatactggcatatgttcaaaagatacatgcacataggtgtttattgcttcattgtttgtatagaaaaaaattgaaatcaacctccatgttcatcagtaaagggatactttgaggaatgggtactgctaaggggatagactctggagtcagggtacctggctttgaattctggatcatttactagatgtgtgatctaggcttacttaacttctctgggcctcagttttttcatccatgaattagagataattgaatctacttcagagcattgtgacaattaactaaaatatatagatagaatatcacttagaatataagtactcattaaatattagctaatgttatcagtttgtagttattagaatagagtacatctgtaacattctaaaaacgtgggaagaaaactccattatttaagtgacaaatgttagagcaatatgtgcatatggcatgaacacctgttcataaataaaattttagaataatatatgtgtatgtatttgaatgtatgtgggataaatctggaaggataaatgccagtcttatcagtagttagctctaggaagtgagattggggaggggaggggaagcagattatcagttttttaaagaaattttttggtattgtttgacttttttccaagcatgtattacatttgtaattaaagatttttgaaaagattccacagggtgtaaatttagtacaacttttgactattattttattttttaactgtgaaaaagttatgttctcaaaatgatgtgtgctttcgcttattttccttagtaacttactaaagttttccttgcaggaacatgcttaccctgctgatgaactcatgcctttaacctgtagaggtcgagttagaggccaagagccaagtcgcggtgacgttgatgatgccttgggaaagtgagtattaacacagggcatggcatggcatctcagagttcccaagtcttagacttttacagacagtttacatataataatatttctagggattggctaaattttaaagactgttttatgtattacattatgctcctttattcccttctgttatcatttataaaagattaatcagtttacatcttggatcagagaaaagttagttgttaagctgcatataacttaaaatatatgtaacttttatgtaacttttaaaatatttataaagtcattagcacattggactgttgatgttttaatattttcatttgttttcagagctagtgaatgtttctatgactcttgaagatacgtagattcattgaacataaatgtaaaggcttttcagtttctttcagagccttataggtttcattgtactatagatacatggaagtactaatttatagaaactaccagtcaatagaatgtagataagtctacttgtacattcataaactatttaggattctaatgttttatatcttgttaacgcttgtttcttagattttctctgacactgattgattctttggacactcttgtggtaggtttgactcttcttggatttattttattcatgatatgcacacttaagtattatgaatatgatcataacacagtaagtatgaaatagaagccttcagaattaaagatgttctgatctttgcttctaaataaatcttttacactgttgagttgatgatgtcaaatggaattatgtaatataacagagatacccaaataatttatggggatgtcagcttatgtaatggcaccttaattaggaaggtccttttttcccccctttggacaaggaggttgaagctattggaaaaaagtaactttagaaaatatcattgatgttgttccataatgacatgccaaaatgatatcaaaattgttaaattagaatctttatattgctgtgttcataagcaaaaaattaatttttcccagcagtgatttttagcatcaggtgatcacttcttggtactccttttcaacctcatatagtacagaaatttatttctggttcaggactgtttgtgatgacagaggggaaagattgagttacagatgtcatgatttctaaatacagtatctttttagttttttactcttagatcattatggtataaaagtaggcttttgtgagaattttccttaaggcataattctcaacttccagttaatatcccaagtggtgattaatatttaaaaaacaaaacaaaaaacctttggggtatcagaaattttttggaactgggcttctcaatgttgtttctgcattcttctttcactggagtattttttttttaagaacgaaaattctcaactctaaaagcagcttaagaggttcacttgtgatttaaaaaaaataggtcctcctaagttattctgattcagttgttgtggagtgggactgggcatcccttccaaagctctttggttcaaaaagatgttatggttgagaaaaatcacgattgttagatctttttagctagtcagggtttgaaagtcacagcttcattttttggagattaatggaatatgcaaactatattacagtaactatgagaaagagaaaatactgtgtgccttgtttttggtttattggccttaaagaaaacatatggaagagtctgattacaagctagaagagttcaagaggcaaaaattcccaggagataaacccagggagaagaattagattaacaaagtgatactaaaatgtatatgtgtatggagggtggggatagtggaacagttatgtctcattccaaaagtgatagatgcactgtatgtgcctgcatttattactgcccacttgatgtggactttgagattgagaagggagagctgtcagtttaaaatcaggtttcatgttatgttttagtcaggacttaccctaaattttacttttactgaatttagggagatactcttatggaatgttttataaattagaatttttacgtatcaaatcaagtgaaaaagcacaacaaattattatcaaacaaggagagattaaacagttaagtaaaggaaaactacttttaatgtacttaggctctaggtaacatctcatgggcggccttaatttagactgaaaaatcatagcagcctgtgtgatgacagggactacttttgctgctcattgcaagaatctacaaaattcttagtttagtcaggattctagatctgcatggttaatagttgtaattattttaagcacttaagtcagacactctactaaaatcattttacatacattatcttatttaagaaaacaaccctataagagtaggtatttcctctttttatagatgaaggaacaagctcagaaatggaagtaagttgtctgagatcacaagggtagtgagtgaaacaaccagaattcaaatcagggcatgaccacaacattgtatgaccacaacattgtatagcctccttagtgaacagggcatccatggagtgaagctagcaggtgatgtatagtttaggaacaattgaacatgccttgaagaaagtgctttcttctgagaataaaagcaacttttagaatgtatctggtgaataggatgggttttaattttgttttgacttagaagccaaattctactagaactcacctcatgtagcctgggtcattaagaatccagttaacaggtctgatgatggtagcttcaaagtcctcataatatttcggtgtatgcaaagaagtgtataaagatgctgtataattagatacttaatttttttagttttagacattattacatttttataatatacttagaaatattatttgtgtatgtcactttttagagttttaaagtagactgacttttaatagctcattctaggaacgtttctccttgtcttggtagaaaagaactttatttcataattttcttctcccaggttttaaataaaactaaagaatttgaagatgcagtgagaaaagttttaagagatgttaatttagataacgatgtagtcgtatcagtctttgaaacaaacatcagagttcttgggtaagtatgaaagacactaaagctataattttattttatttttatttatttatatatattttttgagacagagtcttgctcagtcacccaggctggagtgcagtgacaatcttggcttactgcagcctccgcctcccgggttcaagcgattctcctatctaagcctcctgagtagctgggactacaggtgcataccaccaagcccagctaatttttgtatttttaatagagacggggtttcaccatgatggccaggctggtcccgaatgcctgaccttaagtgatctgcctgcctcggcctcccagaatgctgggattacaggcgtgagccaccacgcccagtctataattttaatatcagaaaagtttaggatatactgtttatttcttgatggtaatcatgcaagaagtttcctgtgtttaaaagatgtaagttggaacattatgaaacacagagtctgtggcattaccttgtatttaatcactcacagacgtctctagactgaaaggtaatatctgtatgttgttaaaaagggaatataggttgaacattagtcagcttcatcacaggttttttcaccagcttacgtagtttgttaaccatagccaagcacctcttcaggtaagccaaaagaaactgaatgtataagattacctctcaacaaacagtttgaaatgctcttgggcctttttttttttttttggagacagactctcgctgtgttgccaggctggagtgcagtggtgcgatcttggctcactgcaacctctgactccctggttcaagtgattctcctgcctcagcctcccgagtagctgggattacaggcacctgccaccatgcccagctaatttttgtatttttagtagagacagggtttcaccgtgttggccaggatggtctcgatatcctgacctcgtgatccacctgcctcggcctcccaaagtgctgggattataggcgtgagccactgcgcctggccaggatattttgaaaagatgaaattacaggatttattagttcaagtttcaatattatttaatttttatagttttgattaaatgttattgtaactcctctttgtcaaagtgagtctactcttcaattaaatgtaagaaattgttatgtagttttacacagagtttattaatctagagcgagaggtttttatgttttaaataatattctaagttaaagacttcatggtgatacaactaaatttttaaatttaaagtttgttaaaatatttgttagatttgttaaatgtagtatctcggattttctttaagaaaattaaagctatttaagaacgcagaacacttcacaacaggatagaatatctaattttttaaaaaatatattgactctgtaattgtaatggcttaccataaaatgagcagtgttaagtaaataatgtttaagtaatttttgtctttccttaaatatgttaaattgtataacaaagtacccacacctttttagatggtaacttttaattgtctataagatatggataatgtttcatctctgtgatcctaggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagagtaagtacttctgaaaaatatgagtctttatatactttctttgctgttttacaaaatgaagttttgtgatcagagccattgttcttcaccagcttgaggctgaaaaaaaaatgcttcaaagctatataacaaatttatattttcatttcaattaactgattatacttctaagtgatgtgataattagattagtttaagctttaaaaaagttttatttctgatttctgtgggtacatagtaggtatatattaatggggtatgtgagatattttgatacaatcatacaatgcataataatcacatcagggtaaatgaggtggccattacctcgagcatttatcatttctttgtgttacaaacattccaattatactcttttagttgttttaaaatgtatgatacatttctgttgactgtaatcgctctgttgtgctattaaatactgtatcttattcattctgtctaacctgtttctatacccgttaaccatcccctccctattccccatccccaccacctacccttcccagcctctgataaccattgttctactctctatctccatgagatcaattgttttaaattttagctcccacaaatgagtaagaacattcaaaatttgtctttctatgcctggcttatttcttttttttggtgggggggaatggagtctcccactgtcacctaggctgaagtgcagtggcgcgatctcggctcactgcaacctctgccttccaggttcacgccattctcctgcctcagcctcccgagtagctgggactacaggcacccactaccacgaccggctaattttttgtatttttagtagagatggggtttcacagtgttagccaggatggtcttgatctcctgaccttgtgatccacctgcctcggcctcccaaagtgctgggattacaggcatgagccaccacacccaggtgcctggcttatttcatttaacatagtgccctccacttccatccatgttgttgtaaatgacaggatctcatttttttaatggccaaatagtattccattgtgtatatgtaaaatttaagctttaatgtgtcattacattacagattagattatgctgcagaaggaagaacagatgctagaccagaacttgggcacagaattatttgtgtagaagatataattgaagcagttagtatgtaggtgttaactgtccaaaggagaggacagagagagaactcacaggacagagggagggcatgaggaggaaggacagccagtggaaagtaaagtacacagagatttaagaggagaaccgtgaagtagtgtagtgtacagtattataaaatccaaagaagggaacttcgaaaggaggaaatgttctagaaaacttgagaattgggtgcaaacagagccttgaagttgtagtgaataaagaggaaagtattcaaagtaggtgaaagtaaataggaatgaaccacttattttaagatttcttctgtgttgatagttaaaggagagttggcaataaagtcagttgaaggagttttattggttttcccctaagaaaattttatatttaaagcagagggaaagaagccattgaagatggaaatagctcttctgatttatttctcattctttattaacactattactctctccctcttatccaagacagatacctcagccattagcaagctctgtcagtttttttcttttcttatgcctgtcttattctttctctcttggtttatgcttcagagcacttgaaaaaccagtatcactaaaatctaatttttgtcaaattatcttcaaaaattgtatggctctttttattgtattgagtgtcccttaactttcagcattttttgtagtttggcagtagactttctgacattctctcttatttccatatcccagtgaaatcattgttccatttcagctagaacaatctatagtgtccccagagtctctaagtttttttttttttttcattccatgcctttaggcttaccatctctatcacccggcataacttctctacaaatataagtcaaatcaaataaggctcatttcctccatcaagaagtcatccttgactggagatatagcatgatatagggcaatgctttacctatcaatttagtgagttgtgactagcactttttaaaaattaaacagactagaatgaaatctcttcttgtttaaatttctagttgatattttaaatagctctctggtaaacattctttttgtttgtttgtttgttttgagatagtctccctctatcacccaggctggagttcagtagtgtgatcattgctcactgcagcctccaactcctgggctcaagtgatcctcccacctcagcctcctgagtagctgagactacaggcacgtgccaccatgctcggctgatttttaaaaaaaatttttgtagagatggagttctcactatgttgcccaggctagtctcagactcctgggcttaagagatcctcccaccttggccttctgaagtactggactcacagatgtgagccatcatgcccggcctctgtggacattctgatacacatctttttatacatttttagtttcttgcttaggataaattactcgaagaggaagtaataagtcactgagtagggaatgctttttaagatatcaggtacttgttgcccaattgcttttcagaaagattcttttttacttctcagtgttgtgtaaaagtacatgtgtcatttaaccgttactgtatattattattttgccaacttaatgaggaaaaattgaattatattttaatatggatttctttgcttattagtacagttaaatttgttgatcatttttttcttagcatattaaattaaaagcaaagttttttaaacaatatataaacatttacttaattcagtttacttttagtaaatacttttagtttttgttataaatggaggtgttagattttgaggaatctagcatttctttacttttgccgtaacatgagaagcaggcaaggaattaaaacagaagatactatgagcgttatggtaaaacagagaaacttatattattttcttatactctgaagtgtcaagaaaattttaaaaatgattttttataataggacaatagaagaaaaataactgctgtcccatcctttcttatacatgcttagtatgcttttgcccatgaaaatttgtgtaatcagtctctcttagataagcatatgtaattgatagtatttgcattaatggttttaactcagaagaatgtactgtacagaaatggtattgtaagagttggtcattttttaaactcatatataaactttagagctagtacgtactttgtaatgccatttcctcaaagttaattaaaagcaacttgccagcttttcagataagacctcattacaaacgttgagtagatgattatatccataaaatataaggttaataagaattctattatgatttatacatattttaaggattttctagtgtagcaaaaagacagtgtaaacaagtttagtgtaggtaatttatgcctttactttgcaataaaaaagtgtcctttttaaaattgccttgtgactctcaggaacacagaattaggaggaaccagattctagattgcctcatgctttattttattcctactttcatctctttttttcttaaacctctcaagaaagcaggacaataagctccttattactaatttctgcagtaatatatactgctaccagtgccatctctaaacccagtcatttgagtcctagtcaggaggacaagaacctatctaccagcccctagatccaccagaggatcccgtaagcaaaaaaagcactgaacccttcttccctgatttgtggaaatggtagtgcctcttggatgctgaaatgcatcttggttctgcatttaaaagttctttaatactggctgggcgcagtggctcacacttgaaatcccagcactttgggaggccaagtcgggcggatcacgaggtcaagagatcgagaccatcttcaccaacatggtgaaaccccatctctactaaacatacaaaaattagctggatgtagtggtgtgtgcctgtaattccagctgcttgggaggctgaggcaggataattgcttgaacccgggaggtggaggttgcggtgagccaagatcgtgccactgcactccagcctagtgacagagtgagactccatccccacaaaaaattaaaaaaaaaaaaaagttgtttaataccacttatcttcaggaaggatacaagatttaaatgagcagatactatagataattgtgttaataaatagtccttttacaaattttatagcagtcatcttggggtacagttcaatatacaaacatcttaagtattattgtactaaaacgctcatgattcaaagtatttccattttaagggaaaagatactgaaagtggaatacagagatgtttattcttttctattttgcttttgctttcttatgactactcttagactttgtcattcttagctctcaactactcccaattcagtgttatttccttttctgaaattcacattttagcacttgtggcttccatttgtttggcacttaatttatgacttttcattgtcagttattttctctatttatatatctgtcttatttgctctgtctggattttaagctccttgaggacaaggatctattcctttgtatattatcataatatcccccacatggtaggtaagtaagcaataaatattgattagttgattgtagtaattaatggaactgaccagaaaatatttttcactgttgattcttattgcaaatatttgtaaaattatactttaccttagtgtaattcatgtgattacatctttattttattattaaggattgcttcattttaggttaattattcttagtatcaattttcaattttagttctgtagatagggatacaggcagcataagggggcaggagatacttttcattcttgtttgtggtgcagaactacctaaaactagctaatcctacaaaagtacaaatggtagagataattataagtttgggaggggatggaggggtactgctagactaatagcacatgaaaatgtctcaagtggcactttacaaagtaagataaatggcagtactgagaacaacattaacagtgatcaaatccccatctctcacctacgttttacatttgttgtttttttgttgttgttgagggggtgtttgtttagaaatgcctggaatctgttgattggacactgttaaggcactaggtatacctagcaattgatatctgcagataagttgaaatataaattttttgagcttctctttatatagagtttgaataataactgaaccaagagtatacccgtgatgttttatgtgttttatgtttgattttttttgtttatttgttggctgaatccttggcatatacctccttttttgttggttatttggattgctgaaaaatattctaattttaatcagtgtctgctcagtttgagtctagttaatccagattcatattgtaatagtaaaggtcttgctctgtcacacaggctggagtgctgtggcgctatctcagctcactgcaacctccacctcccaagttcaagagattcgtgcctcagcctcccaggtagctgggattacaggcacacgcaaccatgcctggctgatttttgtatttttagtagagatggggttacgccatgttggtgaggctggtctcaaacttctggcctcaagtgatccactcgccttggcctcacaaagtgctgggattacaggcatgagctaccgctcgtggcctatttggttgtcttccacttaataaagaaatacacctttgaaaaaatttcccttgtgttgttagcctgccagcaaggtgatacactctatatttccaaactcttaaaacccgtaaatgaaattttaatttcctttcaaatgtataccataacaatccgttttttctctatggtgaactagttaatatataatatagactggtttttcacaaattctaaactaaccctaatttcttctaaggctggtctacttccctattcttgtacttactagttcaaactgtccagagaacaaaattgttataaaagataccttctctgtgtaatttcccttggattataatcatgtcacttgtttactccaagggaagtaattgagttttgatgtcaatgaggatggaatgaaataaaagcttacttacttcatgaatattatatgcttagaatatatttccctacatgctaattggaaagtcagagatcatcagattgaatttcagtgtttagttattttatgaattattttcatgattttatacaaagacttgattgaaaagtagtttcttatcagaaggtcattgtcttgataactgctaatgacaattttctaattgtattcagattaatttaaagtttggcatcagaaaaccagaagctcggacaggaactgagacagatacctgtacagcttgtgcaggtaccttgatccttgaatttgctgctttaagtcgattcacaggagcaacaatatttgaggtttgctttttacggtctttgatatcctgggtattgggcataactacctttatatcttcttcattggttaaatattaggattattagttggagaattactgttattttagtgaactttttgtctaaattcctttacatggtttttaattgtcaaaaacctagaacattgtgagagagctatgttaaatccaactttgcattttgttcaccaactatgaagtatatgtttaggtttagtcttagaaatttttttagccatattacttaaatgaatttgatgtctccttgatatcataaatgtcttacgaaatactatgtccctgtgttttatttgttagacttccatattgcacttctgaaagttctgaaaccttcactaatcttctaaaacacagtgaaatttttgttcttaagtcttgattgagactgtaatctgtaaatttgtttactgcaagggaaatgttattcattatccaaaagacttaatatccccacatagttgtgggctagctatgtctctcattaaaaaaatctaattatttaagcatgtcattggagtgcagtggtaacacaaagcaccctctttttcaagcatatgacttaggttaatgtttaaaaattcaacaaatggcaaacagaacaagcagaaatagggactgtatagtagcattacagatactagatctgaatgtaaagaaaacaaattgactttgtatgtatgtatgcctttgaatgtatgtctgtatgttcaaatgtctcaaggacagatttatcatgtttggttggttaatcttttaaacttaaggttttgctctatatcttgttcactaatattttcccttcattaaaaagtgtggacacttttgcatactttaataactacactctcagatattgatgcagttacaggtgaggaaaataaggctcaaagagtatgacagacctgcacagctggtagatgatgcatggagttggaattagaatccatgtctttctgaatttgaaacccatactctttccagtgggctattttgtgtttattaataaatctgttgaaagtcatgatttaaaaaaaaaaattcttgaatacgcagtaatttgttgtcagagaagatgcagttgacaaagcattgatataatacagggttggcaaactgcagtctgtgagcaaagtgcagccactgcctgtttttataaataaagctttattggaacacagccatgctcaattgtttgtttttatctgtgcctactttggtgctacagtgacagagttgagtaattgtgccatttactgtgtgacccatagcgcttaaaatacctggttcttgtccgaaaaggtttgctgacccttggtctaatatatataaagagatctgaattctcatattatttttttgtcctgtaattcaattttaaactctagctaatcttgaatttcactaggcctgttttcttagctgtaaaataagactagggaaatctttttgaagtttcctggctctgaaattctgccatttaattaaaattataacctgctttgtgtttaagagaaatcagcatagtttgagtaaagaattataactattttacactctgtaatctgccaagtgacaaatgggtttaatgactttttcttttatagaagtccttctgcagtgctaaataggttcatgctctgaaattaatttagaaacctgcctgtacttgccctttgcatttatattttgtaacatcttttcatccaaagccaaaaatttgttcacaactcattttatttagtgtctagtagataaaataaatgagaaaaagacaaacatgtcataaggttacaagtttgttgttatcaaatatttggtagcctaattgatttaatagctttttactaatgaacttgcttaccatttaaaaagtaggatctgaaatgactttcaaagatagcatactacctttgaaattctcttccagttttctaaataagagtatctagggagatttttactttgcctttaagtggtagaaattactttaacaagtatatcaattatgtaagcaattaatataatttaataatacatgtgtgtgaatatgaacttgtgctacaagagtagatgaaatgaagaaaaaacaaaaagagtagatgaaagtgagccatcaaagtgagccttcctctgaatagtgtattcagagtctttcctaactacactgattggttgaaaaagagccaagctttgagttttaaggaaatttgtttataaatagttatcttagaaatttaacctaattcttaaaatatcctatcggcctttgagttttgtttgttagtttcctatttgccaaagagacttagttcttcaaatatgcacttcttttttttttttttttttttaaattacaggaatatgccagaaaagctcttgattttctctgggaaaaaagacagcgaagtagtaatttagtgggcgtgactataaatattcatactggagattgggtacgaaaaggtatgtaagttaggctttttaaatcaagcctttgcatcctcaaaatggttgggaaataaagaattttcatttgttaaaataatctttgggatactataaagcataggttctcacaagattgctggaattttaattaatttagccagattttcttttttgatgccaaatgtgacacacttcttctacatgatttagtattctatttcttaatggatatagcattataggtatagggtgtagatgaaacgctataatttatttgaaaactagagaaccagatttctgcagccatctcacgtcaaggtgtggtttagtaagaatatgggtttaataaattctttttttctcctacctccagaaatatagtagctaagagcatagactctggggtcatgttgttggattcaagctatgtgatcttgggaaacttatttaacctctgtgtgcctctctattccatatctgtaaagtgggcatattaatagtaattagttgttctgtatgaggattaaatgagttaaccaaagtaaagtgcttagaacagtgccgggcatgtactacacttactatgaagtaagtgcccagtaacgagatgttagtccttttgattaataattttacttctgggaatctagtctgaggaataatacaaaacatagaaaattatttgttcccaagatgttcccatgcaattatttataaatagcagaaaattgggaaacagtctaaccatcagtaaaaaaagctaagaaaattattttacatcagcgttggaatattgttattaaaataaatcaggagcatgggaaggaacatgtaacaatgttatatgaacaaacaggatattgaattgtacaaagaactgtgattttatctttataaaacaccctgataagcatagatgaatggaaataaattagaatattcttaatgaaagcatcttttttatacattttctctatttctaaaaagcttatcttgtttatatgtaaaataaatggtaactgcctatatttaaataaataaaaattataaaattattaattcaaacatattaaaattattacctttattcagtattgtataaaatttttctgtgtcatctaaatgacagaaaagaacttttgactcttcacagtcagttatttcagtaattcagggtgatactgaggaagctaagaaatgactagatttaccagaacatttgaaactcaagacaatttcttccaagttcctaaaagcaaaatattgaatggccactgatgaaaagtcatcttgtgtattcattcactgttttctagtatttcactgcttataactgtctggtctcatcttggttatagtttaaaaatcaaatattttcctacatctgtgaattaaatagtacagtgtggttaccatatcatacttcagctgttaaattaaatccattatgtcataacactaaaaagactcatttaaaaatgaagatttaaaataacataatatgttgatttaaatgtaccactagaaaaatgttgtgtcttacaatagaaatgaaatgtatataaatatgggtaaaaagacgagtcactagtttgagatgagaactattattttcatggtaacgtaccagcatgtatgtgcttgtatagcatacacataaacagagaaggcttaatgcatttataatgcaaatacaaatgcattaaatagaagtttgatagtgtattataaacctaagaggaaaaatccagacttgtatttttgatattttgtgcatcaacatattgctacaaacatgaaaactgtgaaatttttaaaatcatttccttgcagtcatagcattgtaccatcttcatttttgtctagagttggttcagttctaagtggtctagactccacctgcctatcattttttttttactggttaagacagtaaaataggtgtttttttgaatctataggtttcatttttgtgttagataacatttcttctttttaagagtagatattattattgttctttaatttttcttgactttggttcttttttcctttttaggaaaaagcaaaacaagagacttcatctttagatttcctcaagatttaagtgaatttactattcatttatacataccaatttcttaaagaacacaagatgcttattttccacctagtgaaactaagagctaattaaactatgaactagttagcaaattatttattttaaatataattatctgttccagggcaaatctaaactggtgtagtcatatatatgcacaatgttaatttaatgctaatctaaggagtgctatttttttaaaaaaatttaacggttttaaaaaaatttaatgaaaaatcacatttgtgtttccatagatagtggagttggagcagggattgattcatattatgaatatctgttgaaagcctatgtcttgcttggagatgacagttttctggaaagatttaacacagtaagttgatacaattttatattttataatcaacttcatttgagtccagatttttatagaaactccattacctgaatgacattgtaaaaataatttttaaaatgtgtagtggttttgtgtcagtatttcctgatgatgttgaacagggacagcgtaaaaagtgatatacattccaaaaaatcagttgataaagtagttttattttcaccttttatcagaaactttgcagatctgccaataagagatgtaatagatttgagttttacctaatcttgtttgtacaaggataagaattattgaaatatgttactagttagctttttcctttgtatttcaattctttttgaaatcttggaagtttggcttagtctttgattacaccaaggatacagggctttgaagacctggagaaactagtgagtattcatttcaaaagcaagtcttaagactggttcagaaccacaagcatgtttttttgggaaaagtgggaggattattgaacccaattgaatcacctttttaactgaagcaaactgaaatgaatatagcaaactcatcagttatatcactatattctttttaaactaatctaccatttccttgctcacctatcagttcatccatgttgtatgtatgagacagtatgacatggtgattaaaagtatggaggagaatggcgtgaacccgggaggcggagcttgcagtgagtcgagatcgcgccactgcactccagcctgggcgacagagcgaaactccgtctcaaaaaaaaaaaaaaaaaagtatgggagatgtactggtttaaattctgattgtaccacctacgggttttgtgactttgggcaagtaactaatattatttgcctctgtttctcatctacagaatgggagtactagtactatttatagggttattgggaggattgagtttatgcattcaaagtgattagagcagtgcctttaacctatggccaatattcaataatagtgattaaataataggtaaatttgcaaaaaaaaaattagtaaaagttaataagtcattaattgaatactttctaaaattatcacatagattgtttattagattataacaagaatttcttgaggtaaatggggacaaataactatttttgttggcttgttatcacaactcaaccttttgtcaaagctgagaaatatctaggagaagaagacaaaagaagggaaaaagagttttctaagaccataataagctgagatagcaaaccataagagtggcagcagtgattagctgcattagtttagatagtagtgagcaccaaaatattgttagccgagaagggatcaaacttccaagatacaggaaaaagcaaattctgtaatacagaagctgatagctatattacaaggggacctatgagcatcagtgggccgcaaagtcataccaaccacgggctaacgccacagggcatagagatgttcagttccatttttctcagaaggtcctatattacagatagtctttaatagtctgcatgtgagttagaggacataaaggagtacatatatattttagaaagatctccatctaaaataacttaaatatttatataaattggtagttatttagtgaatttatatataaattctagtttaatttattcacagtgctatttaatgtgtttagagtagtacctcttttttcatctaactttcatgaacacatgttgtgatcttttagcactatgatgccataatgaggtatattagccagccacctcttctacttgatgtgcatatccacaaaccaatgctgaatgctcggacttggatggatgctttgcttgccttcttcccaggcttgcaggtataaagaattctgtcttcttaatatgaatgtaagatgatgatgttaattaggcgcatttttgatctttaaaactgaactacaaaacatagttgcagttcagaattgtatttgtatacatttttctgtttatgtaatgattagagataaaatcagctcatattttattaggtaattttattgttgttgatttctaggtgttaaagggggatattagacctgctattgaaactcatgaaatgttatatcaggtgattaaaaaacacaattttctaccagaggtaagcaaataatttttggaataatcttacacacacacaaacacacacacacacacacgtacacatatacactataagttgctaatataaaggtagaaaatgtcatcttcaaggcttgttggttctttttatttttttcctattaaatagtttatttttggtttgtacagtattatatatgtttttgcttttctttgtgtgttaagagaagtctgatttagggtaatgctgacatttttaaaattttatgtaaaaaaattcccagcttagttcttctcaactcttcctaacttatgccattgtaatattctctcattctaactcttgtatgtacctaccagctagggagattttgtcactttttattttctaaagcttgtcttatgaaaacagtatatattagatatacttttgttgttcacacatgccctctggaaatgtatagaatgccatctcttcctcatgctgattgagaattattcttcctgatttttatacatcatattagtaataaatattcttgctagcttaatatgacaagattttaatagcatactttttggcttcccagaaatgtaccgttaaaaatttccaaatgtgtgtatggccttgttctatccccgcttattgactaccctctgtgagatatctaagcattctaccaacttagaagggttcctaaagtgtttgttttggaaagtatagttttattagccttcgggtgagtaggactgtgcattgtagaaaattcatatccatacagaataaactgaggtttcaattaatacatctatcacaaatgaaatttttatttagctcccataaaagtttttgtttgcttttatttttattttcttttaaaaaccaattgattatgttattgaataaatttcaaatagactaattttatttatttctaaataatgctctgtcttattccacaaaggatttgaggcttttagaaaatataagctaaaatatgaaatatgtatgcttacacattgctaagagagattttaagtattctcaccacaaaaaaagagaactatgtgagataatgcatatgttaattagcttgatttagccatttcatagtgtataaatatatcaaaacatcatgtcatataccataaatatatgtcacttttatttgtcgatttaaaaaatttaaaaataaatatgagaactaggagagtaataatccagaggaaaaagtagagggaaggataaaaagaaaacacaattatgtttaccaccaggacccatgtagtggcattgctgagtttcattatggagtttttctgagttttctaatagccagaatgatcactgaaaaaataatcaatttaattggtaaaaatagcagcctttgcaaaatgaattgttattttaagcaatgaaaattgatgttttattgatgaaaatgtcctgattgctattttaattgcttttacctatttatatatattctatatattctggaactacttgtgtatttaatcacattttttatgccttttgtatgttgttttgttcaggcatttaccacagatttcagagtacactgggctcaacatcctttaaggccagaatttgcagaaagtacctacttcttatataaagtaagaaaatataccccattttacttaaagtttagcctccattctctgttggatctctcattctttcataatagtaattgggttttcagagtccccttttaatattataatgattggatatatcatgattcttattcatctagtccatagaattattgaatgatgcaagaattgacatgcaaggtttttttctttaaaaaatattatgtaaacatttctttaaagagaaattttatgttctagagctgctttctaaagcatgtctcttgcctttcttcaggcagcctttctgagcattagaaatttaaaaactaaggttatatagttaaattttataattgtgtatttaagaaattctgtaaagcagattcatagctttttttcagaactcagttctatataatgtccttcagtgcctgatacagtgcctggcacctagtaggtactcaataaatatttggtaaatgaatggatatgtggtaatatataagctatatatattatacatatattctcctttttaataggctacaggagatccttactaccttgaagtagggaagacacttattgaaaatttaaataaatatgctagagtgccttgcggatttgctgccatgaaggatgttcgtactggaagtcatgaggacaggtaaaacaattgctaacatcctctttcctcagggtctctctgaaacaacacaaaatgcagctaccatttaggattcaaataagtttaattcttttacaaaggatagaaacctttgttccttgtgtttacttttttaaactctgttgaatacactaattttaatttgtttgaaaagtttgtatttttatcatagtgcctggcatatagtaggtgctcaaatgatttttaaataaatgaatcgatgattgttaaatatcagaaccttggtgttaggactatctaaaatgtggctttttttcttctttgataatagtttccttttatattacataagacattagaaattaccaagatgaggaatgatctggaatgtgatttgtgttcggccaagaattcctcaaaagctgtgtgtacttacaccgttgctgacttgcaggagtgggaaagaccagtggtagtttctgtttcattagacactggatagatgtagatggtatgaagtattcaagctataaaaagtgctccacatgaaattcacaagcattctccttattctaagatcacttatctggttatcacatctctaaatgaatgctgaagcttatttgttcatttggttagcaaatgttcattccagaaatatttactgaggccccttatgtgccagggctcttactagtttttgaggattaaagatatgaagataagtcctttctgtctttgaatcactgaaggcaggccaataagcagacttttaaaacattgtatatgtgtttgaaacatattaaaggggcatgaagcacaagttgggatgtgatagtcagcgaagggttcctgaaggctcctatgtcctgaaggataaccaagaattagaagaagaaagatgtaaaagaagttccaggcagtgagactgaagacatgagaaacacagcactcatcatctacccatagagttgtcccttagttcttcacttagtgttcggataatggttaattaggcttcgaatctccatccctaaccacagctaatgagaaatggttaggttctggaagcaggcatacaagtaatagcaagaaataaaagcagataccttgtgtatttatttgcctgtaacatttattgactgtttcctatactccagacagtcttctaagcattttatgtgtttaactaatttgatccttacaacagctttctgaagtgtactattacagtcttcattttaaaggtgaagaaaccaagggaaagagaagttagggaacttgcctaaggtcacacagttagtaagattaagtcagaattctaatctaggcagattggctcttgacaatgatgttatactggcaattcattaaagaacaataattaaacacctactgtatgccagccactgcacttaagtgtggggtagaaagataaaatagaaccagtccctgcactcccatgacttgtagttagtgaataagataggtgtgtaaagaaataatcacaaccatgtgatatgttctaaaatacaaaagaggtaacaagttgaagaattgcagaggaagacatgatttactgttcagaattctatttttcaaagtgtaacatccttctttttttccccaccaaatactccttttatgacattgtttctggacctcttaccactgacattgccccattctgattgcattccagtatatataataactcttaaaatatcacatccagaattaaccatactcaagatgtgtctggcacacagcaccataactgtctgtattcaggcaaagggtcactaatgttctatgaggctgatgagtttccaccctctatccagttgaggaccactgcttcattgactcactgttcctgaggggattgttgtgcctctcagatgtctttagccaaatgaaaggttaagaactaccattcttcatcatattgtgttattagatgtgctttagattttttaggagctttattatgttcagctcacagtgagcttgtgatcaactagtttcacatacttaactgtatggtctgctgacaaatgagtgttctccaccctgcctttgagcagccaagttttcttttttttagtgtaaacttagaacttttatatttaactcagcaaaatttctttttttgttttgtttctagattttggtctagaggttgaatctcattagctaaactaccagttttcaatgatctatagtttagatgagcataccttacatttttttcatccaaactgttaggaagaagttttggttggaccccaaccagtgccttgtggcactgcactcaagagctttcagttacaggctctttgcatgtggtggtttattaccctatagatctaagcactatcactgtcctccaggttaccatcatctacacagacacagacatacacacacacttttcacaatggaaatatctgtattttcctaatcataattactgaaaagaatgtaaatggcaaaaataataggaaaatatttgctaagacactgtcccctaactgcgtaagattaccactgttagcaattttataaaggcttccagacatttttaatgcctgtgtatttttatttatgtatttttatgattttaaaatataaaatagatcatatgatctgatgttcaacttgctagctttgcccaattcatattgtagttatcttaccatgccttgttcttttctaaatgtttacaaattgtctattctagtatttgccaattatcagtatcctgctcatctgtctgcagttctcaagatagcatttgctcatgtaataactgtcagtccatcagaaaaggttgaattatgataagtgtattgcagataaacaggaaagtgtttttatattgtctaaaaagattaatatccaaaatggctaaacatgttttgaaacatttcaggtgagtttttgttccaaaataaaaaatcatgtgtatgtaggaaaaatgatagctgtagtttcaatctcatatgtatgccaagtgctatgctaaataattgacatttaatatctcagtcttcacaccaatgtcatgagtgtattgttatattccttttacagaagaataaactgaagctcatagtccttatataatatccccatggtgacagaactaattagtggaagatctttctatttccaaagcccatgttctttacttctttgttctactccctctccagctcattctttaatcacgctgtttaaacttgcatttaatttagtaaacatttattgagtgcctactgtgtgccaggaattgtgcttggccagaggtatgaaattgtgcaacttgtccagtaaactagaagttgtttattactgccaaaacctatgatgctttggggagtagtgaattaaatttgatgttactatgactccatctaccagctatgcttttttcctgacacttttaatttaaacttttcttaaattgttaaaacattataacattaaatcatttgtaaaaacacatatagttttactgtctttatttctccacattcccttcttaacaggtaaataaatatttagcatgttataatcatagcccgtgtgactttgcattgtacttttttcatgtaactatttttttctttttttgagtcggagtcttgctctgtcacccaggctggagtgcagtgacactgcactcggctcactgcaatctccatctcctgggttcaagtgattctcctgctgcagcctcctgagtagctggtattacaggtgcctggcacgacacccggctaatttttgtatttttagtagagacggggtttcaccatgttggccaggaaattacatgcaagtaatttctttacatttaaagccttctttttaaatcacttaaatagctacataataaattccgtcaaatttgtatgactttttccagctctctaatttaatggaagattcttatatgattctcactagtaaaatttatcagttacctccctgctgttgattctctatagaagaaatggagaactttccctcattgaaaggcctatagaaaaatcttgtctgcattattcacaagattcagtgtatcagtgtggtagacaactcctctggtctttttcattaacatagaatatacttggagtcaaggttattctgcccctggtagattgatacattctatagttctttgaacatctaagttggtatagacaggattattaaccttgactctatggctttcatatagttggcatttaaattatttttatctacttatatttatttgtgactttttattttagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacagtgagtttttaaatgaaatgtcttattctcttttttatttctacatgttttatttttccaagtgaaaagtaatccatgagtagaattcaataaatatatgtatggtaagaataaatatatacattttcctattttttttcttttattgcatcctgtatacacttatatatttcattaactgtttccttttaaaaattatgttgagtaggccaggtgcggtggctcatgcctgtagtcccagcactctgggaggcccaggtaggtggatcacaaggtcaggagattgagaccatcctggctaacatggtgaaaccccgtctctactaaatatacaaaaaattagctgggcgtggtagtgggcgcctgtagtcccagctactcggaaggctgaggcaggagaatggcatgaacccaggagatggagcttacagtgagcagagattacgccactgcactgcagcctgggcaacagagtgagactccatttcaaaaaaaaaaaaattatgttaagtaaaataattatttctgtttacataaaatgtttttctcttgtagacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtgtaagatgtattattttatattttctaatatcaaagttgtttcttagtaaatgacagagaacttagggagcatgtatcaacagccaagaagacattcacataggccgaaaatgttgaggtatgtagctatcactggttaaaataaaaattagtagtaaagttagatagtaaagcttattttgcagtaatatcttttttattattttggaaactttcaatatatcttttattttatgaactaaggtaataatagtgggcagcatgtaacagtttttaacttctataactcatttttcatggaatagtttcatcgaatattttctggccaggcatgatagctcacgcctgtaatctgaggacactgggaggccaaggcaggtggatcacctgaggtcaggagttcgagaccagcctggccaatatagtgaaactctgtctgtactaaaaatacaaaaaattagccaggcatggtggcaggcacctgtaatcccagctactcgggaagctgaggcagtagaatcgcttgaacccaggaggtggaggttgcggtgagccaagatcacgccattgcactccagtctgggtgacaagagcgaaactccatctcaaaaaaaaaaaatttccttttgtctatagtttctgtgtagtgaaaatacaggtattttgtttgtttgtttggatttgattttttgagggagtacttattcttgcttgttaaaattggcttaatgagttcattttctgacgagtagttatattaggccattgcaaggactttttaaaaattatttttacataagtgttattattcactgatgcaagtattgatttgcttttaaaatattgggagaaaaatctgtgtttttaaaggataacatcaatagtaacaaatccccaagcaaacttgttctgtacctttaaatagttatagttctcttgactaatactgccttatatagataatatacaaacttttataactagaaaatgttatatttgaaagctataccacttgttaacctaaattatatgtaagaaaatactttctagttattccagtttcactagttctaaaactagcaattttgcaagtaacattatttttatttgacatgtgttttttgccaattctaatttatagttttttaagccttgcctgtaattacttttagcagagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagtaagacattgctacactaattagataccgtctctgccctgctttctttggtcgcattagctttaataagataatggatttcaactttctaaacactttaaatatactgtttaaagtgagagaatgagaattttaggacttggaagtatcttggaaagtcacctaattcaactcctttatagtataaatcaattaaataaatcagagctaggttgggtaatttgctgaagttaatataatcaaatgcaggactcaaatctaagttttctgtttctcagtccattggctttcccctgttacttttatttacaacataacttcaaaaactagtaattagttttaatattcatatctccatgttttacatcattttagtctccaaagagctactgaatcttaagtattttgttcatcataggtatttatttgtctgtgcctaggaaaaataacatgtctttttgagaaatttttattgatttttactttgaaagtttttataacacaaagtttttaaattatttaccttattagtatattgattctgagaaaaccacatagtttgctgaataatttttaacctagaaccatattcaggtatcctttaatctcaaattcaaccctcccacaacttcatcacaccctcaagttttcatctcatccatattcttgccacatccttccttcttttaagagtattcttccttcttccttgtattttatttggcctcagtgggagtgacatctcttgtgacattgcttttacttacttaggctgccaatggcataattactgccaagtggcctcttgatccttatatgatttaacttttctgtaactattggctgaacccttcataaaacattttccctttttggcttcccaggatatttcagaaacaaagttctttttctacttcactgtttattgctttgtagctctccttggcacaaccactcaatgtaaacagtttccaagaatctggatgatattcttttctctatatactcttcttcaacagtgtcacctatttctacaagcttagctatcatttttatacatatgacttcttagctatgtatgtgaatcctgattcctaaatttactattaaattcaactttcatctacctctcatacatcttgcatctcaatctcaatctgtccaaacttgaattatctctttcttgtttactctctttctaccctcacctcaacctatgtttccttctttggctctccatgtcagtaaaacctatcatcattctttaagtcatcaaagctggaaatttcaggataggtttgaactcttcttctcttccagttcctcttatccttttccatcctctaacttctatcatgtcttgttggtttttcctgtaaagtatcaggaatcatcttatttttttctattatagtcattcttcaactttccctctgttaagactcaattcaagtgtcattctaaatctttcccaggtacacacaagcagaatcaattgttccctcatctgtgctccttttccactttcccacttgagaaattttatcatagctaactttacatgtctttctcctccagacacaaatttcttaaaggactgtctctccaatgcctaggcaagtgctgagatggaataagtgcttcacagatatgttttgaatcaaattgaatctggttgttcactatttcaaggagggaaagtgtgggtcaggtatgaggtttatttcttcagagggaaagccagtggggagaataagcaaagtgagcatttgagcattcgctagaagtccagttctcaatctgaatcaaaagtggtttatagaatagcgaaagtgacattgataaaaaatacggataagttattttcagaaatactatttctgaaagtattatttttgagtacaaataaggtcataaatacttggtggtgacctaaagtgaaagaagaagttgtagagtagaatactacagtacagtgtctttaggaaatcaaaaaattggtggaagtttccagaaaggaaggataaaatgaatttgtttttttcataggctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagaggtatgtatacttaaaatatagttgttgaaactgaatttaaaatattaagtattgccttatttcttagtctcttctctaatttagtagttttaatttatttaaaaaactgaaatagtcaatctcctggatttaagtaaagtaaaagcatgtcttgaaaactttgagtcataatttatgtatataatatgcttacagaattttaactaaaatattattcaggttctattcaatttcttggtctcttctctaatttaatacctgtaattgatctaaaaatggttttcagactttctaagagccactagaacctttctttgaacaaaagtctaaaccaggagcttaatgtagaaaacagctaaaagcacagaagctctggctcaagtgactggagaaagcctgggaccctgaggttccactgggcaaactttgaagatcatttagctagtccatcctctatagttgtaacatagttataacgtagaaaacaaagacttacataactaagcaattcacaaagttatctaactaattgattgcagagctgggaccagagcccaagtatcgtgacaatctaaagccaatgctcttttcactctattactgctaatttagacttttttctcatgtatattttaaactatgtagaagctatatagattgattgattcattcaactgttgattgagtgcctactatattctgtgcactgcttgctgtatcagtttacaaaaccaatgaagatccatgcccttatggaatttacattttagtagagtgaaggatattaaaacatctttatagtaacgtgtttaaaaaaattagttccttggtggatttaatttttttggtaaaaagaactgcttgcagattcatatagactaagtccattttttcccctttcaaaaacttttcttgttaccaatgatcatttcaaattagttcccagctattgtaaatgtagtgaatctgcctgcaggtcccaactttactgcttagtaacatcgtgttaacattgtgagcaaattacgtaacctgagtctcaatttccccatatgtgaaagggaaatgttatttgtattgttttgctcagggtcattataaataacagattttgtagtttatataaaaatgttctataaactgcaaagcacactagaaatattggttgagtactgtgatatgcaaaatgtttaaaacaatattttatggtgactatatgttagatacgttatcattagaaaagaaatgagttctagttcttttaaaactctagatattgaggtttaatgacttgattgccatttgagaagattaaagtatttaagttgcttttatttctgacagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattggtaagtaatcatccatgtcattgtgttgactgaaggggagataatttttaggattttttcccttttattttctaaaattttatcaaagagtttgtcatagttttttttacctcacctagacaacaaggataggtaatccaatgacttttaatttctagatatctaacatcttttttaaaagtctagatttgaatttctgtatattaatgtcagtgaaaatacttgggtttaggtgtgagggtgaggtagggctgagtagtaaaaaaattcagtaccatggataagaaaaggtgcccatgagatccataacccccgaagggcaagaattacactgtgccacgtccagtggggagccattgaaaatttccattactccacaaagatgcaggctttggaggcagacacatgagagtacagttcctggctctaccacaaaattgcagtgtaaccttggcctagcttcagttttttaatctgtagattaaatagtataatttttttttatttgatagtagaatatttttgagctccagtggaagtgataataaatatattttaggtgattgtaaggtttaaagatatataaaatttcttggcataatagcagacataggataagtgctactataacagggtttacagtattgctagcagatctttatccccttggatctttttctaccgaaatgacaagttaccacctttaaatcatcttacctatatgtatcaactagtgggttttgcttttttatctttcatagacaatcacttatatcatgataaacaggccatgactattaggggaaatataaatttttctgttttaaagtaaataggagtttacattcagaaagaactgtaagacctgggctcacaatatgctgattgtgagttcttttgtacagcttctctcacagggaaatccattttggattcccccctcccctgccgcccaatagttaaggtaaataaaaaaaaatagttcaggtaaaacagaatattaacacttattatgttgatttaatggatgcataaattttattaataaacattaggagaagtcctgtttaatgacttaaatcagcagttggcaaactacaagactataggccaaatccagctcattgcccatttttgtaaataaaagttttattgggacacagtcatgccaatttgtttgtgtatggtctatgactgctttgaactgcagtgatggagttgagtacttacaggagagaactacaaagcctgaaatatttattcatcatctagccagttacagaagagatttgccgacccctgacttaaatcatgctctttatccttgggtatttcccacacttagattagttttattgcagaatttattatattaaccatcactatcattttgaacagttcttaccaagacttcaaaatgaaaatgtaaagtataaagtgtagaatttatgcattaatgtttaaaaatatttctttgtgtagtattttggttttttatatttttcagtgaagtctaattctcatgatcttctatagtatgcaataattgtcaatttttgttttgtttgttttgagatggtgtcttgctctgtcacccaggttggaatgcagtggcgtgatcttggctcactgcaacctccatctctcaggttcaagcaattctccctgcctcagtctcccgagtagctgggattacaggtgcctgccaccacgcctggctaatttttatatatatttttttctttttagtagagatggggtttctccatgttggccaggctggtcttgaacgcctgacctcaggtgttctgcctgccttggcctcccacagtgctgggattacagtcatgagccaccaagcctggcccgtcaaatgttttttttggtagctattagttggaaaatggtatactgggttctgtggataaataaataagagatgatgatccttactctcagaaatttttttttttttttttttttttttttttttgagacagagtcttgctttgtcacccaggctagagtgcagtggcatgatcttggctcactacaacctccacctctaggtttaagtaggtcttatgcctcagcctcctgagtagctgggattacaggcacgtgccaccaagcctggctaatttttgtatttttagtagagaaggggtttcgctgtgttggccaagttggtctcaaactcatggcctcaagtggtctgccttggcctccaaaagtgctgggattacagccatgagccaccgcacccagccaaaaatttaatttttaatgagaaactttcttgtgttgacttctttctcctgagttttttgtttctgacaaagcattttgtttttgttttaattgtatataaatgaataaattaggaattagctgttttttgttgcaagggttagaaatacgaattatcttagaaatcatgtggctgcaggagataattacgttggtttaagaagggaggttttttcactacacagaaatggattatttttagtgaattaaacagtacaaatacaactaggattcaccaggaggtagaagtgggaactaaaaatcaccaggatccatgatagtgaatgtttttcacttttctctctgtatctctacctctgggtccttctgaacttttcttccctgcttctctttgcaattctgcttcattttccagcttctcaccagccttctctctctttgttcctcagttccaaaatggccattctagtttgcagcctcagcccctaagtctgtgtcattcaactggactattaccccctgctaactgaaacagtctttctgtgtgccagttccaggtcccccagagagactcagggtcaggtagccatcttttgtctaatcaattattaccaagaggatgggtcatgcattctgcacttagcaggtcctatgagagtgagcaccctgagacaggacagatagtttcttctgggagactggcatgcgatttggaggtggtcgtgattgtcgtcttcagtaaaacagcatgttgctggtactactactattaatagttctactactattatttaaccaatgcaaaatagcaatactgtttagtttagcttatagaggaagaagcactatagtcataactattctttgtgtgcattatataaaaaagaaatgtccatttttagtttggtaaaacaatgtaatcatgccagtagtggaaattttcaacaataaaattcattcatagttctatcactgtaatccgagtcattgattttttcctttctaggcttttccataagcatatgaaatttttatagtcataatcatagaattctgtattctactttttaaatgtattattattctgtgtgtcctatcaagtaggtcattataatttacttataatggtgtacagttgtttacaattataaatagtctagtaaaattatttgggcatagggcttttcgctacttttgaattatttcctttggatacgtttctatgagaattaatgggtccaaaaattatgttggtttttatggttcttgatgcataaaattaattctgtcattgtaaaaaatcagtaacaattagtagatagatctttttaatggctggatattttgatgtttgctgtatttattttctggctagatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgaggtaagagtaaaataccatttgtttttttatgcagcgtaatattaattttgctagtttgataacaagaatgagtcacaaaaaattgttttggggggttcactgtgaaaacaagtaaaacttttagaagatgatttcaaaatatatttttcttttggaaataagaataataaaacatttattttgctttgttttctgagttaggatgtttttagacatatgtttttatgtgtgatttgtaatttttgccctgagtctgttcaggtgataaaaatacaagagactgcttcaggaaagccattttaacatccggaaatgttcacaatttgatttcactgatactacatcttacatgtcttttataaggaatgagaagacatatatagaatgttgtatacaatatcatagtagttagtctcaacaggccacctataatcaaatgactgctgtcttggtgaaggcaatagaaatctagcagcttcttcccaatgagatctaagtttatcacatggatataagagttacaaatggctgtttctgaaaaacaagatagcatgtcttaatttatgagagtagatagtcctctgtaggccaaaatgtttgttagtaatttgaaatgtctttgaaacccaaattacaatataaatgcaaggccttactagtattcttacatagtttcacacccagggatagaggagaaatgagggaatgtgagccttcagatcttgcttgtggtagcagtctttcctgtctgctggagagacctgaagagagagctaaagttctcccatacccttaaatagatgaagttgcataatagtacagggttgttacatcccctggggtgtttgacagatatgtaggaaactgattcaattcaatgtgacttccaagtgggacatttaaaaaaaaatgttcggtgataatcatgctagcataatcatgctagcctaattttgtcttcttgtattgctttattcttctttgagattctttgaaatgtcaattatttatgagcaatggagtgagcaagtaggttgtttgtatataacaatgtatagatggaaacagaacagaatacaaaggttttctagtcttaaatcctctgtatacctgatttttttttcctgggcccttttctaaactcagatcttcttgcctacatatatgcatttaggcacatctaacataggcaaattattatttcttgtaactctttaatgcatttgctttttttccccctattttgtgctaccactggaatttcagcagcaatattaaaaggtaaaatgattccaagctacattattaatagtagtaagtatcttgcattaacaagccttaaattatatacgtatatatgtatttgggtgtgtgtacacacactcaagtacatatataattttgtttcagtggataccatgataatatcttgtgtaacgtaattagattattttcatgtctagtcagcagtcacataataattttaaattctaataattatacatcccatacaatagatgaattctatgtctatgtccatacaagagtcactctaacaaaggcattgttgttttagtatttattactttgatcacattttatttgaacacaatgtaaaatatttaaagtattgacttgttttaaaagctcatgtgtgtgtatggtacatgggttaggactacaggattatggtacagcatgtgcttcctgtaccagagaaaggttatgagacatgattaattctaccagaaaataagaattcttggtgaacagtatccccttaaggaccttgcattaaaagggcattatttaaaagatattttttgaaaactttagtctataaatttattgaactgtgattgttatagagtgatcttttgataaaagtattgaaaagccccctttttgtgtaatagctctttatagaactgtacagctatattaattagcaacaagatacagtctaattgttaatatttattaatgtaacagaaatcaatggtaatagtgttatgaaatcaacaaatgtattcacttaggatatcctaagaagctacacagtctgtagcggttatcatttgtcctataccattactacatacatcagtgtttctcccctgcatcagaatcaacagatacacttgttagaagtgttggcttctgagtcctgctccaaatattcaatcagactttctgattcagactttatgattgggaatcagaatctgaaacttcaaacaaacatcccgggtgattgtgttgtagctgcttcctcagctacactttgagaaatattgaacaagattcagaaagcaccccttttttgtctcccagctatgtatcaggccatattgtaccattacaggtactagttaacagattatataagtacactaagtaacaacatccttaaaatctgaacaataaaatgttctccagattgccttttctagaaatgtcattccacaaatacgtatttttccatatgaagtcacacaatgctgattaagaagtccttttcatatttaatacagaaaatagaagcccttaaaaagccttcactcctgtcttcttcttctgataagtccatgccattagtatagatgtatctgaaactgttctgctagcagaaattttctggtcatcttaatacacatttagaagccaaaaagcattagcattttatcaagtgatgttgcttccttaggtcaaacctgtgacacttctgaaagttaagctatccacagtctattgttgaacagaattttcaatatcatatctctcagtgtttcatttttccaaaatttcagtttgtaaaggtacttaattattccaaccgtgtgcccacaaacaaaaggcaatgttttgttacctttaggtccaaattgaagcagtttacaattaagagtaaatttccttttttcaatagtatttgtcacagggaaaaaaacatcagcatttttaagttccaattcattgtcatgcttgcagcttagagtgtaagcctatagtgccttaagggctctagacaaatgctttcaagcaactgtatttgtctctatctggtaaagagccagacagagaaaatggaggaaagaaaaaaaaaggttccatcatttgcaatgctctgatttaagtcaggcagggtcacttttcctgattatcccccactgaatttgattggtgtgaatctgttctacagctgaactgcacaccttaagttgctgttggaaaggatttgattcctaggagaaaaatctagtacatatgcagatgaactctacctggagagaaacatctgaaacattcttcttagcagaattgatacttaaccttcccttctccatccaagacatgttttctcatgcattttcacatttgcgccatctcttccctttttctggaagttccctatcaatcccttttcctctcccatggcccttttcctctttgagaacatttagatatcctaaatttcaaatgccacctcctaggtaaaatttaagggtgtccttttaatacagttctactatgatagttaaatagttctttacctgcttctcatctctatattccttgctttcagtaaacatttaatgtacagatgaatgaatgaatgaatgaatgaatggttctaaaacatccaatctctaagtctttgccaaggttcacttcctcttttattattaaaacatactgattttgtttctctgtattttgagattttctccattctttctgtgtttctgatgtaccattcctgaatttaatattgtggttgttatgctcttacgactttgatctcacatactggtgaaaacaggcaccttaggatcaagatttgtagcaatgtggcagactttaactcttctatctttttgtagttctctaactgccatttttactttcctgattgttgcttttatttctggttctatagctccttcagcttgcgaaaaccaaaatattttcttccatgggcatcttcttcaaagttcttctctctgtctctctctctctgtctctgtctctctctctgcttctctacatttaaatttagttggcccctggtgactttcctatagtgctgcatagaatagttattggtatctttttaaaaactttataaaattaaacttgtaacaaattaaacaatccagaagtgtattaaaaacttttaaataatctctcatctttctgagataaccaaccaatgttagcagtttgatgtgtaatcttttatattcttcttagtgctttatacatttctaaatatatgtatcattcagtaacttgccttttacagttaaagctatattaaagacattcctccaagttagtaggatagcataacttattcttttgaaagctgcattatgttttgcattatcactgtaccataatttatttaaccatgtcactattaggcgtccaaattatttccaggtttttgttttgccactgtatacaatggtgtaggtaacattctcgtacatatcttcttagatatgcatactttttctagaatattgagatttactaaaatgaaatgctggcagaaagtatatgggtcgttttcattttaatggatgttgcaagttgcattccaaaaaaggttgtagcaattcacatcctttccagcaagatatgagagtacatgtttcttcctattttagtcagcatatttccctttataggtatattttttgttttttctctttatggattgcctagtcatatgttttgcattttgccttctttaaataagattctgtgtcttttctagatattttataggacctctctgtttgtgtgtgtgcgcatttcctatatttacatacatactcataaagaaatagaggttctataaattatctagaaaagacacacatatagggacagaggttacacacacacacacacaattttcccaacatgtcatcttttcactttgtttatgtaactttcataacatttttaggtaatcagaaatattaattcctttgaggctcctgggtcttctgtctcacttcagaagatcactccatcctgtttttacataatattttcctaaattcttctggcatttttaccattttttacattttggtctctaaatcatatggaattttaaaataaaagttaggagtctttccaattgagttgtcagttactaaataccatttatgaagcaaaccactcatttctccttcagttaaactaccatctttgctatatatcaaatattcttgcatagttggatctgcttctagacttacccttctcttctactaatgtgtttattcctttgccaataataaaagtttgctgttttgagtatattttattatctgatagggcaactctcccctcactgattcttagaatttcttggcttctctttgacatatgctgttccatagaaactttaaattaattgtatctggttctaaaacgaaaacaagaagtacaaatgagattcattttgaaattatataattgcatactttacatataaattaggaaaatgttaaatattaagacttcatttaagaatatacctataaatttaatcaaatcttgttttatgttctcattatgattttatttaagcaacgtgggtcttataccttttataataaatttaattctatgttttgtagctttttattatgaaaaggtttaatgattatattttaactatttattgttactacaaaggagttattggtatttgcatagtcttcttaccaaattttttttatcaattctaatagtatttttttattaaagttgctttgacagtgtacgatcacaatctgaaaatacaaataatttgatctttttctatatttacattgattattctactttcttgtccgattacatcagctagatttccaaaataatatcgtatatgtaaccctaggagagttttttatcacaagcacaatcttcattaccaggtaaaacaaccctacaccttttcctctccttctaatctggaataatacaatctagaaagaaacttggagatttttctttttgttctctcttgaatttagggaacctaggataaataagctgtaagtagccagctaccttctttctttggtctgcaccattggtttccctaattgcctaattaaattgtacctttttcacagcttagaagacagagattgtgtggaattcctcaatccaccccctgctgatcctcccctccggaaaaaaaaccctaagaatgtaaactttcagagtcaagtaatcccatctaatcagggtgaacatatatgcattgtaggggcagaaaggggtgatcctttcctccccatcataaagggttacagcggacaccccgggttaaaaaaaaacaaaaacaggttaacaacagaaaagcataataattttattatgtgtacgtgtgtgcacaggagccatacaaaatatgaaaggggacaggtggttgaagcttaaataccctcttcttagggtagaggaatactagggaatgaagaggtccagtgcttagacaatgattggtaaaggattctctttgcatagtatctagataaagtcccccagttaatctctcagctgtcctcagaagaacagaagaaaagtctgtttgggtgtggtgaggacccctgtctctactcttctctgatggctcattttttttctcgttatttgatgagagtcctagggagggattcttgagacaattgcatttcatttggaaagaagcttccttagataagaaaattccagagagaatccccccagttgcttcaggaaagaggatcagagagacagggaggcaggggaaggtcagagacagactggttctgaggcttatttctgagacctttcagttttccaagcattcatcatgctgaagcaccatattttggggaattgttttctgtgccccagcaatacccaccacaccttcctgcatgtctacatttcctttgttttttctggtttttaaataaatcctcttccctcccttctttgacattatcttatactttaaaccccagctcaagtgtcactttctgaaggaactttttgaagaaacttctcaaatctccttacagttctccctctgtatctgtgggttctgcacccatggattcaaccaactgtggataggaaatattcaagaagaaaaaagcatctgtattgaacatacagagattttttttcttgtcattattctccaaacaatacagtataccaatgatttgcataacatttacgttgtattaggtattataaagtaatcaagagatgatttaaagtacatgggaggatgtgtgtcagttatatgcaaatactgtgtcattttacataagggacttgagcatccaaaatccttatctctctttcataacgtgtcacagttgagttttctatttattttccgtgattatttgtataatatctttttctcccgttggactataagacccataagggcaggtatagcatttggtattgctcctcattttatccctagcactatgcaaatgatgacttggaggatatttgctggccaactgcatcacagaggcagagactgaacaggatgtagcatgtaggcgtcgatgctatttaagcactttcttgtaggaaccctaaataaaatgcctctactggtttcactgtatattcattataagaggtttaactcactcttcagccttccagtggattttaaaatgactatatcttataattcataggcctaaaataatagaattttatgaataatctcagttcttgtcttgtgaaagtatttctgatcagtcacattaatacccttagtcattcaaaaaaatctatgttatctgcttctttatgacttactgagtaggaatttcacttttcaaaggaatattatttgaaaatatagcaatgatatatgctgtttaaaattgattctgtttaatatgttcttatgcataagctttaggtatctaatacattttagccatacattgcaaatctctatatattttaatattattattggttagcgtacttcttggcttactaatgtccactgatgtcagtcttagttattgtcattccttccaatttggaagaacgtttattttctaacactgacacattttgcacagtgaatctataggaaaatgtgactgcataaagacagtcttcatttcagtgctgatgctcacctttctgcattaacatgagtctctttcacgttttatttcatcttgttgcaaaaaccaatatgctttggaaagtgtaatagtacatttttttagagaagtagcatgaggtttgtttctttctcatacagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtaggtatttaaaaagaaaaggtaaactgtgtgtggttaatagacatcctaatactaagcaggctttctaatgggaggctttaagtatggtgatgaacaaccacgttctgactggcgtagttatcgtaggaatctggagcatgctgtgttagaattgaccttgtttaaaactgtcccatcaaaaatggaaatccacagttcccccttcaaatgcagcactgcaccaccctgcaacacctcaggccagggaaagattactgagcattcctgcgaaccagatttctgttgtctctggatagacaagaaacaaaattcatttagtagtggagtggggaataggagtttggatagccttctaattaaaggaagctcgcctttcttggttttgggggttagaggctcttttgggaagatgcatccgagtattgtggcattctgattatgctgccttcacaaaacactctaagtgacctaagtggttatgaagcaaatgcatttatggtgaaaacagtctttgctcattgctttctcttgtttcatttagtgacaaatgatcaagatgacttgattttttttccttcttaacaatgtcttttttatttaaaccaaaggtgaagccagtgtactttctcagtgagttctctgcataaagactaatcagtgggaccaggtaaaaaggtcatataatacattgtggagattgcttacttaatacttctgaaaaatggagtaagggagaaactgtaatgttgcaatatgaacctcccattgggccttccatagggaaagctgtgactactctgaaatggaacctagcattatatccttgtagggtagattataaatcatttccagttcatttctcttagaggtgattacctctagccatcagccttactccatcccatgtttggtatgcaatttgagccacaaggctcgtatcgccaacagctatatacattttgttccatttttctgtcttacagagccatgatagaactgtggttagtgagttaaaattcctggagtaactactgtttttctcctttgaaacttaggtttctaaagttgcacctaaggaatctgtcacattttctgttgaatcatggtttttgtttttgtttttaacagatattccttctgatacggacttgaaaattagtgtatggtgacctgtgtttaaaaaaaaaagtacaatacaactacatatagctatatagcttaatgagacttccaccccccccctttttttttttggtttgttgttgttgtagtagtctggtgctggccacatttaagtcttaaaaatttttaaattttgttgttgatgtttgtagacagccctgttgttgaaatcatggctttattcattttatttattttttaaacttgcctgaatttgttctaaaggaatatttaagagacataattttcttctctttaccataacattacacaaaactttttcctaaaacacggttgtgaggtactgatgaggtgtaagtggagctgttaaaaacagcagtgctgtattgcagttatgtatattcgtgtacagtatgtttagatcccaggtaaacatattcttttctgagaggataaatacctgcattcagatattccaggtaaatataattgagtcagggagtagtaaatctgatggagaattcactttggggaggggaaaaagaatagtatgcaagacccttattggcttttaattatacctgaaaccaaaatggatatttttagtctctctgcatgtgagatttggtgtaacaagatagaactataatatatacagtatatggaaggatagatatagtgctttgttcattttaattgcaaagctgccaaaatagttgaagcttaattacttgacttgccttgatttataggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaaagaaaaattgtacactttctgattttaacttcactaatgtaattactctctcaagaagcttttaaaatttaaattaccatcacacaaccttttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattcc

SEQ ID NO: 38632 - DNA, 66729 bp, Homo sapiens
gagcgccggaagtggggccgaaggaaaacacggagagggagcccggccgggacaggaagaggctggggaccgcggcgaaggtggtgagtgctcttgggcgccttctcccaacgtccctgccagactcgcctccgggctgattctccagttggtttcctggactccagagtagctgtccggcctggccccggaggtacgttggttccatcccccgccggcctcctcgcaccagtttgggtgaccgaggaacccccaggccggcagaggctgagccctcgggttcgagtccgtgttttcactttttgtcagactgcgggcgcagaagacgggatttgggtcaagacattcggctctggccccctggccggccgggggaaccctggaaccccatggagacagcaggtcacttcctgcttcctggtccccacggtggcttcttggccaggagtgcagggacgcctcctctttctccacgtcgggctcaaaagggtggaaactaaggcagatcggtggtggagcggtcagatggggattgaagaggagtgtcattcctcagggaattgctgttcctgacaaaaccaaacttgtttggggttggagaacggggattgaggaggttagatggagttgtcccttgatcggaaacccagcctctttaattacagctgcaccttggtcggaagcccagcccctccgtaacctaagcgctcaaagccggtctgtccagaataggggtggtgaagggacggaaaattggagttgagaaatgtagtactcctttcacgtaaagtttcggtgtataacacttacaagtaattgccaacttaaaaaacaaaagactgtttcggtagtttagtaataatattggcttgggatgaggttttctttgaagagaaacgccttgttacagagggaaaagccgaccatacttgatatgagtaatattctactatgctacagttctggaacctatagagcttctcttattcacacatttaatcttcatgctaaatagtaagtattaattttcatgaagaatattagaggaccaagcctcccaacctctagggtaaagcactgattattaagaatgtgatagaatttttattttaaaaaaatagggagtttctttcttacaggctttggggcatctgtacgataaattgttattttgtatacttgtatgatatcttgttatatagtttgatatttccccaaaataccttctttcaggtgcaaagtaagaaaattgaagtcaaagaccatgggagatacagcaaaaccttatttcgtgaagcgcactaaagaccgggggactatggatgatgatgacttcagaaggggtcacccccaacaagattatttaataatagatgaccatgctaaaggccatggcagtaaaatggaaaagggccttcaaaaaaagaagataacaccagggaactatgggaatacccccagaaaaggaccatgtgctgtttccagcaatccatatgcatttaaaaacccaatctacagtcaacccgcttggatgaatgacagccacaaagatcagagtaagagatggctgtctgatgaacatactggtaattcagacaactggagagaattcaaacctggacctagaattcctgttataaaccgacaaagaaaagactcctttcaagaaaatgaagatggttataggtggcaagacacaagaggctgcagaactgtaagacgactgtttcataaagacctaacaagcctagaaaccacgtcagaaatggaagcaggaagtcctggtaatgttttccaacttgtcagatcacaaccccagagtcagcaatgttttattctttttcatccaaatgagttttgttattttcagcaatttagtttcagtttttcacagtttctgttttaagaaatggtcacttagtgtgattattttaaggatagtaatcatgatatttgagcagctaaaacacatttcatatgttgatccctttaaaagtttactttgccccagggctcactttacgtcagtaaacatgttttctgtaacgtgttttttacagaagagggtagctatatgctccaggggaccatatcgtaattgctcagtggtttgtgtgttttcaaaattgtgattataattttgtatttgaataattaatgtgttcataatataaatgacagaatataaagctttttttaaaaaaaaaacttatttgttgatgtaaaaacacagtatacactgcgtatatctcctgccacaagagatatatcttttggatgtagtgtcagtgtcccgagatggataatctgagatctttgtttttcaaaagggatcgtgacaaacaggttgagaaacaagtttagaaagtcagaaatagattcaagctttgctgtttggtttcagtaagaccaaaactaatttctcggtgccctcacatgcttggttaattgccccaaagggataataaggagataatatgtttttctaaaagtaaaaagtagattttatccatgtggcaacgatttctgcaaacaggaaggttatttttatctaatgggagatatataccgaaatgaaataaagtcacaaattggatggaaaaaatgaaacaatatcacagttggaaacatggacttgtaagtttagtggctgaaagcgttttttagtggttgtatagaatgtgtttcaaactggccagcacttttaaataaatttttttagtttaaatgcattcagggaatatggacactttctagatcacccgatgccttttctcttcatgttatctcacagtggccagttcatacactggttacctataaggtgtttgaatttgtgtcccatgcgtatagaatacttaaaagccaaaaggtcgtcttttatctttacaaggtcttaggataaaaatgaaagtctcaagcacttattaatattaaatggggggaaatgtgctacttgattttttttcttttttcacagatacttctagttgtcagatctgtttatttatattttattttattttttgagacggagtctcgctctgtcacccaggctggagtacagtggcgcgatcttggctcactgcaacctctgcctcctgggttcaagcgattctcctgtctcatcccccaaagtagctgggactacaggcacatgccaccacatcaggctaatttttgtatttttaatagagacagggtttcaccatgttggcctgactggtctcaaactcctaacctccagtgatccacccaccttggcctcccaaagtgctgggattacaggcgtgagccaccacattcagcctgattttttttttttttttttgagacagtctcactgtgtcacccaggctggaggtgcagtgatgtgacctcctctcactgtggcctctgcctcccaggatcaagcggttctcatgtctcagcctcccaagtagctgggactacaggtgcacaccaccatgcccagctaatttttctgttttttaatagagatagggtttctccctgttggccaggctggtcttgaactcctgacctcaagtgatcgacctgcctctgcttcccaaagtgctgggattacaggcgtgaactaccgcgcctggccctcagatatttttaaatttgaaaattaagagtatatattaatatcaagtagcagaaacagaatgaagtgttataaaggcgttaagtagtagggagacataaaacttaaatctttaagctagaaatagcttgaggaattatctgatgcagtactctgttgtaatatatcaaaaatggaatcacagttttacaaatcaggcagctgcagctcagagaggttaaatttccacagacctgtttatgcagcgcggtaaatgaggaagtagaactaaaattggggactctgctactctggccattaactcagcctcgctggacctgaaatcctgacggcggagccgaatatttcttgataatttctgggcttttgatttgtgtttttctttattaaaaattgtgtatatttaagtgtttctgtattactgtccaggtgggatgtgggtatttaattttgttacctatagtcttgtagaagttgatcttgaaaaccatttcattttattattattattctcttttttgagatggagtctcgctctgtagcccaggctggagtgcagtggtgcgatcttggttcactgcaacctccatctcccaggttcaagcaattctcttgcctcagcctcctgagtggctgggactacaggcacgtgccaccacacctagctaatttttgtatttttagtagagttggggttttagcatgttggccaggggtagtctcgataccctgacctcatgatctgcctgccttgacgtcccaaagtgttgggattacaggtgtgagccactgcacccggctgaaaagcattttaaaaagaaagtttatagatcaaaaatttgcaactagacattaaaaggaactgttggctgaccacaaaaacttttatatgttttcttattttatgtgtattcttataaaagcaactaaagaagttgcttttaagtgtatttgaataggaaatgcattttgctatttttttattggaggtaattcaaaagtttgcatgtttttgctgtatgacatacaggtatatgctttcacagttattaagtaaagaattattcagtttctatcccttgaaaatcttcatataggaagcattaagcttcggtataacattatttagtttagagagattcaactgaaagtataaactaaaaaggatctcattaaagagatcgaaatttctttatcaaaattgtgtcttaataaggaagggtattattcaacaatgtgagaagatataatggaaattatggtggagttgcttttttcccccccacatacggtactaccttctgtttttttcagctctacattactgcccctactttagccttcaaatgtcctagattgccagtttaatgtatttgggacattgccattaatgatcttagctggaaagcatccactcaaatacacatgtcctttgtgaaccatatgcaaataaaatatgggaaacttggaatgccgaatatagagaactcttattacaataaatctgaggtaagccaggtagtcttcctccaagtaattatgagaatttttcttttttcttttttttttttgagatggagtttcactcttgtcgcccaggctggagtgcaatggcatgatctcggttcactgcaacctctgcctcccgagttcaagcaattctcctgcctcagcctcccgagtagctgggattacaggtgcctgccaccacgcccagctaatttttgtatttttagtagagacagggtttcaccatgttggccaggatggtctcgaactcccgacctcaggtgatccacctgcctcggcctcccaaaatgctgggattacaggcatgagctgccacgcctggccaagaatttttcatcagtacctagctttaccctccaagagtccctccggtgagattttgacagtttttaccatgcatgcctgtgaaagtaggtttagaaggttatattgcctttcagtgctagtccactctagatgtgaatgggtatgttccaagaagggattttagtaatttctttccagtttttatgttgttagttagaaggctgaatttcaggatttcatcctttttttgtttgtttgttttttagacagagtctcactctgtcacccaggctggagtgcaatggcgcaatcatgactcaccacagcctcacctcctgggcttaagcagtccttccgtctcagcctcctgagtagctgggaccacaggagtgagtcatcttgctggctgatttttttcatttttgctagagatgacatctcactatgttgtccaggctggtcttgaacttctgagctcaagcagtcctcccaccttaccctcccaaagtgctgggaattacaggcatgacccactgcacctggccccatccatattttaatctatattttcaatccctttactttgatttagccatgtgttcttggagaagttattctcttggattcgcattgtccccatctgtacaatggggacagtattagcaggattgctgtagggattaaataaggcagtacatataaagtgctttacatctgttgcataataagatacaccatcatggtagctgccattatctgacagaatttctgcagccatccacttctgtataaaagcagtaggagttgattgaggtctttggaggaagagagaagttactctttctagaaaatgacagcaaatatggttatatggagaaacctttgtgaccagaagagaggaagagtttaaaaaaggaattcggttccctatcacttactggcttgtgaactaataggggcttttctaaagggtattgcagtattattttaaatttatagagtttttgcctaagaaacctgtaataaacactgaagttagatgcagtttttttgataatgtttataatgataagcaaactaaatgagaatggatacatctctaagtaaaagaagtgcttatctgaaaaaaaaaaattgttcagaccagaaatactggccttaaaagattatgataatttaattgggagtcgggggagtattaaaaaggaaatattaaggtagcgcaaggtagcctgattttctgttgaaatgacaacttaccttttagtattttatttgttcagtgtattttgattgattttttaaaactacttttccaacactttaattttttttaattttttaattttcttatattgtggaaggtgtttgcagaattttgagatagtcatctcaggtagttttagcacaatgcttgctgcttatcctttagcgctctcagcaagctttttataaaattggaggtcctatatttccttttcagcctgccagttcattgtaattgccatactagtagtaatgagttcctctgaaaacttgatggaggaattacttcatgtagggcttttcagtaggtttatgtttccaagcactaatgtgttactaatagtttcattttttaaaactcgatataagttatcaaagctatctaaaacaattttttatggtttaatcccacaatcactttaacaagttgaaaagttataagttttaaaaaggaacaggatgatttttattcattataaggattatagaactaatagcagagtttataaacaaatgtacttagagaaaacttttgtttcaatggccagttgtttttttcctttgaaatatgctcagtgtacaggccattcaaagaagctaaaatgaaggtaaaggtaaaatgagagatagttgtccttagtaaataaaattttggcttggacttcttcatattaacggagggacccggcttaggtgttattgatggctaaatttgcaactaaatgatgatttttcactccagatgagtatatagttgatttctgagttgtccaggggtacattttgcattttgccttattgagattgttcacttatagaagatgaaagcaaatgtggctggttttaatgagaataacaggtgtacttacagatattatagaatatgtaagatatatttacaatatgtattgtaatattttaatataatagaattatagatatacttgccttcagagtataatttttctgttgctttgctatgctcagcagtataccaggaagagataataaaaatcaaattgtatgattgaagtagaattcttttaaattttccaaaaagatgatttctatggcttaatgtctacaggtgatgtgctcactgaatacagtattaaagcattttgtccataggacagctacctttccttctgctctgcatgcagatgtgatttattctctcacatgatttaatacatatgtaaggtctgctttttactcaggagtggcattatttaatattgccaataatatttttcccccaccttaagaaaacaagaagcagaggtccagacctaggaagccacggaagactagaaatgaggaaaatgagcaggatggagacttggaaggccctgtgatcgatgagtctgtactttcaacgaaggagctgctaggcttacagcaggctgaggagagactgaagagagactgcattgacaggctaaaaagggtaacatccttatatatatatttgttggttagaatcctggttttagcctcaattttgttgttaattgagtatgcatgctctgatcaattagatatcctactttggttatcagtatttaagcactacaagttaaaagtgatgtccagtgtgatttaataggattaggagtcattgctattatacttaaaatgactgttagggtagtgataaagggaacaataacagtagcaattttaaaagtgaagaagaagccaggcacagtggcatgcctgtagccccagttacttgtgaggttgaggcaggaggattgcttgaactcaggagtttggggctgtagtatgctataatggtatctgtgaatagccagttcactccagccagggcaacatagtgagactcctgtctctttagagaaaagaaattgaaggggaaatcatttcctggctgattttgtttatctgaatgtttggttttacttatgtctctctctaaataaatctcttcaaattatagcgaccacgaaactaccctacagcaaagtacacctgcagactctgtgatgttttaattgaatccattgcatttgcccataagcatatcaaggaaaagaggcacaagaaaaacattaaggtaaattgaatgtaacccaaacaagtctgcttacttgttagttgttattacttgtcatctttgtggctttcttctccttaaggctatgatattgataactttactgctttatttattgaatatatttgagccaaaatacataatactggtcagatgtattttactggttaatcttgtgaatttccttaagggcagcatcaggttatatgaagtcattgataggacccaggtatatgtccttatactagtattaaagcaaacaatgtttgtaagtgctgtttttaatattctttccttacactttctccttatgcccacctatcctctgttaccactgatccacattatgtgcataaggaagtatgtatatgtttgataggatgaaaactaacacagctaaaatgagaagggagggctaagaaaaagaaaactctatagggtgttgtcttcatgagtggtagaaggtcaaaactatgtgtaagtcatttttaatctcaacatttgatcttaaaaggagaagcaagaggaagagttgctcactacgttacccccaccaacaccctcccagataaatgcagttggcattgccattgacaaagtggtacaggaatttggcttacacaatgagaacttggaacagaggctggaaattaaacgtatcatggaaaatgtgttccaacacaagttaccaggtattttctagatttgtttttctatttaactacctaaaagtacctcattcatttctcctaccaatagtaattttcatcaaataaaaatttatttaccatgtcatgaagctcttgtgttttctatttttttgttttttgttttccctggctttccctaaggtaacaaggactttcatatgcattgtcattataaacctgtttccattataaattttaccctgtgtgtgaactttaagttgaatgccctgcattattggggcactgtgggactcttgtgtatgtatgtttccctttccgctcatctaaattgacaccatattttgagttaaaatcaagagaagtatcctgaagttattttcaggttattcatgtcaaaaaaaaaaaaaaagattttatttaactgtacttaagagaattgcagcatctaaaatgaactttgaaaactagttttaagaaatttgtattggattttgtgcactgttgaattgattttccaagttatgtctgtcttctgcctgtttttaactttagacctttggcatgatggggagggggcacaactatttggagtgtattactatgaaaatttaaggtcaggtatgttcaatgcctgacacaactgctgtcaatccttgatggcaacaaaccccaccccacatcatcccccaacccccactggccattgctgtttaggtaaatggttggaatagcttcatcattctcaattcttgctgtgcatcagaattatctgtgaagccatggacaactatttttacaaagctcgacaagtgattctgatccacagctagggttggaatcattatttatatttgtcaccttataaatcttaaaactgtttgttctactgaaagatcatacatatagtatttgtaacgcatatactttcataagaataagggaaaataatctcattttattatacatgtatttcctgaaaagtcagttgtaattctgatgatttttactgtaaaatttcatgtaaaaatgaatgtactttgttgtggaaaactgctaaaacccaaagaaatcacttgaattttagcaaaccttaaacaaacaagaaaaccaacccctgatgagaaaggatactattttggcatcatagtaaaacactgaaaataaatgctatactatagatagtactcatatacacacacatcttcctctgaagagtgaagtgtctgctacctatgtcagtgatattgtaattatttttcaaaagtttattgggattttgttacagcaaacgctttttgttcataatataatgagaaattcatattaaatatgtcaaaagattatttttattattgttttactaaaacctccttatagtaaattacaccaatgggtgcattctaaaaggtgaaaagaaacgtttgcattagctcttgaatatactatcaggtttataaatttaaacaaagacattctttttcaactggcacatttaaaaaaatattttaaatagtattttcttcataaaatgtgatatttagataatagtattttattcataaaatacatgataacgtagcaatttgacgttttacaactgacatgaagcgtggctgttaagctaaatcatagttgatgcagccttccctattaaattaagtgaagagcaaagagccacctatttctgtcctttgtttatgctagtcttgaatacaagtttgcttttgtgtgtaattttaattgatggttctgcttctgaaatagcagtgttttgttataacttttgagaaattctactgtatttattacttttatttatttatttattttttagattgttccctaagattatatgggtcatcctgtagcagattgggtttcaaaaattcggatgtaaacattgacatccagtttccagccattgtaagtacaaaatgaaatgctggcactttcagagtggtatggaaattctttcttacaaatgtaaactgtctatgaatatattttagatatttgaagatattttaagtgtaatgacagcatccgcttgccttcagtttcagagcttttttttttaatactctgcaaattttcatacttattttagtctatagatcttttatacatccaacactggtttttcaaccatgtgcacctgatgggggtgtttaggttctgttacttaaaaagagtaaattttcttgataaaatcaactttccagtggcagaaagggaattcagattttaaagtgtagatatttaaacatttatgatctgcaagcttaattgtctctggagtttcctctttttgtatacctattttgttaaaataattaggcttttaaagaatcacacctagcctggatttctggtttaaacatgatttaaaagtatgttgatgagttagaattttaaaactggagtgtagctggacacggcacagttctgtagtcccagctactctggaggttgaggcgggaggatcacgagcccagaagttcaaagctgtagttagctgtgactgcacttgagaattgccactgcattccagcctgggcaacatagtgagaccctatctcttaaaaaaacaaaaaactgaaaggcactttagtagattatccatttctctgctgttagttcccacaggcctgtttatagatgatgtgtttgcagttacttgggttgcttgttaaaaatccatattctgagctgggtgcagtggcttcaccctctaatcccagctactcgggagactgaggttggagggttacttgagcccaggagttcatgaacagcctggccagccccacctctctcaaaaaaaatccagattctggggccccagaggttctattttacaacctcttacttcttgctaaacctgagtgctgtagctacctggtaagctacccaatagactgtttttttaaccttaaattctgatcagtgatttaccagccatagcagttattttgatccggtgtcattaattcatttagcaaatattcactcatcccatttgtatggcagacatactaggttataaaggacaaaacagagatggttcctctttatggaactcatctagtaaaggagattagtaattaccttgtaattatagtgagagctgtgcaggtaaaggttcagggatagaaaatgacaaggtctgggcagagatacagcagtcatgaaggcttctttgaagagggaacatttaagctgagttctaaaagacgaaaaggagcctgcaggagagggggaaacgggagggaaaagagtttcaggcagggggagcagcatttgcaaataccctaaatcaataaagagtttggcatattcaaggagctaaaagaaaggttgtgtaagtatggtgaagggaccaagaaaaagaagagcaggagattaggatggctaggtaggctgggcttgactggccgaattgtgtagaccatggtaaataaagaatttggttttgacctaagggcagtaagaagtcattgagagttgtaaggatacagtttatgattttaaatggccctggctccattgcgaaacaaggattttaaaaagaagtgcaagactgactccgggaccagtaagctatctgttgcaatggtattagagtgaaaggtaatattgttagcagtttgacaaacttccagctaccactttgagacttgctgagaggcaggttaacctcaataattagttaaatcagaagttagttgtatagtaggtctcttgcccacatttgtcttcatttggtgttgatctgtctgtctttgactgacatatgcaaacaacatagtgagtaatttctttactttgatagcaatgtgcatttctcatttagaaaggaatttggggaacttcggatgactcttatatcagtgaagcaaaatcacttaggaataatttcatgtattcattgatttatttcctagatgtctcagccagatgtcctcttacttgttcaagaatgtttaaagaacagtggtaaggccaaattccacatttaaaaaatttttatgttgtctataatttggatctatcttatttctcaaactttgaaaatagcaaggcatgcttttaaaattatttatgtgggtaatatccaaagcaaatgcccatgaattattaactagagtcctgttagtagttctactatgcagaataaccatttcataagtaaagcttttagcttgatgacatcatcactatttataaagattaaatgagtcctagatgtgactaagaaatgcaaaatatgtaaaatgtactcttgagggtaaaactgaaggataatctgcttttatcaatggttaaaatcagtattttaccaacagtgaataggtgtaacccaaccctaattaatgaatccacagagtggtgcccatttaggtttatcagttgtctaatacaatgtccagcttggggctttatggctctttgtgttttacatagtccttatgaaactgtgtcatctcttgaattagtcatccccatcctccttgttttggttaaattttgtcttcgatcaatacatattttgacactgaatattttagtagcttttacagcaactttgtttttaaatgtattacctatatttctaattgttatccatataacatttgaattttctgatccaatgatgtagtcacttataatgaaacattcactttacaaactaagggttttacactaatgtgataacttggtttttgaatgtaatattttttccttttcaagtcattgcagagcattatttagtagtggtctttcaaaagactcaacagctaagggacaactggtacttgtactttatctggttctgcttttaaacaaagctttaattaaccaacttaatatttttcttcttctttcctcagactcctttattgatgttgatgcagacttccatgctagggtgccagtggtggtgtgcagagaaaagcaaaggtctcatttctttaaactgtttatttactaactctcaacttgccaaaagcacaagtactttactacatcttaatgtccaatttctagaattataagctttttatttggttatcacacatggttcctactaacattctccctatacttttggcatttgatgtaaaaggggaaaatctcattttaaaaataataaaatgacttaaaagaaaaaatatagcaaggaagtatttcggtccatttcaactcgttaaaaaacagccttattaaatagttacttgctgtaatcacctgtattttgccaccctttttggcagcatttatggcagtgctgagtaacagtgtgacctctctggtttatctctctctgcctctgtgtgaaagcattactgtcactactgtaaatgggtggtttataggctgtaatgattcttcattaggtacattcctccaactcttgggaaaacactcttttattgttacagagatgaatcatgctcccatttgaaacttttttttttgagacggagtctcgctctgttgcccaggctggagtgcagtggcgcaatcttggctcattgcaacctccgcctcctgggttcacaccattctcctgcctcagacttccgagtagttgggagtacaggtgcccaccaccacgcctggctaattttttatatttttagtagagtcagggtttcacccaggatggtctcgatctcctgacctcatgatctgcccgccttggcctcccaaagtgctgggattacaggcgtgagccaccatgcctggcccgaaacatttgataatattttccttatttgcatttccccccaaaaaataatatttgaaaacaaaattattaatccgaaaaataaagtttactcagaaaatagccacgatatcttttttgtaaagaaaatttattaaattactcataaagatgtagtttttttcacttttaagctttttatttttgaagtatttattatgcatgtatattagttgttggcataaaagacactttgagacctgtgtaacacttttttctttttttctttcccatcctcctcccccacctctcaccagtggtcttctgtgtaaagtgagcgcaggaaatgaaaatgcttgtctgacaacaaagcatttaactgcccttggaaaactagaaccaaagctggttcctttggtgattgcatttaggtactgggcaaaggtaggcttgaggtctttatgcatgaatacattctacatatgtataagcagtatgctttgatttttacttaatttaatcttcagtgtttaaatgcaaatttatagacatcaaaagagaaagacatctgaattttgcaacagaaacgtacagacggaagattcagtgtttctgtttcactttaacggtattgctcaaaagatcaaaatgatttatagggcttattaaaaatcagatttgtgagttaaatctcagaggataaggcccaggaatttacattttaactagtttaccacagtggttgttaggcacaggaacgttgagataaagcttctcatatcatgtccaataacatacacagagacggcaaaaaatagaagatactctctgatcttgtttacatttccataatgttttaaatatatttcaattaaaatactcaaacagtagaagatttaacgttcccccaaaatgtgaggttgagtcatgattataaaattgagattctgtcgcttgaacctgggaggtacaggttgcagtaagccaagatcgtgccactgcactccaccctgggtgacagagcaagactctgtctcaaaaaaaaaaaaaaaaaaagagattccatgtatgtgcttttagagaaaatcaaaagctttactgattcaggtatatcaataacaatagatacttcccgtttcttggatcctgaatgaacaacggatttcccactcttcactggctaaattataattataatatgctatcctttgaaaaccaccgcctgcttcatcactaagtagaacatgcccttttagttgttatttccattagtggtgatgagtttgtccacgttctctccccacgccaatctttgtgaccaaagcatgcatatgcaagacgctatgggttagggtaagaggaccattgaactggcttaatgtgtaactgaacaatcgtttttaattcattaacatgtattctaaacaaatgaatgaattgaccatggatatcaaaaaataaaataggaaataatattttagggccatccacaagtgagtatggttaacaggattaaatattcaaaattgaaactatcacttaaaaccacaatatgtggttgctgcaaaagtataaggaagttgtatattttgtaactgctattttcagctgaagaattaccgtaaatcatgtagtaaacaagaatgaggttacaggttttaggccaaatcgtgtaaatgacaaattcatacaaaaagaatgcttaactttcttttctcttgtttgtagctttgcagtatagatcgccctgaagaaggaggtctgccaccttatgtgtttgccctgatggccattttctttcttcagcagaggaaagaaccccttttgcctgtatatctaggatcatgggtataaaacattttttttgcttatatatctgaacagattttattacaggtccacaattaaattttgcataatttcaaaatctagacacctaaccagaactgacatggatttatttattctactcatgtgaatattcatacctttcactgctgaaatactaatgtgtttgatttcagtatgttgccctataacctgcttagggatattattacctttctagactgcaaaatctcttaatttttgaaatatgtatggtcctgagacgaacaagagactgaccctgtaaatttaccatttggtacattctttctttgggtacagttttctaaattgatacttgaatttacatatcacctccagacagacagactgtgggaagcatttggttcactgtaacttactttctgtttctaatctatttctccccataacctgtaaaacaaaaaaatatataaacattgaaattgctacctgtaccacaagatgcagaacctagtagtcatctcttgaataatattttgacattattttaaagatgaattagaattcatgtgatcactctttctttctggataaattaatgttgagttgatttgttcaagtaagatttaagaagagaccatctgaaagagtcaacatgatattagctcatcctcttagaaaccttgtttgtaatcccttggtattaccttgatacacttttatgtgtagaaaaactcccattttatagaaagaccccttagtgaaaagcttactttgacacattggctattgtaactacttttcttaatgcacacaagtttctctcatcatttaaggagttcttaacaatgagtacacatcaaaaaatacatttaaagagaattttttccttatactgaataaggtgagattaagcagggacttctgtctaccaggccgtgggaataaagactgaagtagaataactcacttagaaaactatcctggcataagggattattgcatgctgtgtatcctagtaacctaaaggtagttctcttcgtgcctgtggtactgagagaattcagagccatgagagggtatctctaccagactactgtcctggtagaaaaaagagcaagagaacaaagtcaacccttagttgataaataactctttccagcacacccaagtaggaatgtgtgaaagtctttgaagttttcctttcaccttgatctaagagagataggaatttaggataggattaaatcaggtggactcctgcacctaaaaaaaccctggcacaagttggataagttgccttgctcactaccatcttactgaatgagatctgctttttcatgtgtcttgatcttctctaagtagtcatctgtcattaacatgagaatgcaggaaaaagaaaaatctcttctggtgatgagattctcctaaggatacttcagggtagtatggataccctttcctatggccagcatattatttccttgttagtgataccggaaactctctaaagtgatactgaatttgattttgattggatcatgtttgttcaaaatttaatgacaaaagcaggtatgcagtgatcaaacactggattgaaatcattggatccattaaggcacactaccacccgaaccaaaatgatcctgcggtgttcagcattttaaactagttaggaagtgaagagaatggaactaatacttactaagtatctttatgctagatattttacatacattatttctgcagaaaatccaatgaggtcctcataattatgtacatgagagtatctaactgttaattccttcaaaatatttaaagcactgtgtatactagtcattgtagtagtgcctgaaatacaaagatggacaagaccaaattccctgtcaggaagtttagtgtattgtgcctgtgttctctgatctgtcttttcacaaatcttttagtcattctgtcccgacctacccagatctcttccatgttggagactccaaccctctccaacctttattcccaatcataattcccattttattgtcattaaatcttgatatgattgaagttaatcatagtgagttgtgaatgaagaataattttatattataaaaacctagtccttagcagatattcatactttagagatgccaggtaatatagtagaaaaaagggtgattttcaagtttaccagcactgggactcatctctgttttgccactcacatccttgtgaccttgagcaagttatttaatctctgagcctcaatgtcattctgaaccttgaatgagataatgaatgtaaaattcctgaaacaaggaaggagaacaaatgttatagtccttttctccttcagtagaaagtcaagttccacttatggtgtggaagtgtgaactcctaatcaagtgatccttctgcaaataacaactataaactctgggcaacatacagaaacaacagcatcaaaaacctgcagactgaacaaatgcaaacagtctttagaggggagtcaaaacttggagcaaatgaccaacacagagtgagtctcctgtttttctgtagctctacccctaaaggcaactctgatttaagacaaaaatcagtcctcttcctggccagaggaaccagggccaccagaagataaggtgtacaagaggaggaactgaaaggaaagataacagataagtggaacccttaaaacccttaaaaagaaccctgggtataaaaactcaggatgtctctgcccaactcctgaaccagtttagtttggcatgaaaggagcccagaagtcgtcactctcatcctcacaagaaaaaaaactgaacaaacggaaaatcaacaattctttttggatccatcagacaattgatgtcatgggcaaaccactgcccccagaattagagagcagggtaatacagtgaagcacagcttaccagagcagaaggccaggagcggaatcctgccactgaagccaatactagggtagaaaaatttaaagtgtagttgacaaatttccgaaggctcagtttggacaagcttgagggttaaaaatttctcccattcttaggagggcttcctcagacttttgtgtgagttatacctccaggaatcccactaagctctgagggtaaagacctgagaaaaatctcccagtgcttctggcaggatgagaggaaaagttgccatttagaaataatgcccagagcattctttaattattgaaagcctgcccttcggaggtactcttactgaagcctaaccaccttgggttttacttgccacgggaagggaggtacctagctccactgctccagccttcctttctcatctaagtaagggtggtagtaggagaactgggaaatagttatgaaggtcactgtctaggggcacaagctcactaaaagactgagacctaatcttaggactatacagtgtttcccctctccagggatcacaaggtctgaactacaagtctcagaccttttttaagaagtctttagggaaacacagaggcaacaagggagacaaaaacaaggacaccagaggaattttcagctacgacagctgcagaaaacaataaacatcctaactcctagccagataaacataaaacctcaccctaaaagcctgtttacccagtacatcgtgtctagctttcaacaaaaaattacaaagcatgctgaaaggcaaaaagcacagcttgaagagacagagcatgtgtcagaacttaagttggatatgacaaatgttgaaattgtcagaccaggaatttaaaataataatgattaatatgctaaaagctgtaatggaaaaaatggacaacatgcaagaataaatgggtaatataagctgagaagcagaaactctcaaaagatttaaaaggaaatgctagaaatccaaaaaattataacagaaatgaacaatgcctttgggctcattagtagactagacatagccaggaaaaatctgagtatgaagtgatagcaacagaaaattctcaaactgaaaagtaaagaggaaaaaggaacaaaatacctaagaactgggtcagttagtcaaggttgaaacatatgtataatgggaataccaagaggagaaagaaaaaagaacagaagaaatagtagaaggactaatgactgagaatttttcaaaattaatgccagactcctaaaccaggcctgtgtggggcagattgaatatagttgggggccaaggcttaaagaactgatgcaagagctgagccacaatctactggaggtgtgataatttccagtttgcctaaacaagttaattacctgctgctaaaacaaaaacatcactttttggagtaaaataaatgattaaaattttaataatataatatttacaatgtctaaaatgcaatccagaattactcagaaagagtcaagaaagtgagacctactctcaaaggaaaagaaaatgaacaaaggcaaactccaagatgacccagatgcaactgtcaaagacattaaagcagttattatagctgtgcttcatgacagaggaaataatacatgtggaataaatgaagagataggaaatgtcagctagagaagtaggaaatatcaaaagaaccaaatggaaattttgtctgagtggacaaacagaaaacactcaaatgttagacctaaaaccaatgatatcagtaatcaacttaaatattgacagactaaatatccccactaaaaagcatagattaccagaatttatttatttatttttaactttcaggttcaaaggtacatgtgcaggcttattatataggtaaactcatgtcacgggtttattggacagattattttatcacccaggtactaagcgtagtacccaatagttattttttcttgctcctctccctccttctacccttaaccttcaagtaggccccagtgtccattgttcccttctttgtgtccatgagttctcattatttagctcccacctataagtgagaacttgtggtatttggtatttgattttctgttcctacgttagtttgctaaggataatggcctccagcttcatccatgttcctgcaaaagacatgatcttgggtttttttatggctgcatagtattccacggtgtatatgtaccatattttctttatccagtgtgtcactgataggcgtttaggttgattccacgtctttgctattgtgaatagtgctgcagtcaacattcgcatgcctgtgtctttatggtagaatgatctgtatttctctgggtatatactcagtaatgggattgctgggttgaatggtagttctgcttttagctctttgaggaaagtgttcccttttcactgcaaccttgccagcatctggtatttttgactttttaatagtattctgactggtgtaagatggtatctcattgtggttttgatttgtatttctctaatgattggtgatgttgagcttttttcatatgctcattggctgcatgtatgtcttcttcagaaaagcatctgatcatgccctttacccaaactttttaatggggttattttttccttgtaaatttgttaagttctttatagatgctggatattagacctttgatatatagtttgcaaaaattgcctcccattctgtaggttgtctgtttactctgttgatagggctatgcaaaaattcttcagtttaactagatccccttcagaatgaattttaaaagcaagactatattctagaagaaataaattaaatataaagacatataggttaaaagtaaatggatggcaaaagatgtaaattgtaaccaaacgagagaggctatgttaatatcagatgagattgatttcaagtggaaaaaatatgccaaagacaaaagggacattttattagggtagggtcaattcattgggaagacaaaacaatcgtaaatgtttgcaactattaagagggcaccaaaatacatgaaataaaaattgatggaatatattctaccatcagacaaggagattttaacagccttcatcaattgacacctgtgttagctaaacaaaaaatcagtatagatagtataaactgatacatcatatcaaccgccttgacctaattaatatttataaaacactatacccaataactggagaatacatattttttacaagtccatatggtacattcatcaagatatactacatgctggttcttttgtttttttaatttaagagacaaggttccactatgttgcccaggctggtctcaaactcctgggctcaagcaatcctgtgtcagcctcccagaggagggcctatgctggttcttaaaataagtcatagtacatttgaaaggattccatggattaaagaggaattcaagtgggacattaaaacatattttgaactaaataataataaaaatgtaagatagtttggcatagtggcacacaccctagtcccagctactcaggaggctgaggtgagaggattgcttaagcccaggaggttgaggtcgaggctgcagtgagctatgatcacaccactgcactccagtctagaaaacagagcaagaccccatctcaaaaaaaaaaaagaaagaaaaaaatacaagatatataaaatttgtcagatgcagctaaaatagtgttcatagggcaagttttagatttaaatgcttaaattcaaaaagaaaggtctaaaatcagtgacctaaaggtccacctcaaaaagctggaaaccaaaatgggtgaaagacctaaatgtaaaagttaaaaactctgaaactcctagaagacaacctagggaaaaacctttgcagaaaggatttcttaacatactaaaatcaataaagaaaaacattaagaaatcaaactttatctaattctaaaactgcagctcttcagaaaatatcactaaataaacaaaaactcaagctacccagttgagaaaaatattgaatacatacatccaaccaagaaatagtcactacgcctaatattttccaaagtgttttctgtggaagactagttcagtctgtcaacaaatctttactgagcagttaccatggccaggcaccaactaattctgggtgttactgttagaagtggtgaacagggccgggcatggtggctcacgcctgtaatcacagcactttgggaggccaaggtgggtggatcacctgaggtcaggagttgaagcagcctggccaacgtggtgaaactccatctctactaaaaaaatataaaaaaattagctgggcatggtggcaggcgcctgtaatcccagctacttgggaggctggggcaggagaatcgcttcaacccaggaggtagaggttgcagtgagccgagatcatgccactgcactccagcctgggcaacagggtgagactctgcctcagaaaagaaaaaaaaagaagtgaacaaaacacaattcttgccctcgaatttatacatccaattggggcaagagactaataaatatatatgcagtggtggtactttctctgaggaaaaataaaccagggtaaggaggacagagaatgataaatgtggagctccttagagaaaacatttgagcagagctgaataaagtgagggagaatgagtcatagtctccctcactttgttagggggaagagcattttaagcagagggaataccaggtgtcatctctgagccaagaagatagaaggatcagagaagtagaaaagagccaggttactcaggccctggaaaggactgcacttcatctagagtgagacagaaaccactatgaacaggagagtgtgtcttctgttttagaaggatcactctcttctaaaccaatgaagtagcccatttggtataaaaatacatttgggaaatgtgatgtcacatccatactccatcccatattattttgttcattaacctgtttttgtttgttttttgttttgtttttttttttttgagatggagtttcgctcttgttgcccaggctggagtgcaatggcaccatctcggctcactgcaacctctgcctcccagggtcaaacaattcttctgcctcagcctcctgagtagctggaattacaggcatgcgccaccatgcctggctaattttgtatttttagtagagacgggatttctccatgttggtcaggctggtctcgaactcctgaccttaggtgatccgcccacctcagcctcccaaagtgctgggattacaggcatgagccaccatgcgtggcctgttcattaacctgttttaaaggctgtgataaatcctatcatacgatgaagaaacctgttcagctccgtttgacatttcacaagccttttcaactagaccattttcttttgcattaatattcattaatagcacataaaatttactttgaaaatgtccagcatacccagaattaatagtatttaaaattattttctaattagctggatctagttcttgtaattttcattttctagcaatatagttgtcttgtatttattaagcagttactatgtgctgtatgctacaagcagatactacctctatctgagtgccttatggtcattttttttatatcataaccatcccatgaaggaagtcctagtgttacccctttttaaaggaacctgaggcctacagagagtaagtaccttactcaaggttatacagctagtatatgaaggagctgagatttgggaccaggcagttttacttcagaacccatgacgtcagccactaggccattttgcctactcttagaatatttactgaggaattatttcacaaagtcaccatttcttttgcaaatcaaaaccttgttttttacttttaaaaatatttttaaatgtatagatgtctctgtgatagtccataaattatatcttttgtattttcgttgaactatgagtatttttttattccaagattagtagactgtgtttgatataagattatttctatcttattttagcatgtgtctaatttttcctagattgaaggattctcattaagcaaactagggaatttcaaccttcaagacattgaaaaagatgttgtgatctgggaacatactgacagtgctgcaggggacacaggcataacaaaagaagaggcaccaagagaaacgccgattaaaaggggacaggtctgttctcttttgtttctagttgtcagtttcacttgccaattgtgaagttgtggattagtcagtcttgtcttctttccttaactatctttactatttcgtggctctttcatttgccagtctgtttagtacctcgaacagacaagtaatgagaaaaggttaaaaaaaatattagatcactaaatccacagttatttatgtagtttctttgtgctggttcctttgaaagagactcagaattcaaaggtaaatccatatctatcctcaaagagcttagtcttaggtggtattatgaggtttaaatgtatgaaaggttaactagctttcagttactaaaataacagtgaatgcatatatgatttaatgtaccggtcccatactgttgggggtgggcaggggaatttatgcacaaggaaagaatagccattagaatttcaaacaaaaatctctgcaatgtcattatcctagtaataagaataagattctctcccaaataggtgaaaggcccctgatcttcccgttaccttttggggtaaattgacagtaacatccacaaaattcttggaatcgaatcccagctttatacaaacaagtcatgtcactcctccagttcatgttttactcatgcctaaaatgaggagttagtggtgaatcagattttccagttgtgttttctagaatccttgaacactgggaggaggaggagagtggtggtaccaccctacctctgctgccaccagaaccacttttatctgtttcttatttggagtctctgtagtggagaagagtataggctgtggagccagaatatgtgaatttgtatcccagctctcccacttcccagctgtgtgtccttgggcaagtgacttcgcctttctgtgcaccagtttcctccctactcatggggataatattggtaccctctcatagggtcacttacagaatgcttaactcagtgccgagcatgtggtgagcactcagtaaatgttagctgctattcttattttatttgaaaaagaaaatgttctctgctttaaagaaaaccagtttaagttcctgtagtctagatatttcaaaggtctctccagtttcatgttatggtattatcaagtcatttcagtgagatgcttaaaaatcctttgtaatgccgctatggataaagaggtaaaatgtaataatgcttaaaatttctggggggtttatttgtgtcctcaaactgtagtgtttgggacttagacaacttccatttttaatcagttctgccttgtaaagccaccagatgactttgtattacttgacagaacctttgtgattgagaaaaatagaccactgattttgaagcttaatataataaagtatgattgaaaacaaatttgtgcaccttagaggaaattacttttttcagtgtgaattataggaaaagctattgctgtaaatccatttaatgctttatttttacatttttatgttatttggaaagattaatcatgctgccacttctgaaataaagtgagcttcagacattatggggttgcatatggtgtgcactgtactgagatcaggagacattgagacattgttctcatccggccactgccaggcagtgcaaccttctgacaagccatgggcactcgtggggcttcagttccttctcttgtaatatacaggagttgaactagattacctcttaagagcatcttacagtggtgacattgtgtttcagtgatatatggatttcttgtacttaaaaaggctatacctacgtggaaaaaatacagagagcaaccaagtctgccagatgctttcccttgtttctgatttaatcctcatcactatcctgtgttataggtggtatcatccctactctgcagataatgatagcgaccattttttgaacactgtgtgccaggcactgtgctaagcactttacagacactatctcactcagtcctcccaacaaccctatgaggtgggtactgttatccccatttttcagatgaggaaacccagacttagacagattatagaccttgacccagatcatacacagctagtacatggcagagtttggatttcagatctaagcttgtcccaattccaaagcctgttctcttagccactgtgctgtgctaccagtctgagaatgaagaagctaagtcacagagcaattaagagctatgacgtggcagaatctctatttgggcccatattttcccctatcctaagtaatatgtactttctaatatattacatcgcagttatgttccaacttgtcagaagtctgtaactgtaaaaccagtgtcaatttctgatggcaagagttatttgactttaaaatcagttgtcactgacagagtcaatgtgcttatgtagcttctcagggcagtgagaggagtgtttttcctttttctctatgcctttagctactgtccatttttgtgtgtctgtgactgtaaaggtgcctccagcagcagtaacaggaagagttcagtgctgagaatattagcaacccatgcacagtcctctccacctgttattaacagttcaaaattaggagctctgtctggttaaataaaactgatcctgtctattcctgtgataatgactggattatagcatactctaatcctaatagtgcagtgaagtaatgctgttttaccacaaacaaaatagaagttagaattgatttatctagatggattgtcaggcttatatctttgttaaggttttccagatttttttaatttgatgcttaaatgatctttaattttccagattgtacttacatctgaaataacctgtatgtttctctttgctattaataggtgtcattaatattggatgtgaaacaccagccttcagtaccagttgggcagctctgggtggaattgctgcggttctatgctttagaatttaatttggctgatttagtgataagtattcgtgtcaaagaattggtatctcgggaattgaaggattggcccaaaaagcgcattgccattgaaggtatctcaaaatgtttatcttattcccccccactcttttttttaaaggtaccagtctaacagcatgctttttatttcagtctcttttcagctcctacaagtaaggtaggcctgccctcaaagggaaataaatagttagaatcttgcatgtgttaacagtgggtcatttcaaggaatcaaactgttcaccctgggtttttaaagtataaacaacttgaataatggctggctgagtccttgctttctttgtagattgcttaaccacttaaatgcctaaagtatgtttttcacagtgatgtgtaaatccccctttcctctttaccattctcacctctggattttttaattcagtccttttgtggattgttgaagttgtttagttttgcaaaggtgaggacaatactttttctcgtcaaaaatgtcattctccattggattcctctccagtagagagaatgagtagttatttttgacatatctacagtagcatttagaacttattcataaaaacacatttttagtgaagcctcatttaactgaaatcactttatcaaagacacactgatgtgccctgtagacatcattaaatggactagctcttctcagctttgcaaagtcaggaggttgaaacccctctagaaatcttaattctcctcctttaaataatttaaagaacctcctaaatggaattctcttatttttgcttgatttttttttcaagctttatgttgcataagagggttttttgcattttgcataaattctgtgtgcagtcatggggatctcacatttttaaaccctcccctgcagtttctgtggctcagctcttctggccaattgcctaacctgctggagttctaggggaggagaaaagattgagagaagtggtgtctcctcctggtgcctccctctcgcccctgaaattcagtccagccaattcagtgatggggcttcccagggcagaagagtggaggtaagctcgataaaccacagggcctggctgagtggggaggcagagcactcagcagcagcagagcctggtgggaagatcttccttcccaagggcctgagagccacgctgataacatcttttctacctccacagtcacagagcacaatagggagaaggggtactggttctgaacagaatgggttcccttcatagagccgatgtttcagaaaatactgctttttgttcttaaactctgttttcttactccccacccccagtttttttttaagtctataaaatgcaagataaattttaccattgtttgttgtctgtttttatctgcagcaggctaatttttaaaacatgaaatatagtaacatatgaagagatggatttttctttctttcttttttttattacagatccctactctgttaaaagaaatgtggcaagaaccctaaatagtcaacctgtgtttgaatatatacttcattgtttaaggacaacatacaagtattttgctcttccacacaaaattacaaaatccagccttctaaagcctctgaatgcaattacatgtatttcagaacattctaaagaagtaataaatcatcatccagatgtacaaacaaaagatgataagctcaaaaactcagttttggcccaaggtcctggtgctaccagttcagctgcaaatacctgtaaggtacagccacttactcttaaagagactgctgaaagttttggaagcccaccaaaagaagaaatgggaaatgaacacatcagtgtccaccctgaaaactcagactgtatccaagcagatgttaactctgatgattacaagggtgataaagtataccatccagaaacaggaaggaaaaacgagaaagagaaagttggaaggaagggcaagcatctgttgactgttgatcagaaacgtggagagcatgttgtctgtggcagcacacgtaataatgagtcagagagcactttggatttagaaggcttccaaaatcccacagctaaagagtgtgagggacttgccactttagataacaaggctgatcttgatggagaaagtacagaaggtactgaggaactagaagactctctaaaccactttacccactcagtacagggccagacatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgaagaggatgatgagttaggcgaagctgctaagtatgaagacgtgaaagaatgtggaaaacatgtagaaagagctctcctagtggaacttaataaaataagtctcaaggaagaaaatgtatgtgaagaaaaaaattcacctgtggatcagtctgattttttttatgaattcagtaaacttatcttcaccaaaggcaaggtaatcagtaccaccactagtcatagaactaggagactttaaggactttgaatgcatttaatttcaatttttatatactaggaattttcctattttggtagtgttgaacaagttggcctttcattctgatatgactgctcggtctgcttttctccttaagactcatgggaattagcagaggaagggaatgctattagtagtgaaaatagccactatgttctcctaatgatactataggatgtccccatctctcagatcatttgagtggatgcatgttatattttcatttcctttggaaagtgaataggtgactgtgtacttttaaaacatgattccagactcctttatttggcaaataaagtgttaagtcttgttttgctttgccatattcctgcagtctcctacggtagtgtgcagcttatgcaaacgagagggtcatctaaagaaggactgtcctgaagacttcaaaagaatccagctagaacctctgccaccattaacacccaagtttttaaatatcttagatcaagtctgtatccagtgttatagtaagttattcacatttcttttgatttgtcaaaatattaaattgacatttactcgagtctttagaatcactatcctatttaggtctctaaacattattagggaccaagtctattccattctccattgtatcctcaagcgttccatgtcatgtctgttctgtttgggacatgcaataaatgtcaaagaaggatgaggagagatgcagggaggatcttttttatttaaaaaaaaatttttttttaaattttgagacaggatctcattctgtcacccagactggagtgtagcagagcaatcatgagtcactgcagcctcgacctcccagactaaagcaatcctctcacctcagcctcccaagtagctgggagcacagatgcatgccactatgcctgactaaatttttcattatttgtagagacacagtttccctgtgttacccaagctagtcttgaactcctgggctcaggcaaatggaggatcttttatttttcttttaatatcaagtgccttctgtacttccttttattaacagcatagttgttgcatcaagatacatagcaatcatagcaggtttccttttttggagggtgatggtgagacagggtcttgctcggtcccccaggctggaatgcagtggcgcaatatcagctctccacagcctctaactcctggactcaagcaattcttctgcctcaaccacccaagtagctggtattacaggcatgcatcaccacacccagctcattcttatattttttgtagatacagggtttcaccacgttggccaggctggtctcaaactcctgacctcaagtgattcatccaactgagtctccgaaagagctgggattacaggcttgagccatggcgcctggccagcaggtttctttttaaagcttagtattaaatatctttccccatttaaattttccattactctgccaagaaaaaaaatttttttttttttgagacaaagtctagctctgtcacccaggctggagtgcagtggtgcgatctcagctcactgcaacctccacctcctgggttcaagcaattctcctgcctcagcctcctgagtagctggaattacagtcatgcaccaccatgtccagctaatttttttttttttttttagtagagatggggtttcaccatattggccaggcaagtctcaaactcctgacctccagtgatccgctcgccttgacctcccaaagtgctgggattacaggcgtgagccaccgctcccggccaaaaattaaaattcaagttacttgaagcctggacacacttccctggctagctgggctatgtaaaggttggtggtgttattcttcctgctgtgtaagcagatccaggccccagaaagaagggaccaggttatataattgtttttgaaaagtttgctacaaaaatgcatggcctgttataagccaggatacaaagtaaggatgagggtaagggagcgacatttttttccagaagaaagatattttctgaagagtctcagttcataattttcccaaaatcgttggaagagagggtaaaatctcaatatgaatttcaaagtactgtctctgtgaggggccgaaagttgccttgctgaggatcttttattaagtcttaaaattagagtagtagcatttcccagctggcattctttgaaatgtttttctagatggcagttaataatatttcatcaccagaagtatacctaggccagcgagggaataacactacacactcccttctctcttagaattcctgggttatttccaggacatattagcatattgaaggtatctgagaaatattatttctaaaatttgaacatagaataatttttgagtaacgctaattaatagcctacttaacagccctttaaggaacacaaatttggggaagcattggtgtagagagccttaaagttttacaaaagaaaatatttaaaggatagatgttcagctgcttaaaatgaaggaacttgtttcacatggcttcatcataaggtgttcatccgtgtcagaagacacgtgttcttaacaagtccttttttttttttttttgggaaattttttttttttatattatgagctattaaaaaaactaggttctccttagggaaaaaaatacatgcaaatgctcacaaacttttaaattcacactttagcggggtggtgatttctgaaggccctttctgtaaccctggtgtctttcaggaaacccaggtggagatcccatgtttaaattactttccgtttcaagagcacttcttagattctttaaaaaaggacatcttaaattttacattactgttacaaaaattagccaggcatggtggtacatgcctatagtcccagctactcgggaggctgaggtgggaagatggcttgagcctgggaggcagaggttgcagtaagctaagatcacactactgcactgcagcctggccgacagaaccagaccttatctcaaaaataaataaaaaacaaactttaccttgttaatgctatctactgagaagacacaatgatttaggaatttttaaatttaagcttgtaagttttattttctaaaaaataaatttttttcagctttttctaagagtgtcaaccggcttattttgtcaatatgtctatttatttttaaacagaggatttttctccaacaattatagaagatcaggctcgtgaacatattcggcaaaacctagaaagtttcataagacaggactttccaggtaaatgatttattttttatttttaagaaaagtagtgtaaccttttttccaaatcagttcatgtgttacaagcacactgattttgagaatcaggatttccattgttttgcaatatacccaggatggtccttggtctgccaaatcctcatttaccaacagaaacagtgtagggtttattctagcaagtgccataagtgaatttcatttaatactatgtttagagtcaaagttaagcttacattattaaatgtgttgaggtgatctaacattttccttgaaatgtctttgcatttaagaataaaggagcacctggtaatctttcttgccatatacagcttgtatgtaaaggaagctttgagagaaaaagactttagcataaatgaccagttaatcagagaacataagtatgagattaatataggataattaaacaactgggtgtttttgattcatgagagggccattttgatcaaaaattaaatgtactcaggtaattagttattacttttcatatatccctaacaggaactaaattgagcctgtttggctcctccaaaaatggatttgggttcaaacagagtgaccttgacgtctgtatgacaattaatggacttgaaactgctgaggtacagtgaccacataaaacttccatttgctgtggcagtgtgatttaaccaatctagactggcattacagcttggtattttccaaatttatcagggcataccatatagagtgtgctgtttggcacagtctctggccaaatacattaagaggcttggaaaggttgtgaggaatgtgaggagcagaaaggttatactttcactctgtagcaaaaagtggattggaaagtgttgcctgggaattctacatagccaaaccagcctcttcagtgtcccattggcttggctactatgctgacttggatcacacactcacataaggttacctgtaaagtttgttaccagacaggcagtgtggtaaatcataagagtactaaccttagagtccagaggcctggatttgagacaaacttgtttcatcagtacctaaacatgtggtctttggtaaataatcgataaagtataatatctgttcctcctgcctccgctgatttttgtacacattatcatggatcatgtgggtcaggagttagcaaacgatggcccttgggcaattcagccccccactgcctgtttttgtaaataaagttttattgggacagaatcacacccattcacatatgtaatgtctatggctgccttcactcttaagtacagagtttagtagttgtaagagaccatatggcgtgcaaagcaaaacaaacttgccagcccctgggatatctgaaggcatttataaaatataaaacactatataaaggtataaagtctaggaagtgctgagtccctattcttttaaatccttaacagcagtccaaatgctaaatatccaaatgaatgatgctgctgttgctgaagacctttttgtaccttttcttagtttcaagtctttctattttgaggatgtatctgatttgggaaaatagtcaaaagtgatctagcctgaatttgaataaagtatataagcaagattggctcaacatatggaatgaccctatcatacatcctcaaggtttatttatttatttatttttttacatggcttataaactagttttgagggcatttctaaagtaacattccacgtatgttctgggatttttataaccatcaaaaaggcgtatgttgagtcagcccaaatgtttttaagaatgatttatcaaatactatttatatttgctgtatgactttagttatatgcattataattctggctagtcctatagggaaataatttgagcttaatcactctccacagcaattcatcaactcttaaactatagaaggtctgcttagaatgaatgagctggggcacagaagcctcctctcatttattctgggacatggggtacatccgagtgatattatgtggaggggaagaaatgaaggtcctcaaccatggttcagagacttttttggaagccctaggtccataagcttcctgactgattttagcctttgttgcacacccaaaaacaattaggaagtagggtatttagtggtttttgtaccgtcaggatatttcctgtgaatactgactctaatacccaactagaaaggaaaaaaatagatatagactgacttgaaattaattacattatttctgaaggtaatggaaactatagccagtttcagaacctgtcttccagttttggttaagttctttatgccttctttgttgtagggattggactgtgtcagaactattgaagaattagcaagagtcctcagaaaacattcaggtacctctgtaaactttttctaaaaatatttctgactttttaattagtgttttctatagtcttcccttggtatccatggggtatttgttccaggcccacccatcacccctcaaccctcccttccccagcagataaaaaaaatccttagatgctcaagttccttatataaaatggcatagtatttacatataacctatatgcatccttccatatagttttagtcatctctaggttacttataatacctaatacagtgtaaatactatgtaaatagttgttatactgtattttttatttgtatttttttattgttgtatcgttagttttttattagttgcttttttctcttaaatatttttggtttgtgtttgattggatatggggatgcaggacccacagacatgaaaggccaattgtatttagagtttattaatgccatgaagcagtatagtggctcattcatagaataattgcaatattaatgtctttttaaaatcttgtatgcgtaagtatgaaagactgaggaattggtgataatttatatgcatattgttgcctagctcagttttatttcaagacaaagcctacgccagacaggcaagaaaggctataaatccttttcctttgttggcgttgtataagtcaaagtgtaggagttgctaattgtgtgaagtgtcaaggaaagcaccccggactgggcttgtgggttgaatttgcagctgttctgctcaacaagctgtatatgaccctgaacaagtccttcacttgaagcgatctctttttttaagaaatgggatcttgctaggttgtccaggctagtctctgaactcctgggctcaagtgccttggcctcccaaagcactgggattacaggtgtgagccactacgcttggcctgatctctttttttcattgataaattgaggcaactggactggataattattctagagtatttacagctataaaatgtatagattttgtaaaccatgcacagaattgaaatgctgttaacgtatccttttgttgtcatggcagctatggataccattaacagtgaaaaatcttcttttaaaatgtagttcagcaaacttctgtgctaagagctgaaaatgaaagtgaacaatatatggcccctatcctcaggaacttaaaatccatggtctgtccatgaaaagtttttgtacatttcggttaggaacagactttaagtcacagcatgaacgtgcacacacacctagacacacacatatatacaccttgggtgccacttttctttgaaattttttccccaggagttaataaagtacataccatgttgtttaaataacaggaggaaaaaaaatcttaattttggtttattcccaataaaaattaacctaaagtatacagaaattgggttaggctttgtttttttaaatgtacattgatttgttcacagagggcagaacaatataaaaaaaaaagaaaaaaagtgcattgatatacttttctttggtcattgaagtaaacatttcccttaacttgggaattccacctctaaagatcatgtgttttgttttgttttgttttgttttgaaggtcgtgcaaagaaactgaagtactaagttagcgtgactattaattttttagtactgagctagattttaactttgtgttttgaaataatttaatttcacatttaaaggaaagcagcaaaagttgcataaagagttccacatataacttttattcagatccaccaattaacattttccatatttgattcatcattccatcttttgcttgctctcaatttcttcctgtaccatttgagattaagctatagacattatgtcctttcccctaaatacctcagtatatatttcctaagaaggaacgatgttaaaaacagatcatttttagattagaaatgacttaggcacacagatgatttataataataatggaatgcagattgcctggaacaagaatttcgtaacagctagagggctgtgtttaaaacttcatatctttaaaacagtctccccaggtattttattgggtgcctcctatgtgcacagcactgtgttgggcacttagggatggtggaaaagtaaaaaaatctgtatgttttttttgtgaaagcttccatatcttaagaggtaaggtaatcttccaaactatgtaacaatgtaaggtaatattcaattaaataacttctaagaagagagaatgtgggaaagagttgcacaggggaggttgatggaagagatggaggttgctatgatctcagatgatggtgaacacgatttgaaaaggatgggaaaagaaatcatttctaagtgcatagatgtgaatgtgagactgtgggatattttggagagcagtgagaagattggtacatttggagattttcaaatgggaaatactaggagataagatgaagtctatagatatttggaagcactgaagtttcttcaggagggaaaggacccaataaaagcataacataaggtttttaggcagctggtgtggtattttagggaaggtataatgtagacaacagggcagcaggacctcagccagggtgccactggtgctaacaggaaaaagatatgagagattccaagtgggaaaatttcctagatttggtacctgcaagtaggaagtaaggattgaggtcactatctgggttatttgagaaccaggaatgtttgcagagaacacctgtgtgaaagtgtttagtttgccatgagcatataatctccaagacttaacattccagaaaacaattagaaatatggggttgccagtcagaattgaagatgaaaataaaacagtttttttgcattgaaagccttgaagaaaaagagagagattgagagaaagagactagacagaaattaagaaaagagactgaaaaggaactgggaagatatgctgtgaataaatccgagactttgaagtgtggtaatgatcaacagtgtcaaattccagaatgggaaggatgtgaagaaaagggcctctgtctaatttagaggcgagatagcaaagtactaggtggaggttctggaatcagactctgattttaaattctgtctcccccttgctggctgtgcaatcccaaaaagtcactcagcttcataacaagcactcagttcctcatctctaaagtggaaataacaattctatggcatttaagaaagataatacgtaaagtgcaaagcctagcatattctaagtattcagtaaagtgagcttccttgccccctttccccatcagattaagtttcatttcctctgtctgccacacagattttttcctgaaatgtcttctacctacttattttctcctgtgttctatgatgtgatcactatgtatctgctttttaggaaccaccacttagctctctcagaagaaactcaaactctgacatctcagaatgagcttatctttcactttaccgcttcccttctgcaggaaccaactccattaatctgcccttccttgtgaatcctttttcatggttgttgatattggcatccttggaatcaataaaacgggtgaaatgataattagcctgacccacactaggttcagtataagttgggagtcaatcttacctagatttgaattccggctccacaatttaccagctgcatattcctaagctagtgaatctttctgggtctctgtttcctcatctgtaagatgagggtgataaacctaaggaggtaatgtttgtaaaggactcttcacatatccctatcacacattaggtgctcaggaagtggtaactcttactctgaaagccctgatcctctcttactacccctagcttcccatccagttacagatgctctcaaacatgccttgcttcttctgtgtattcccatgccaccatgaaagttcacacccagttgtttttcataagtggtcaccctgcctctgttcctggtgcctccagtctgtccactgccagggttattgtctaactagatgtggtcagtgattcctcccaacttagaccagttcattggctcctctttgattctaaggataattctttttatttatttatttatttatttatttatttatttatttattattgatcattcttgggtgtttctcgcagagggggatttggcagggtcacaggacaatagtggagcagcataataaacttgtttatctggtcagcagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccgcccttaatccattcaaccctgagtggatacagcaggtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttccccgctttctattccacaaaaccgccattgtcatcatggcctgttctcaatgagctgttgggtacacctcccagatgggatggtggccgggcagaggggctcctcacttcccagtaggggcggccgggcagaggcgcccctcacctcccagacggggcagctggccgggcgggggactgacccccccacctccctcccggatggggtggctgccgggtggagacgctcctcacttcccagacggggtggctgccgggcggaggggctcctcacttctcagacggggcggctgctgggctgaggggctcctcacttctcagactgggcggttgccaggcagagggtctcctcacttctcagatggggcggccgggcagagacgctcctcacatcccggacggggcggcagagcagaggcgctccccacatctcagacgatgggtggccgggcagagacgctcctcacttcctagatgggatggcggccgggaagaggcgctcctcacttcctagatgggatggtggccgggcagagacgctcctcactttccagactgggcagccaggcagaggggctcctcacatcccagacgatgggcggccaggcacagatgctcctcacttcccagacggggtggcggccgggcagaggctgcaatctcagcactttgggaggccaaggcaggcggctgggaggtggaggttgtagcgggccgagatcacgccactgcactccagcctgggcaccattgagcactgagtgaacgagactccgtctgcaatcccggcacctccggaggccaaggctggcggatcactcgtggttaggagctggagaccagcccggccaacacagcgaaaccccgtctccaccaaaaaaatacgaaaaccagtcaggcgtggcggcgcgcacctgcaatcgcaggcactcggcaggctgaggcaggagaatcaggcagggaggttgcagtgagccgagatggcagcggtacagtccagcttcggctcggcatcagagggagaccggcatcagagggagaccgtggaaagagagggagagggagaccgtggggagaggggagagggaagaggggagagggagagggagaggactaaggataattcttagcaaaatgtgtatgttctgtagttggacctttcccagtttctccaccatctcctatgcctcatattccattccctcaagttcattcggcaacctatgcaattctctggaacttccctgaacgtaccattctatttcaggcatctacactttttgtgtacagtttgccttgcctggtaaatttgctcaactgccactatttttgctggtttttctccctctttttcaaagcttagctcaggcaatttcctctctcctattgaagttaattcctattaacttcataacttctagctttaaggtgagtaacttgtttggaggataatcgtcccttaggctgttctccaaattagatatagtcacatggagagaacaggtgggaaccacatagttcagactctatagtagtttcctctgtttggtatttgtcttagtgacaacgacatacacatgcatatacacacatgcacacgtgtgcacatacgatccagtaagttcccagaggggagtgactgtttgattcttgtagttctaatatcaatatgtttaataaatgtaaactttgccagactaatcttcccagatgtttgttaataacagaattctttgacaagtcctaatgaatgcaatgaaacaggccaaagttaggtttacaccattttatattggaacattaacataagagttacttatatccccagctgctgtatttaatgataacattttatttcccaacttaggtctgagaaacatcttacctattacaacagcaaaggtgccaattgtgaagttcttccatttgagaagtggtctggaagtagatatcagtttgtataacacattggtaagatttttttcaggctttttgtttagagaggttaagggaacaaatgtctcaccttgcaaaaacctcaagttaaagaagtcacattcatttcatcttagtgaatctttcaagagttattatgcttacttgctgtgaacctggcagtgttctgaggctgaggattctaagataattcagatatgtttcagggatttataggacctctctgaccctttaggggtgtttgtgcagagagatcttatatctactgaaagggaactgattgtttatttcaccagcccttattttctagatgttcagaccaaggacgtataaaagccatgaggtcagatgttacttataattctttattattatctagtaagttaatgaagattgtctttagggaaaaaaaaaaggttaatttcagttgaaatgtcttcttcctaaaatgaatcagactgtaaacctatttaaaatattccagtttaaaatcttttcatctaggctcgcatggtggctcatgcttgtaatcccagcactttgggaggctgatgggggaggatcacttgagcccaggagttcatgaccagcctgggcaacatagtgagatcccatctccattatttaaaacaacaaccaaaaaaaaaaaagagaccctttacacttcattgttagtcttatagtgttattttccttttaacaggcccttcataacacaaggcttttatctgcttattccgccattgatcccagagtgaagtatttgtgctataccatgaaagtatttacaaaggtgagtatgcttcctattgtgacttatcaggaaatttcattgcatctttaaacactgttgaaaacataaatctattttttaatgaactgtagtcatgtgaaatgcttcatgtagctatttgggagaccctatgaagaaagctaaaattttgttctgaattttatacaatgacctgatcttgcacgtagccagctgtccactgctttgctaggttggattggttttgcctttgacaatgtgatttttatattagttctcaaaatatgcactttacttttagtgataacagaatggatgcaaagttagcagaaaacagacctttcctttgttcttggttttccttctgtctagatgtgtgatattggtgatgcatctagaggcagcttatcatcgtatgcatatactcttatggtgctatattttctccagcagaggaatccaccagtcattcctgtccttcaagaggtattagtgaatgaaattgtatttcttatctggaaaactggtgatctctgagcctttctcctcctctaaaattctgtggttctgtagttaattttttacctattttcctagaagtttttgtatcaatgcattaagtttgtaatccatactaatagtttaaaaattaatttcagatatacaaaggtgaaaagaaacctgaaatatttgttgatggctggaatatttatttttttgatcaaatagatgaactggtacgtattttaagagtaaagattttcctatatccttgactaaaaattagctatactacagtgtagatgttcaacaactattttattgcttgttgtatttatatatcttatgatagtaaaaaaaatagtgttttcagatgctttctttgatgtgaaaatatttttactaagccaagtgaatttctagggcctatatccagtatttctttaatgcctaataattccaaatggttaagtaactttattccaagtgaatgaatatttgttctgtggtttttgtacccagagtttagaaagactttcaatgagctaaagagatctaataacctacgtattaccaaggctcttagaatctatttctggatcttctgactaatatgttctgagacttgacactgaaaactctgagctcttcctactccaagtcacagagtagagattaataaacttatgtaaattatgtttttaaatatgaaagaaaagttgcataattgagctctagttaattagaaataaatccaaatttactccctaaaatacaaatgaatattgatattaacacttcactaaagaccatggtatcccttgttcccttctatttctagcctacctattggtcagaatgtggaaaaaatacagaatctgttgggcagttatggttgggccttcttcgtttctacacagaggaatttgattttaaagaacatgttattagcatcaggagaaaaagtctgcttacaacttttaagaaacagtggacctcaaaatacattgttattgaaggtacgaataaaattaaacttgaagtcgaatagactatagagcttgaactataaggacattgttcttcctccttgcagagctcttccagctgcttggggtgtgcagtgccccagtctcattgtccataccaggccaacttttctctttccagccttaagatttgttttttaaatgactgaagccatttcaccatgacaaattttttgctattgttggacacatactgaaggataaggcagcagtagtgataaggcagcttcaagaaagtgggacttctacaaccttcctgttggggggtttgaagagtgccgctaagtgaattttcaagatcttcattcgctattgatggagttcacctataagtaattgtatataaattttgacatttattttgaccatatggaagccttttctttttctattttttagtttttgagatggagtttcgctcttgttgcccaggctggagtgcagtagcgctatctcggctcactgcaacctccgcctcctgggttcaagcaattctcctgcctcagccacctgagtagctgggattacagggacccaccaccacaactggctaaatttttgtacttttagtagagatggggtttcaccatgttggccaggctggtcttgaactcctgaccgcaggtgatcacccacctcggcctcccaaagtgctgggattacagatgtgagccactgcgcctggccaccttatctttttctattgaatgtagtgatctattggagccattgatgctaatagttgattgtttatttccaatttgtgggattcttattttaagacaaaatggaatttaaatgctttagctgagaaatgacctaagaaatatttttttaattttaataagatttttaaatgtttatcttttaatatgtttgtatcacataaataatacgtactattctaagttgtggttttattattatttctgcctattggcagtattaaaatacaatgaacttttgtaaaatgaatttcagatcaccatgggttacagatatagttttgactttttaaagatctcatgtgtcaaacacatagaatttttgacttactacgccttttcgttatcactgcagttcttatcatctgtcacttattaaggtattccttttttttttttcttgagacagtctcactttgtcttccaggctggaatgcaatggcgcaatcttggctcactgcaacctccacctcccgggttcaagtgattcttgtacctcagcctcctgagtagctgggattacaggtgccgtgccaccacgcctggctaatttttttgtatttttagtagagacggggtttcaccatgttggcaaggctagtttcgaactcctcagctcaggtgatccggcccacttcagcctcccaaagtgctgggattacaggcgtgagccactgtgcccggcctattaatgtattcttttttaagttttgaaggtttattatcttttgcttctaattcttacattactttcagacaagcagttagtaataggctaaactaaaaagaaggcttcattcataatcatataaccagctattttagaattgaggcatttcagtggtgatagtagtcgtttgtttttgtttttgcgggggacagagtctcactgtctcgcccaggctggagtgtaatggtgcgatttcaggtcactgcaccctccgcttcctgggttcacccgttgtcagcctccagagtagctgggactacaggcacacaccaccaagcctggctaatttttgtatttttagtagagagagtgtttcaccatgttggccaggctgatcttgaacttctgacctcaggtgattagcccacctcagcctcccaaagtgctgggattacaggcgtgagccacagcacccagccagtagtagtttctttaactgcacagtagctaatattgtagtatctccactacaccaagcaaataaccaaaaatacacatacacatataaaaatcacttgaagaaagaatgaccaaactgatgaaggtaaccttctcatagcaataattactgcagggttgagctgaaggaagggtcctatacttcgataaactgatagtctcaatctcaatatggtacacctcagttaccgttcactagaagcatacctggcaagtggaagatgccactttttacttctttacttctcttgtgtatgctatatccatgcagtccttcattttctcaataagaggattcccgaaaaaaggtcatcgcttttttctctttgccttcttgaatattgttttagggatgtgaaaaatagaagttagatatctacacataatgtctaaattatgaatcatgggtgtatgttattttagatcacttataaaacagtatttggatttagaaatagtgcttttaaccccatttatttcatgagacagtttattcacacctcacataaatctttgacattagcattgttttcatcattcctaccattttctgggttatttaacaaacagtattccaaaacatatcctatatacagctatctaagatgtttcagatgcagacatgtaagatcaaatgagagtctatattaagcttttactagaaattgtatcccaagatccaggtagccaatggcatgccattgggacagatgtatatatctgtgtgttttataagtgtgttttgtaatctccatcatgaattattttctgaagtgatctttaagaaatttgttacatagtgggaacatttagtgccaaaatgttttaaatgtatttataacttctatatacatccaaaactagtgtcattaagtaatatcaggctaatgtgtcttctgcaaacagtattttgttcaaaaataggcagccagtcataacataaagagctttataatgatttaaatataaagtagtacactctattctgatgaacagtgtagtggaaaaacttgccttctgtttaggaatatgtattgcttagctttattataacttctaagctcatttaacaggtgtcattttaaacttttttttgcacttcttttctatcatgtgaatttaaaacttattaatgataagcaaagtagatgatattcttgtcttgttttatgaactttacttattggatgaatggtggcattttctatttgattaccttatttgctcttaaatttttttgcttagatccctttgatttgaatcataatcttggagctggattatcaaggaaaagtgagttacttcgtttgtcaattttattttttattttacttatgtatttacttttataatagagacagggtcttgcttttattgcccaggctggtctcaaactcctgggctcaagtgatccacctaccccagcctcccagagtgctagaataacaggcgccaccaggcccaggtagtttgtcatttgtaatacaatctcttttccttttaacccgcctaagtgagttcttactcttctttttagtgacaaattttataatgaaggcttttatcaatggtagaagagtatttggtattcctgtcaagggatttccaaaggactacccctcaaaaatggtaagtgtgttggaaataccaaaaaataaaaaataaaaaaaagtgcctaatttgtacacatcacttcagtagtaacttaaatatttagaaagtctgtgagtctagccaaagtaaatgactattgtacagaatgattcccagagcccccctttttcttaaacatccccgggtagaggccatcagaatagagagaaatagtaagaagttggatttaaggttgttaaattcttgttttcctctttgatgccttttttttttctggttatctgtgctagccttcataggtgcattgctgttctgccagcattcggcttgatgccagccttggccaagcccagtttgtacatatctagaatctagattttccaatctgcttgcaaaaagtagtaaatcttttgctgggactagggggttaacagtgcttcctgtagcagacagctatctcttctcatgtaacttgatactcgagtttttcaggaaccacatttattgaaaacaaagcaaaattatgtcaaaaaaataatttcagtgagagaaaaatggctagggactagatgatcttgctaagaataatattatgttcttctgcattaatttccttatactttttattcttatttttaattgacatacagtttatggagcacaacgtgatgatttgatacatgtatatggaatgatgaaatcaagttaattaacatatatatatcacctcaccattttttgtggggagacatttgagatttactcttagttatcttgaaatatacactattattgactatagtcaccctgctgcgcaatagatctcaaaacttattcctcctgtctatctgaaactttgtaccctttgaccagcaaccccctattccctctgtactcccagtgaagacttttaaaatttaacgtaagtgtattgctttataggcacattcagtgtttgattacatctgtacatctgatttatggtagatattgatgtggcttctacaccagtgcttctgaaacttgttcgaacaaatcacctgaggattttgttaaagtgcagattctgattcagcaggtctaggatcaggctcaagactgcttttccagcaagctccctggggatgctcatgttgctggcctccaccttaattttagtacaaagaggctacaggctagaccattatctttcctttgttctgttatttttccttcagcagccacaactaagcaaagtagaaacacatagttttttttcttttcttcaatataatctgtatgatgcaaatcatgtttctcaattcattatgttttagccttttcatttgatgaggagacaaagcctgtgtacctggcctcaactccctcccacatcctgaaaagctgactcatccgcttctttagaagtgtgcttaaacctttagggttagggctcacgagtgctctgcatgactaaaaggaataaacaaaaatggatttagttaaaactatcctgagttagaccttgatggtcttagattttgtttggaattaagcagtataaataatatttattaaaagtaatgttatatcaacattgaattgtaagataactgtttaatatctggttagttttgtgttccgatctcacgtgaatagttcaggcttttatatatttatgttcttctaggaatacttttttgatccagatgtgttaactgaaggagagctggccccaaatgatagatgttgtcgaatttgtggaaaaatcggacacttcatgaaggactgtcctatgaggagaaagtaagtaaatgttcaaaggggttggttgtgtttttattttcttaatgtcccaatttttaaatgaggtactattataacaaagaaaatacacttgtgtaaaatccagcagttttcagatacatttaagttttttattttattttttaatgaaatgaagtgatttaaaacatgactttaggccgggtgcagtggttcacgcctgtaatcccagcactttgggaggccaaggcgagtggatcacctgaggtcaggagttcaagaccagcctgacccacatggtgaaacctcatctctactaaaaattagccaagcatggtggcgggcacctgtagtcccagctacttgggaggctgaggctgcagaatcgcttgaacccgggaggcagagattgcagtgagcccaaatcacgccattgcactccagcctgggcaaaagagcaagattctgtctcagaaaaaaaaaaaaaaagcccaggtgtagtagctcatgcctgtaatcccagcactttgggaggccaaggcaggcggatcacttgaggccaggagttcaagaccagccttgccaacatggtgaaaagaggaaacaaaaattcttcctttttacagtagtgagaagttcagaatcatttcagtcagtaaacagtcaaatgagttccttcaggatctcagttacatctctaatgcacagtaactgttcagcacgttgggatatatattcacaaacagttcactggattttagcactctttgtttgtattccacttaacccttaataattgttgtgagtaggtaagccatgcagtttagtccccatgctttcttctggtggcgtttattggggggcaagagagacatgtttttgcttgcttgccttgggatacgttgttttgggtggtagtggtggtgtttttaactgtacagcaatattttaaaacatggtgctcaaattaggttaccatctggaatttgagaagctttgtttttcagtcctttttttcattactcaaaaatcagtgattattaggataagggagaaatgattttgacattttaagagcataaatcttaaaaccattgttcctttgtgaatttaagccttcacatctaaaatttccagtgccaagtaaagaaagaatgctaatgtgccagaaaggccgttcaagaaatcactccatggatgatttgcctttcattacatcagtgtcaaagtaggcattcagccaaggagtgccactaattgcagtcattggttttacagcactagagcaactttgaaaatgaagaagaaaaactgcacccttaaaccctgagggagcatcttaacagagaagatggattttcatttaggttcttgcttttccttttaatactttctattcctggtcatctcttaaatctagaattgccttaatattttgggaattgccttaatattttgttaggcttctgtttagatttttgctactaatatgatatcttctacagagtaagacggcggcgagatcaggaagatgccctgaaccaaagataccctgagaacaaggaaaaaagaagcaaagaggacaaagaaattcacaacaagtacacagaaagggaggtgtcaacaaaagaagataagcccatacagtgcacacctcagaaagccaagccaatgcgggcagctgctgacctggggagggagaagatcctcaggccaccagtagaaaaatggaagagacaggatgacaaagacttaagagaaaaacgttgttttatttgtggaagagaagggcacattaaaaaggaatgcccacagtttaaaggctcttcaggtatggacacctatcacaccttgatgtttgctctaacatctcaagggaaatctgctttttagagctctttactattttagttatctttatttctttatcaatatatttactcaaaaaagatcttgtttttaagaaagtaaaatcccttccccctcctttaatgttgatcctccatatatcttattcctggctttatttagagtcttatgagagtcatttggtgaacttttctaagattatcagtgaggtgaaagtgtaatcatccctggtacctgcacatgtagcctcagtgaccagaaaagaagctgcaacttgagctttgctacttgatatatgtacttgtgaaatcaaatcacaggggtggcggtagccagagttatctcaggacaccatgctctgtgcacaggtgagccacacacaggcacatgcatagaaaagggaacagaaagaaataggctgcatagttagcagtgggtgaatctgcagaggggaattatggaagatttttttctgtagattttgtcattttgattttctacaagtgagcatgattattcttatgacgaagaaaatatctattagcagtcattaacaacaccatccacaaatctggcccctttgagttgttaaatacaaattggccatttttgctaaatgggtgaaatgtctattgtgggcaccttttaaacagactactaactataagggtaccttgtgtgtgtataataagtaatgatttacaaagcaatttacattctcacttctcagaactgtgcaagtgatgaaatttgataagcatagaaaagaaatatttggaagtaatttttttctaattaaagtagtcaatcctgtcgctatcctcagttgtatatatatgtttgtggacagcataaagtgtcagctgctttacagtttccctaaaatactccatgtgtatagttcttggaacaagaatacctctcttctattttattttatcatattcagcaatatagtgtatctttttttaagacaggagatttttagatcatacccattcttttttaaaggagctttatatgaaaagatcaaaatacttaaaaatttttatctattatttttagagtagggtttaaatgtttatgaaagatacagctttagctgctcacatgggacatataccagaataaagtgattttcttttgttgttttaagaggaaaatgtatttaaaagaaattacaataataatagttgctaacattcattgagcattcactatgagttaggcactattttaagtactttacatggataatttcatttaatttttacaacagcttcattaaatacattaatatctgctgttttacaggtaaggaaactgtaaatagtatagataacttttaaatagtattcccaaaattattcctaaaattactcgaggcctgtgttgattactcatgactgaaacattattacagtcttcctctttggtacaacaaagtggagaatttgccccagctttgatgaatttcttttttctcgctagcagcaagttttaagttgtgtactagggaagctctcacaacagttagaccaatgattttggcagcctgtggggacagcagcaactcaaaaagatgcggggcgggtagtccgggtggcaggggaattatcaagcataaggaagagcacttatctagaaatgtggtcccttcagaatgcagtcttgacacattaaagttagtagtcatcatattttaaaagtgaaatgacagtggaggcatggggatagatacagggaatttcctttggtggcagttcaaaaataatcagctgcttcttcctctctcaaaattatgctgctctctcttgtttcttcagatatattgctcctttgtccacacaatatactgagtggagcttctgtcacaccaacagacagtctctctgtgaaagtttgaaaacagggctactgctttcaatttaaagtaggaacaaaaagtgctaatttcttttttaggaatgtctaaatcagattgtatgtttggatcgccctcacctgtcccattgaaaccaactggtttatttgttcaggtaaacctagctcaaacggagaaggaggcgtgtctgtcatctgttcactcaggagctgctccctgagtgctctcagctctgcaccatgtccttgcgctgtgctggcagtgcgggccctccttcctctggctgacctgcagcactcctgtctgtcctgcgcgggtgtggtgcgtggtgaggcttactgggcaccggatggcggggccttgtttcagaactcctgcccatggtcttgcttttcagttaacttgcaaaattctgccacccacatgccttatttcagctctccttggatatggtttcggttttaaggctgtttcagatgctcttcctttcgattttgtaaaccagtctatttcattttttaggcagtgcttttacatgaagacaaaaagaaacaaaaaacaacaatatttttgagtccccagtcaggtatgtgggttttaaaaaaaacaaatgtgtgttattttatttactgcatactttaccacatgccttttgagactttttctccaaatatgtgcttttaacagggattggacatcagaatcacttgggggaactttaaaacatatagttgcccatcctctacctttatttcctaaagctaattcttcagtggttaagcatgggcctgtgtgttttgtaaattccaagtgatgtttataccacccatgagtggcaaccagagtcttcaattatttgttccagtcccgtgctttttgttgctgctgtcttgccagcagtgttttctcctcctggagagtatttgccacacacaaagtaaggaaaaaaactaatctctagcctgaactccactgttacctctcagctacttcatttattcattctttcaacaaatagctatccagcctctcccctccctttccaagttcaggacaccagcctcaacactgaagatacagcagtgaacaagcaaagccccttctctcatttactctgcatccttttcagaagaggtagacaataaagagatacagaaataatatgtcatgtggtggcaaatgctaggaagaaataacaaaacaagaaaagggaaagagaatggttggctaaggaggcagcatctctggtaaagtaacatttaagcaaagaatcaaatgaaacaaaggggccagtcgggggaaattggtgttagactggtaaactcagagatggaaacaggtgttgtcctgcagcatcactgaggcagtgtggcaggagtggaacaggattggaaactcgagagacagaagaaatttgaaaaaaaaaaaaaagtggagcaggcagaagggtgagtgagtggtagaggtgaagtcagagggtggatagatctgggttatgaagcgccttcagcagtggtaggtaccgtttttgttggtttttttctccctcaaagtgaaatgagagactattgtagggttttgagccaaggagtgatattatctgaattctgttttaaaaggttcattatggctcctgtgtggaggcagggtagctacttagaaaccaagccatctcagcctcccgatttgtagagatgtggtctcactatgttgcccagactggtcttgaactcctggcctcatgtgatcctcccaccttggcctcccaaaatactaaaatgatagatatgagccgccacacctggccataagcttcagccttgagcagatactttctaaacactttatatagggaaaaaaaactaattcttgcgtagccaaggtgttcattttgccgagaataacgtagcatagtgtttacaattacgtgggtgtaatttctagctttgtgatcctgagagactgccttatcctccatatgcctcagttttctcatgtgtaaaaagggggtaataataatacctgacagggatgttgagaaatccatgtaaaagtacttagaacagcgcctgcatatagtgagagcagagaaaagggaaaaggttcgtggtggtgattgcattgatgttattattccttcagggtatcaccaagtcttccagtgccagcattgttcagttgagagagaaatatagatgctaggcatacacctagaaatagcattgacagtaagttacgatttctgtaattatcttcttagtaaaaaacctacatatttataaatcttttgagcaactggaaaaaaagtattaacttaaatttactacaggaaaaatgtattgcaataattatgttactttataccagaaaaaagaaaacatttataggtggttaaaatcgatcctatccaataaatcagactcttccaaataagtatatgtcagatgatataactgtctagtttatctgtgatatatgtatccaaattatctatgttgttataaatgtgaactgtatctcacctgtaagtggtgttaatttccccacagctcttcctttccatagtattaagtatgtctttggcccacttgtagtttctcaagaaagcatgttgatacggacagcccctactctcatatatggtgtattgaccttaggcaagagatgtggtttctctgagctccagatatgtcatctataaaattggtgttaacaccgtttatctcatagggtgctaagaagattaaagtactgcccagagtaggcactcagtcaagttctctttcctctcctgatacctacccccatcctttcctctaggttgcatatagttctttactcccaaaggagatcacagtagatagaaaatcccatgaatgtccttgctcttcgttgttacctccctccccctctatcccccacacataatgccttagatattcagtaggttttattgattagaggtgaacttatttggaaggaataaaaagacaaagcaggagaatggtcaagaacatgagttttagagtgagacacttgagtttgaaatccagcccaaccatttactagttgtgtgacctctatcaagttatgcaacctctctgtgcctcagtttcctttttggcaaattggtgctaacacctcacaggactattgtaaggattaagttcatgtagataaagcacttaacacagcatccgacacatctcatcactcaataaattatcactgccctttgttactgtggttaacaaacacttgctgtaatttctctcttctaacttataggacaaacaaataatggaaatttttaacataagtatgtagagattgtggtaccacagtgataaactgatttttatgcttaagttaatgactctggtttatgtatgacaatttattcagtatgagaatctcagaaaactaatgtttttttctattccttaaccttcctaccctttttttggtaaagaaaattaccgaaaaaacaaaaaacaaaaaaaaaactacctctgtctatttatttattccattttaatctcatggcttgaaatctgaaaaattggagttgctgtaagagattggtggatgtctttttgccctcatggtgatgtattcttttacagcttttatcattgaccagaattttaaggcctgcttattttaaaaaacgaaaaccagtgttctttatgataataagcttaaaataatagaaatactttttaaaatagtatggggagagctcattgtcagtgaatatagatcattcttgttgatacccttctttgaatattctagtgtattaatataccattgtttatttaatcatgtcttattaatggactggctgttttcacatatttgatatatcaagtgtcttcacaacttgtgcttgcatattctttcccaaaatattgaaagtccatatatttccttgtacatttttaaagttgatatctaaatctttcattgtagttgcaaagcatgtaatttcttgggggaggggggctgtaaatattgacattttaaaataaaacttttaaatcagccttaaatgtatcaaatgaagtataaatattattgctttttcatacccaccatcatttatatacagctcagctcttctttaacaggcaaaaattatatatcatttccctttcctccttgaattcctttgttgtacttctacagaatttcagcataagatgatatattttgtttgtttgtttgaacttctccctgagatgatatatttttattacacatattttcaaatattttattgagtagcttatcatgcttatctgcaacaaaaatgacaggggcaacaagctaggccctattttctataaattgaatttttaagctttttattaaatctcaaaggatgaaaatatcttctatattgagttttcacaattattagaatatataattgatcaaaacaaatgttacaaattttaattaaaaattactttttttttttatacctaatgctaaatgacgagttaatgggtgcagcacaccaacatggcacatgtatacatatgtaacaaacctgcatgttgtgcacatgtaccctaaaacttaaaatataataataataaacaaatattaaaataataataataattactttttatgtttacttacaacgactttaataagaaagatgagattttttccctatacattcacatatctttgggtcgacattatttactgcgtgaatgaaactgttccttttctatccctaatttttttttatagttgataaaaatggaaaaaccccaatattctttatgatagcaaattaaaaataatagaaatactttgagtttgggaatagaagatatattacaatagtgccactcaattattttgattccttcttaattacatgacaaaaaatcacagtgatgtatcatcaaaaattatttgtaatgatcatccactatcaatgtaattttatgaaagctaaaaatttggatttttattagaggcatttacattcaccacagacaccagcattttgtttgcctctcctcttctctgggtttttttttttttttttttttgcctcatggcaatacaccacagtaggatttggctggttaggagatacgcctttcttttgtaaagtagataaataattgtgaaaggggaattagaaaggacaggtggagtgattcctgaaaaccagcctaagccttgaccacaaaggcattcacagacatataatttttaagaaagagtacacatggaagttgaagagctagaaattgactctcttaaaactatccttgcggccgggcgccatggctcacgcctataatcctagtactttgagacaccgaggcgggtggatcacctgaggttgggagttccgagaccagcctggccaacatggtgaaaccccatctctactaaaaagacagatttagtcaggtgtactggtgtgcgcctataatcccagctgctcaggaggctgagggcaggagaatcacttgaacctgggaggtggaggctgcagtgagccgagatcaagccacatgccctgtcaggtaggctcaggaacacatgggcccaggttggaagagcaccatttatataaaacactctaatgaatagtcgcatatttgtctagttatttcatcaggataaattcccgctcataagaatgataggtttaaaagtatgcacattttgacagtgatgccaatattcccaaattgtgattgttgacaatcccggagagtcagtgacattgtttcccataccctgacttcattgggatagtcttttttcattttacacctgcttgaattcctattattaccattgaactttaccatttttttttacatgatttcatctatctttctttgtacttttgtattggagtattcttgacagggtctcactgtcgcccaggctggagtgcagtggctcaattatagctcactacagccttgaactctcaagcgatcctcccatctcagtctcccgagtagctgggaccataagctagtgagaccacactcagctgatttttaaaatttttttgtagagacagggtctcgccatgttgcccaggctcgtcttgaactcttgggctcagatgatcctcctcagtttccagaagtgttgggattacaggcatgagccactccacccggcccagtttattattttaacctcacttatatgtgtttgccatacagatgaatgtttgttttaatagtgtgatctagccaacttttgcatggtttcttatcatgcttaccaaattttataaatgccatattattcctctatattatataaaaattcattcatgtgttatttctagtacttttgtttttttacatgcaaatattttatattcaggtatagtgaagatttttctgatatagtagattacatgtttaaatgctacagtagtaaaactactagtactatacttaccaaagggtttaacattttgggaaaaacagaaacgggcaagtagcagtataacaataactaacttaccttctagagaattggcattgtttttcaattttttttttcttttagagagaagggtttcactctgtcacccaggtaggagtgcagtggcacaatcatagctcactgcaacctcgaactcctgggctcaagaaatcctcccacctcagcctcccaagtagctcacaggcatgagccacctgtgcctggctcaatctcttttttttttttttttaataaaagacctgtcactgaggtagtggaagtgccttgagtaccatcaccaacatcgtttcctctgtcatgtccctctcaaccctagaaacatccattattatgaggttaagtctccaagtttccttttttttttttttgagacaaagtctccctctgtcacccaggctggagtgtagtggtgtgatctctgctcactgcagccttcacctcctaggttccagtgattcttctgcctcagcctcccaagtagctgggattacaggtgtgagccactgcacccagccccttctggttcattttttatactctttcatatgtactccttaacatatgtttctccttggtgaatttttaaattaaaatggcatatcatggcatataataagaatgtcctacaaaccagggatggtggcacgggcatgcagtctcagccactcaggaggctgaggcaggaggatggcttgagcccgggagatctgacactgtagtatgcaatgatagtgcctgtgaatagtcactgcactgcactccagactgggcaacaagctagacctcatctattttaaaacttttatatggtgctgtttttatatttgggtttttttctttacagtattccaccctgtgaataaaaaatattctatgtatttattacccagttttaggttgtattcaatattctgctgttattaacagtgctatagtgaacatccttgtggaagtccccttgagcatgtatgagagattctttagggtttgtgtgtctacaagtcaaatcgttaggtcatagcttatgtgcattttagttagattctatcagattacgcttgtattggctgaaataattagaactcccaccagcagtgtgtgggtcatttctatgtattcttccaaatactttatttattaatttttcagaattttcatttttgcaagtctgatggatgaaaactactttggtgttgttctcatgtgtatttgtatgactctggtgatgcaaggggcccttttacttttttttttttttttttttgagatggagtttcgctcttgttgcccaggctggagtgcaatggcacaatctcggctcaccacaacgtctgcctcctggattcaagcgattctcctgcctcctgtctctcgaatggctgggattacaagcacataccatgacacccggctaatttttgtatttttagtagagacagggtttcaccatgttggccaggctggccttgaactcctgacctcaagtgatccacctacctcagcatcccaaaatgctgggattacaggccctttttacatgtttattggccatttggagttcctcttctgtgaattgtctgtccaaatcatttgcccattttcccattgaattatttccctattaatttttaaaggttcttcatttattctgaataccgctcttttattattatataaatttcaagtgtctacctgcagtatatcttctgtttcaactttttgtgtgtattgccattccaaagtttttaattttgagataatcaaattattagttttccataattagttttcatcatcatttggttcataatttagggtcatctttaagaaattcttctctaacctgaggtcataaagatatccatctgtattttcttctaacagctttaaaactttgttttttctatttagacctttaatccatccagagtttgtatgtgtatgaagtatgaggtagtctctttttttttcttttttgagatggagtcttgctctgtcgcccaggctggagtgcaatggcatgatcttggcttactgcaacctccactcctgggttcgagcaattctcctgcctcagccttccgagtagctgggactactagtgtgccactgccataacccagctaatttttttttttttttttttttttgtattttagtagagacgaggtttcaccatgttgcccaggctggtctcgaactcctgagctcaggcagtctgcccgccttggcctcccaaagtgctaggattacaggcatgagccaccgcctggctgaaaagccaaatctccatactttgtgcagttcacaatatcgaagatgggtgcctacagactagtagacactttgtggcataaataatacagtggtagaacaatagagtactttgtttcttcttgactgaaatttcttactgaattccctggctgatatttttcattgtgagttgcttatctcgatgtcctgctttgaaaagtatgtgtttagggaatgtttttatttgcatacttactatgtttgctatggaaaatttagaaagtaatgttaagtaaaatgaagaaaataaaaaccatctgtactccctccattctagcattaactactatttagattttggggataaagttttcctgtctttttacattaatacaataatagttaacatttattaagcattttctagtaccaagtactattccagttgctttacatgtattcgtctaatcttcacaataacttcaagggggcaggtattattgtcctcattttacagataaagaaaatgaggcaccaaatacatgattggtggggtatattttagttttttgaaaatgctatttatatagttttataccttgttttttcatattattatccttctgtgtatacctaatattctattatgtgcatagttcctcatatacttggtcatatcgtaagttttggattttaagttctttgcattgttaattataaggtttttatgaatatttatttagcagaatttctacccacctcctcctgatcttcttccttctaataatttggcaaccaaaaattgatagttttaatttgcatttcattgattacccctgatatagaattttttcatatacttatgccatttttttttctattttatatattaccttttcattacctagttatctattggtgttcattcttttctctggtgacttacaagttcattaagtatggtagtgtgcttaggaaactcttaccctaccccaggattacctacaggattactcactctttcttacgctctgactttcttatagttacatttaattctgtattcacttggaaatgggtagagaagaaggatatggtgtgaggagggaaactacctcctttcttcccctccaaaattacttatttgacataatacagttattgaataattcatactttcccccattggtttgaaatgcaaacttcattatgtattactttgttacatataatcacttaagaatttctcaggtctcttcagttttttcgttgatctatttgttcagactccagaacaaaatttagtaactattctgtggtattggttttaatcagtaatcctcatttgtgtcctccacctgtaaatataataaatttccctttttccttttatatcaataagttattgctacaatgattaccatccacagcttcgtatctgcagagtaatgatctaagatatttatttctggccagataattctttgcaatctattatgtttggctgcaaatgaagatactgaattatacaaggcagaaccttaagttcgtctggtgctctgtaccaacatggaaatagtgaatatgtaaatgtattaaaatgagatcactctaggaacctgtctgcattcagaaagaattttgactaagcttatatttaattaatcatgtgcatatatacttttcaatatcaagtcttattacttgattcaaaacaagtgaccaattctagtatgaagtttttgtgactacttaataagaagtaattttatggcttttgtcataaagcgaggcttgtttcatttatattgggttttgtttcttcccctcctctaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagacatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtataaatccattttttgttttgaagaggggaaattatatttattgttgtttactgaatcctggtgtgaaagcatatcagatatgtatgaactgctactgctgtacttccgatttacggacatcattttattgctatttgtagacgtgataacatgaacatgagtacctatttatgtgggccttcagtggatgggcagtgccactcaggtctctggggtttccctctctaattttaagtaaattgacatataactactatgcttataaaaatgaagtaaggaaaacaagtagtcctgtttgccactaaaaacattttcaaaggaaaaataaaatgaaagtactttttactttttatgatactcagaaattaggatgaagaacttttaaaattgctgaagatcaaagaggttatctctgccagtcacaagtgtggctggtgtcattctgggtctgactggagccctcctggactgtttctttaatttcaaaagccctgcagacatagtacctggtcagaactatgcctcggtttatttatcattttgaaataaaatcagaatttcaacctgt

SEQ ID NO: 38633 - DNA, 49704 bp, Homo sapiens
tagtaataccagctgtaatcccagctacttgggaggctgaggcagaagaatcgcttgaacccgggaggcggaggttgaggtgagaggagatcgcgccattgcactccagcctgggcaacaagggcgaagttctctcaaaagaaaaaaaaaatcgtcggtttccttttcccatctttctttcgtgacttatattccagaacgaagccccacacatcattaatgatttgaatcgtttctaaagtgtttcttaaatcgtttcttaaatcgtttgttgtttcttgtctaacagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggtgggtggcaggctcgggcgtcgggaagtgcaggggtgcactcgcgcccctggcgtgactgacgccttcgtctctcaggggtaaatcttcagcgaaaacaggcggcgaacttcacggccggaggacagccgcggcgcgaggaggcagtgagcgccctgtgttggggcaccggcggcgagacccaggtgagtggcccctggtcgggccggagctgggggcctggggcgcagcagcctcgctctcctcgccatcttgcccttctttgccgcagatgctggtgggctgcgcggacaggacggtgaagcacttcagcaccgaggatggcatattccagggtcagagacactgcccgggcggggagggcatgttccgtggcctcgcccaggccgacgggtaagaccaatcccctcgctaaactcagggccgaagggagagcgttgatgctccctgaggatactggaatgatggcgacaggcaaactcttagtgacacggctttgaatgggtgacagggacctgggtttctgccttatgtagttcatacctgtaacacacatttattgaacacctactgaattccaggcactgggagaagtacaggggctgccggtaaaatttctgccttcaaaaagttctcatcctctaaggtttttcacctgactccattataatcctctaagtaaccatgggcaagtcatttaatagttttgtgtgtgtgtgtgtttgttttttgttttttttttttttggagacggagttttcgctcttgttgcccaggctggagtgcagtggcgcgatctcggctcactgcaacctccgcctcccgggttcaagcgatactcctgcctcagcctcccaagtacctgggattacaggcgtctgccaccacgcgcggctatttttgtatctttagtagagacggggtttcaccgtattggctaggctggtctcgaactcctgacctcaggtgatccacctgcctcggactcccaaagtgctgggattacaggcgtgagccactgtgcctgcttgtcatttaatagttttaagcaaggctgggtgtggtggctcatgcctgtcatcccagcactttggaaggccgagataggtggatcacttgaggtcaggagttcaagaccagcctggccagcacggtaaaaccccttctctactaaaaaaatacaaaaattatccgggtgtggtggctcatgcctgtaatcccagctacttgggaggccgaggctggagaatcgcttgaatccgtcccgcagaggttgcagtgagcagagatcgcaccagtgcactccagtctgtgaaacagagcaagactccatctcaaaaaaaacaacaaaaaaagttttaagcatgcattcattaattcattattaattcatttatattttttgagacagagcctcactgtgtcacctaggcttgagtgcagtggtgcattcatggctcactacagcctcaacctcccggggtcaaacgatcctcccgcctcaacctcctgagtacctgggaccacaggcaggtgtcaccctgcccagctaaatttttaagttttttatagagatggggtctcactgtgtgcccaggccagtctcaaactcctgggctcaacttgagctcaaccaccaacaaggtgatgtagctctgaaagcaaagattaggaaggtgctaagtggttggatgactggccttgctttcttccaaagatgatgaaagagggctgtgaagcaggctgcataggtttggtggtggtaattctgacaggtgaggtctggaaagcctgtgggggggactggatgtctgaactggttcttgagggatgggtagaattttgactggtggagaaggggataagggtattctagaaagagggtactgcctgggagaggccaaggactggaggcatgctacagggtacataaataggataaatagcatttgatttggaagttgataacaaggaagcgtttttttttttttgttttttgttttttttttatatacggagtctcactctgttgcccaggctggagtgcagtggcacagtctcggctcactgcaacttctgcctcccaggctcaagcgattctcttgcctcagcctcctgagtagctgggattacaggcatccgccaccacgcccagctaagttttttttgtatttttattagagacagggtttcactatgttggccaggctagtctggaactcctgacctcaggcaatccgcccacctcagcctcccaaaatgctgggattacaggcgtgaaccactgcacccggccaaggaagcattttaatacaagatgaacactatattaggttgggattaaatgtaaagggctttaagtgctaggttgagagatgtgcacttttattggtgttggtgagttattcatttattgtttttgtttttctgagagacggagtcttgctctgtcactgaggctgaagtgcagtggcatgatctcggctcactgcaacctccacctccctggttcaggcgattctcctgcctcaacttcccaagtagctaggactacaggcatgtaccaccacacccagctaatttttgtattttttagtagagacaagatttcactatatgttggccaggctggtctggaactcctgacctcaggtgatctgcctgccttggcctcccaaagtgctgggattataggcgtgagccactgtgcctggccaagttatcagtttttgaataggaagtaccatagtcagcactgggagcctgtaggagtatggaggatggattggagacagcaactgggagacttttgccacaggtcaggcaagtcgatacagagcccgaacccagctagggagggttggcaggtgtgagaaagaacataggcgcaggctgtgcagatcctggggagagacttgcttggacttctcgggagggatattttaagcaagagactgacatttagtgcctgaaactcagagcaaggaacccaagaagttggtgtttgactttgaccaagccctaaattcagaccagccctagtaagcaactcaagattcagacagaccagtacagccagatgctagacatagctgtgaacagcaaaagcactctggaatatcacagagttgatttctagctgtggttgtaacatagctgagtggcaaattagtttctcagcgcttctatttcctcacttggtaaaccctcaccctgttgagaaagttgaattaacagattaggaagctggaagctgtcaagccctgcctagagcccagtgacctagaggcttccttctaaactggactgttagtagggaatctggttgatatgagtttggggcctagagaatacttttatacttttttttttctttaaacattagtcaactgtagtagtaaggaggagagaaagattagaacaaggagtttaagcacttaaaaaatcccaactctatcctttctctgcagcaccctcatcacatgtgtggattctgggattctcagagtctggcatgacaaggacaaggacacatcctctgacccagtgaggctcccctgccctgatggttgggggaggtgggctggggtaggtgcctaatgatcacgctggggaagggaggattaaggactctggaacggactcttatctcctattctttacagctcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgagtgacaagagtgtgaaggagctgttcctgaagtcgagggaggctgaggccactgacgatgcattagagactagatggacttagggggcgaaggagggctgaaaacaggggcacatcgagccccccatagccctgtcctccatctgcccaccccaccaggtgcggaatgactggctggacttgcgggttcccatctgggaccaggacatacagtttctcccaggatcacagaagcttgtcacctgcacagggtaccaccaggtaaggtgtcacctcacacctgccttctcctgggataaagcagcctcctggagaaatggcccccacggtttgacacaactgctcttctcaccattctgagttcagaggagcaagcgcttccccgtctgttccaaccctgtccctgagcccatgaccttcctctactgtattctagggtggagtttcctgaactatgcctgttttcctcccacctggaagagaggaaaggagagtggatccccttcactgtgggaattatagggtgcaggtgtcagaggacattgggctgggtgttaagagaactgggttctggtcctgatgcagcctctctgatttgctttgggacccaggcctgagcctcccatctctggcctcagctcctcagctttacaggaagggcccgaatggggaatctttatggtttgtctcatttgaggtcttgagacacgggcggggctgggtcactgtatttgtcctattttctttgcttctgcacattgaagtctgatcttggtcatatgcctctgctcaaaacacatatgagggcatcctctttcctccttcattcaggctaacccctgcttgaaatttagcacctactgactactagaccaacttgcttttctgtccctccatttcccctagatgggagtatggggggatggaatgctcacacacttccaacctaggggacctctcccctcagctctgtccatttatgctgctaagcagctctcctgacaccctgatgctcagagaagaggcatacatctaagatgagaaagtttctgggagtggatcataaataagaaagcagtgtgcagggagggggtgaggatgcagagacgccagagggtaggtgcagggtgaggatacttttgtgatgcttcagccttcctctaggtccgtgtttatgatccagcatccccccagcgccggccagtcctagagaccacctatggagagtacccactaacagccatgaccctcactccgggaggcaagtgagtgtttagaggggaaggggtgggagggtggggcttgagaagggctccaggaggttactgctgatcccacttgcctctggtctcatcctcagctcagtgattgtgggaaacactcatgggcagctggcagaaattgaccttcggcaaggtgagtggactagggtacattgggggaaaggaaggagcagggagaagggtcaggattccctctaaggtggtgcagtggggccagtgaggcctcattcaggtgccagattgcctgggtttaaatcctggtttccctaaaagctgtatgaccttaaactaattatttcaactccctgtgccttagtttcctcacctgcgaaatggaaatattagtagaagctccagtctcagggttttgttgcagattaaatgttgaaatggaaagtgattggaacaggaaacaatgaatggttggttattggccagccagttatcacggatgcttccccccttctctagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtaagttgtctctcccacctccaactcatggtcttgtggaggccccgcctcctgtgccctccgttcatgtttctgtctcagcatgcctggctccttaaggtccctcatcttttgcaggtttatctcaagtctcaattgaactgcctcctcttgtcaggcagggacaactgggaggtgagcagttgggcccgggaatgtgggagccaagggcatagatgtgaggacctccctatggagaggaaaaggaggcagctggaatgcagacttgggactatctgtttacctgcctggtcacttaatttctctgagaggcattaacagttaaaatcctgagagggttattgccaacagcatggatggggttgctttctaggagcagggaataaaggtggtggtacccagagggattctttctcagccagggtctccttccctgtgggtttgtccctgtgcccctgactacttttctttttttttttttttttttttttttttaaacttctttttgtggagatggggtctccttatgttgcccagtctggtcgctaagtcctgggctcaagcaatcctcctgccttggtctcccaaagtgctgagattacaggtgggagccaccgtgcccggcccccctgactcctaagctttcttcccactcaccaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacacccaccatgaccctgagccttttgtgatgggagaaaggaatgaggggtagcttggggtgggggctgcctgagctggggcgacgggatatctgatgtcacaaaagccgggcctggaggcaggcaggctggcgtgggtggcacggagtccagggccacgcggggccatgggctgctgccaagacaaggactttgagatgtctgatgagcagtccaaggaggaagagtctgaggacggcagggaagatgagaccacagacacacaaagagggcccagggagtgtgagagggggcttcccgagggtaggggtgagctcagaggcctcgtcgtcccctcaggcgccgaagatatcgacttgaactccccggaccatccgaatcacaagtcgaacgaaagccttctgattaccgtgctgtggcggcgactatccacgttcggtcgtcggggctcctcgcggccaagcaagaggcaaccagaccagattcggaagcaggagagtccgatccgagaaggcaaccaggaggagccggagaagggatgaccccagacctgctctcagtccgccccaacctccagagaataaaatttctaacgtatacctgcacgaccactctgggggactgggcgcggacaccaccgggcagctggttctttaaggctccttcccggaggcgggcccagccccctgagcgcctgctgtagtactctggggcggggtcacggtggcgccttagccaatgggagggcgggatcgctcttgcgtttgggtgtggggcgtgtctttcgggtcgctgggcttgaaacgcgtgggaccgccccctcgtcactgggggtggggttacgtgtaggtgacgtggccgcttccagtctttggtcgggtttcggcggcttcagtgctcggggaggaggcagtgacggccggtgagattggaagtggcggcggcggcaggcggcagaggggaggtaagattcgctttaagaggggatctggccgccgtgtcagctctggggcagtggttttacgggggcgacgactggcggggggaagggaatcaggggcgagcgggcaagtcctgccggcccggctccgggtgagcgaattccttgccgtccaatcaggaaagcctctgttgagagagacgtcggccttagctaatgagtggttgaagtcttccagaaggcggaccttgggcggggggtgggacttcctgtttcaaataaacacccagaggttttccccctccgcccaccgaagtgtgtcagtctttggaggtccgtcactggccctcccggaggggccgaaggaaaccgcggaaacgaaagggctgggttagggcccggggcagttacacgggccgggccggagtctcaggaccacggggttggctctggccctgtctctgcttcagggtccccggcccgcgctctggccgccagagccaagttggaagaagagtctgaagcgggttcgacttgggacaggggaaaagcggggccctttccgctgctggtccgccccaggatttgcgagcgtcctgggcgcgaaagtccacgagaagtgcagaaggggctcggggatttgttgattggggtggggcgggggagtttgggtaaagaagttgcctggggaatgacactctcccctccacaacagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcaggtaaggacctggagtggaaaaggcgaggagtgagccttactcaaatctaggaaggactgtgctccaccactgttaaccgaagtaattttggggggtacctgatggaactgataggcttggatggggcctgtagggtctgctataagcaacagagaagaggtcggctggctaactaggggcaaggacttagacttttttttgtgaggaatcctttggagggcaggattgctattctggagggagtacttcagagagtacttggctgcaatataattggtgtgaataaggaacaagttctaggaagagcctttagctgagaaacatgcaccttgaattttccaatatacttctaccataagtttgctctgtaaccatgagaaaattagttaatctagttacatattagtttttatctctgtaagattaaggacattttctagataagtaatttgttgtttttgttttgttttgagatctgtttttcaactctgtcaacaggctggagtgtagtggtgtgatgatagctcacttgcagtcttgaactcctagactcaagggatcctctttcctcagcctcctgagcagctgggactacatggatgcaccactcagctaattttaaaattttttcgtacaggcagtgtctcactatgttgcccaggttggtctggacaccacacctggccctagatcagtaatttgtatcaaaatcacttagggttggatgtggtggctcatacctgtaattccagcactttgggaggcctaggccagaggatgacttgaggccaggagttagagaccagcaggagcaacaaagcaagaccctgtttctacaggaaaaaaaaaaaaaaaagctggacgtggtggcatgtgcctgtagtcccagctacttagaaggctgagcgaggcccagtctcttcctctctctcttttttttttttttttttttttgagaaggaattttgccttgtcgcccagactggggtgcaatggtgcaatctcggctcactgcaacctcctcttcctgggttcaagcgattctcctgccttagcctctcgagtagctgggattacaggtgcccgtcaccacgcccggctaatttttgtatttttttttagtagagatggggtttcaccatgtcaggctggctttgaactcctgacctgaggtgatctgccctcctcagcctcccaaagtgctgggattacaggtatgagtcaccacacctggcctctctctctccttttttggaaacatggtctcactctgtcaccaaggctggagtacaatggttctatctcatctcactgcaacatctgacctcctgggctcaagcaaccctcctgcctcaggctcctcagtagctgggattataggcatgtgccaccacatctggctaatttctgttttgttagtagagatggggttttaccatgttgcccaggctggtctcgaacttctgggctcaagtgatccgtctgctttatcttctcaaagtgctgggattacaggtgtcagccactgcactcagctcctcttaaaaaaaatttgggagtgctatttatttatttatttatttatttatttttgagatgggaatttcgctcttgttgcccaggctgtagtgcagtggcacgatcttagctcactgcaacctccgcctcccgggttccagtgattctcctgcctcagcctcccaagtagctgggattacagacatgcgccaccatgcctggctaattttgtattttgagtggagacggggtttctccatattggtcaggctggtctcaaactcccgacctcaggtgctctgcccgcctcagccttccaaagtgctgggattgcaagcgtgagccaccgtacccagccgggagtgtttttttcaacaatcccagtgggacccgagtaagcagtttgtgtttgtttgtttgtttgtttgtttgtttgtttttgagacagtctctctttgttgccaggctggagtgcagtgacgtgatctgggttcactgcagcctccacctctgggtttaagtgattctcctgcctcagcctcccaagtagctgggaatacaggcggtgccaggacacccagctaatttttgtatttttagtagagacggggtttcactgtgttcgccaggatggtctctgtctcttgacctcgtgatctgcttgcctcggcctcccaaaatgctgggattacaggtgtgagccactgcacctggccaagtaactgtatttatttatttgtttgtttgtttgtttatttatttatttatttattttgagacggagtctcgctctgtcacccaggctggagtgcagtggtgggatcttggctcacggcagcctccacctcccaggttcaagtgattctccggcctcagcctgctgagtagctgggactacaggtgcatgccaccacacctggctaaatttttgtatttttagtagagatggggtttcaccatgttagccaggttggtctcaatctcttgacctcgtgatccgcctgcctcagctttccaaagtgctgggattacaggcgtgagccactgcacccggccgagtaactgtatttttaaatatttttactgatggctggacatgctggctggcacctgtaatcccagcactttgggaggctgaggtgggaggattgcgtgagcctaggagttcaagaccagcctgggcaatatagcaagaccctatctctacaaaaagttaaaaattagctaggtgtggtggtgtgccctgtagtcccagctacttgggaggctgaagttggaggatcacttgagcccaggatgtcgaggccgcagtaagttatgatcatgctactatattccaacctgggagacagagtgagaccctgtctcaaaaacagaaaagttataaagaagtgtttttcagctcatggtaaagctgctcttctgtatgatctccaagagctttgcaatcatccttattgatttcctgatttgaggaatagaatggcaatactagataccatttatttagtgcttactatgtaccaggtagttgactgaagtacttttcagcctttttgttatttaaccttagcaacaataggagatgtgtggattgtcttcattttatagaagagaaagtagagatttagaatgttttaagtaactcgccccaaatccaccagctagtagtaagtggtgagtcaagatttgaactcaggtctacctgctcttcaaatctggactctaaacgactaccactcataaatctagatcatctgatggatgccaccagcactagagataggttagtggacacctcaggaagagtgaaagctggaactggggaagggagaactaaagttgtcacctcctgccattgcttttcagaatggaatccagacaaataagccagctttgcgtgctgtccgacaacgcagtgaattcaccctcatggccaagtgagttgagagaagctttctggtggggtgatacagtgtctgaagaaaagtagacttgcaatcagtggccttggctgtgaagtctgggattggttatgctggagcttatgtgggaaaaggcgtcctgccctttcccacagtctgactagtggtcatttgcaggcgcattgggaaagaccttagcaacacatttgccaagctggagaagctgacaatctgtgagtgttcttggggtctttcagaagtggggcagtaaatcaaagagggttgaggactatattccctgagctttgtccttgacctcacccattgtggcttcttgtttgtctctgtagtggcaaagcgcaagtccctctttgatgataaagcagtggaaattgaagagctaacatatatcatcaaacaggtgagctactagccatcaggagagcccagcattccaatcagatcacttctgtcttcctgtcattttccattgccatggggacccagagcaagtttctttttttagagaggggggtctcactgtgttgaccagtctggagtgtagtggtgtgacctagctcactgcagcccttaactcctggcctcaagctttcctccagcctgagcctcctgagtggtagagactacagggacatgccctcattcctggataattttttttttttttttttttttgaggcagagttttgctctttcacccaggccggagtgcagtggtgcgatcttggctcactgcaacctccacctcccaggtgcaagcgattctcctgcctcagcctccccagtagctgggactataggcacccgctaccaatgactggctaattgttttatctttagtagagacggggtatgccaggctggtctcgaactcctgacctcaagtgagccgcccaccttggcctcccaaagtgctgggattacaggtgtgagccactgcactcgactgtaataataacttttattttatttatttatttatttattattattttttgagacagagtttcactcttgttgctcaggctggagcacagtggcgcgatctcagctcactgcaacctctgtctcctgggttcaagtgactcccctgcctcagcctcccgaatagctgggattacaggcacgtgccaccgcgcccggctaattttgtatttttagtagagacagggtttctccacgttggtcaggctggtctcaaactcctgacctcaggtgatccgcccacctcagcctcccaaagtgatgggattacaggcgtgagccaccgcgccaggccaataataactttttttttttttaagacggagtctcactctgtcgccaggctggagtgcagtggcgcgatctaggctcactgcaacctccacctcccaggttcaaaacgattcttttgcctcagcatcccaagtagctgggattataggcgcgcgccaccacacccagctaatttttggtatttttagtagagatggcatttcaccatgttggccaggatggtctcaatctcttgacctcatgatctgcctgccttggcctctcaaagtggtgggtttacagacattagccattgaggaattgtgtgtatgaaaatagttctgttgatgcctctcgaaactacagtgcctttgactcttcccttttcctgagtactgtccgggggctttgttggtcatgccctagacccgagattttggcctttgaaagggttctgtggccaagagcatggcctcacagaatggagcagggcagtaggctggaggagtaaacaagttatttacaatggatgaaggcctattttgcctctttgtagctcttctctgcagggactgagccagagcaaacactagaccttggaaaatcctagcaggcccatctggtctgactgtctgagatactctcactctggctagtaacttccaccttgtccttcctaccagagatggccatcgtgagagatgctgactaaggactccttggctaatactttgtttttccttggactcttttaccaggacatcaatagcctcaacaaacaaattgctcagctccaggatttcgtgagagccaagggcagccagagtggccggcacctgcagacccactccaacaccattgtggtctccttgcaggtgggacctggggaggaagggagggaggcaaagaggaagaatgtggagccttctttggttgaccctctctccttttcttctagtcgaaactggcttctatgtccaatgacttcaaatcggttttagaagtgaggacagaggtgagaacaatctgcgtaggaggggtaggaatatgggagtaaagatccaagagggaaatgaagaagggacaagttctacagggtcatggggccaatggtgggagtctctttaacatgcctgctttctagtggcttcaggtcctttgcgtttttccccaaccccagaacctgaagcagcagaggagccggagagagcagttctcccgggcacctgtgtcagccctgccccttgcccctaaccacctgggtaagtcacaggtaaaacggggagccctgggaggtaaggttacttactctggttgtgatggcatcctctaaaggcacgggttgggtaggagagtggaaggtcaaggaattttctaggctttatctctcagaggccaaaccagatggttgagattcgtgatccacatttagactcccacattctcactgttggggtgaattcagttatattcagaataatgataatttctaattttttttcgtacactttattcacattctctcatttaattttcacaaccaccctttgagaaagcaactattattatcccccattttacaggtgaggaaactgaggctcagagaggttaaatgacctgtccagggtcacaaggctagtaagtgctagagctgggattcaaacccagagcatgtgggctttgaacctgcttttaactgttaaggtgtgccacatcctgttttctcccccaggcggtggtgctgtggttctgggggcagagtcccatgcctccaaggatgtcgccatcgacatgatggactctcggaccagccagcagctgcagctcattgacgagcaggtacccaggctctgaactaggtagaatcagcttctccattatcctctgtggttcccgagagagtgtttggagtgtgccatgggcagaatggcaagctgggagggttgtaaaaatgcaggtctgaccctgaagaagctgttggtgctcatgtgctctctccctctcctgaaggattcctacatccagagtcgggcagacaccatgcagaacattgagtcgacaattgttgagttgggctccatctttcagcagttggcacacatggttaaggaacaggaggaaaccattcagaggtgagatacactctctcgccccaaacagaggagctttctcttccccgtggattggcatcttaaagtccccagggactgcttgatgccttttggaagatagagtgaattctgcccacccatgggacccagttcacctgcttccatccacccaacaagtttttattgagcacctgttcatgtgaggcactgttccaggtgcgggagatacagtggcaagtagaacagtaaagtctgtctggagctgctttgtagcatgtgtaagtgtatggaatttgatagggcagatgaggacagctgtggaaaagaactgacaaggctggcacagtgactcacacctgtaatcccataggcagcactttgggaggccgagcaatgcagatcgcttgagttcaggaattcaagaccagtttgggcaacaaagcaagaccctgtctctacaaaaaaatacaaaaactagctgggcatggtggcatgggcctgtagtcccagctactcgagaggctgaggtgggaggatggcttgagcctgggaggcagaggttgcagtgagccaagatcgtgccactgcactccagcctgggtgacagagccagattctgtgtcaaaaaaataaaaataaaaaattgaccaacaaaatttcagggagtaataaaggctgtatacagagttaaaataggatgatgtgttaagaaagtaatggatgggtacggtggcttacacctgtaattccagcactttgggaggcccacacagtcagttgaactcaggagttcaagaccagcctgggcaacatggtgaaaccccatctctacaaaaataaaaaaattagctggacatggttgcgtgtgcctgtggttccagctactcgggaggctgaggcgggaggatgacttaagcatgggaggttgaggctgcagtgagccatgatggaaccactgcgctccagtctgagtgacagagcaagaccccatctcaaaaaaaaaaaagaaagtgactaagtaggtatatcagattgtgtggtagggaatgctgctctgaagacatgacatttaagcagagacttgaatgacaagagggatccaaccaggcaaagaacagagagtgttctaggccgaggagacagctagagcaaagccttgtgatgggacagtctcaccatagcaagaatcaagaaggcctgcgtggctagaaagtaatgaacagggatagagaagtacagggtgtactggagggatgtaggcagaggcccaacaatgggctggcctctctgttcctctggtgcctcctgctactacaagagtttttatctgctcctcctctgtggtgcttagcattcagtcagtcagttatgggaatatagcagtggacaaaagagacaaaatccttgcccttgtggaacgtgtatcctaatagggagatagatgtgaaaaagtcataataaatagtatgttaaaaaaaaaaaaggtcgtaaatgccaaaaaaaaaaaaaaagatagtcaacacaggataaactaatcaggagtgccaggtttggagggaggtaggccctattaagaaggtggcatcacacttgggagaaggtgaggaaattagctacatagaccctggcaaaggcccgcaggtgacaatatgtttgatgagttaaaggacagcagagactactgcagctgggatcaatgaggaagagagttgtacaaggtgtggtcagaggggaactgtgagacctcttgggaccattggtaggctttagcttttactctgagtgacatagggagccattgcaggggttagtttttctgtgtttgagacagagccttgctgtgtcgcccaggctggagtgcagtggcatgatcttggctcactgcaacctccacctcctaggttcaagtgattctcatgcctcagtctcccgagtacctgggaccacaggtgtgcaccgccatgcccggctactttttgtatttttagtagagacagagttttgccacattggccaggctggtcttggactcctggcctccagtaacctgtccaccttggcctcccaaagtgccgggattacaggtgtgagccatcacaactggccaaatacatttaactttatttatttatgcatgtatttatttatttatttttatttttgagatggagtctcactctgtcgctaggctggagtgcagtggcagaatctcggcccactgcaacctctgcctcctaggtccaagtgattctcctgcctcagcctcctgagtagctgggactgcaagtgcgtgagaccacgcccagctaatttttgtatttttagtggagacagggtttcaccatgttggccaggatggtcttaatctcttgatgtcatgatccgcccacttcagcttcccaaagtgctgggattacaggcatgagccaccatgcccggtgttaattttatttttatttatttatttacttttgaggtggagtttcactgttgtccaggctggagtgcaatggcacctctcgcctcactgcaccctccgagttcaagcaattctcctgcctcagcctcccgagtagctgggattacatgcacccacaccactcccagctaatttttgtatttttagcagagatggggtttcagcatgttggccaggctggtctcgacctcctgacctcaggcaatccgcccacttcggcctcccaaagtgctgggattacagatgtgagccactgcgcctggccacatttaactttaaaacaaaaagtataatagtgtatactctgggatttgtaaagtacatagatacaacaaatttaactgtagaataaaggatgaagcaagagggtttcaagattttgacaggtttttcttttttttgaaatggagtttcgctctgttgccaggctagagtacagtggctcgatctcaggtcactgcagcctccaccttccaggttcaagtaattctcctgcctgagcctcccgagtagttgggattataggtgcccaccaccatgcccaggtaatttttgtatttttagtagagacagggtttcaccatgttggccaggatggtctcgatttcttgaccttgtgatctgcctgcctcggcctcccagggtgctaggattacaggtgtgagccaccgcacctggcctattttgacagtttttatgaagtaggctgtgaaaagttaataaggtgtattttgtaatccctagagcaaccattgaaataaaacagaaactcaacaatgacatatagcaagaagagcagcaaccaaattgaaatggaaatagaattttaatcaaaatttcaattaattcaaaagaaggacaagagaggataaacagaggaacgaaaaatagaaaatagtgccgggtgcagtggctcacgcctgtaatcccaacactttgggaggccgaggcaggcggatcatgaggtcaggagatcgagaccatcctggctaacatggtgaaaccccgtctctactgaaaatagacaaaaaattagccgggcgtggtagtgggtacctgcgcagctgcttgggaggctgaggcagaagaatggtgtgaacccaggaggcggagcagtgagctgagatcgcgccactgccctccagcctgggcaacagagtgagactccatctcaaaaaaaaaaaaaagaaaaagaaaatagtaaaatggcagccctaaatccaaccttattaaaaattactgctggcctcaagtgatctccccaccttggcctccaaaagtgctgggattacatatgtgagccaccacacctggccagattccgccctttttttttttttgagacagagtctcgtcgtgttaccaggctggagtgcagtcgcgtgatctcggctcactgcaagctccacctcacaggttcacgccattctgcctcagcctcccgagtagctggtactacaggctcccgccaccacgcccggctaattttttttgtatttttagtagagacagggtttcaccatgttagccaggatggtctcgatctcctgaccttgtgatccgcccgcctcggcctcccaaagttctgggattacaggcatgagccaccgcacccggccgattctgcccatattttaatctccgtcccagacctgtctcctaaactccatatatccatattcctgttcaacaactccacttactggcctgggagcggtggctcatgcctgtattcctaacactttgggaggttgaggcgggtggatcatttgaggttcaggagtttgagacctgcttggccaaaatggtgaaaccgcatctcaactaaaaatacaaaaaaaaaaaaaatagctgggcatggtgacacatgcctgtaatcccaactactcaggagccagaggtgggagaatcactttaaccttagaggcggaggttgcagtgagccgagatcgtgccattgcattccagcctgggcagcaagagcaaaactctgaaaaaacaaaaacaaaaacacaagctgggcgtggtgatgcacatcttggtcccagctactgttcccagtagctgaagtctgaggcaggaggatctcctgagccctgggggcggaggttgcagtgagcagagattgggccactgcactccagcctgggtgacagcaacaccctgtctcaaaaaaaaaaaagtattaaaaagttaaatgtattttaaagaaattaagaggaagacttggtaatagtgctcacatatttaccatcttcagtgttcttcattcctccttgaatagatctaagttttccactggtatctcttccctttatcctgaagaagcacttcctttggttttttttttgtagtggagatctgctgacaacaatttctttcagttttctttcatctgaaaactgaaatctttttcactaactaaatcaaaactaaacttttttcaccttcttttttttttttttttttttttttttttttttttttcagacagagtctcactctgttgcccaggctggagtacagtggcacgatctcggcttactgcaagctctgtctcctgggttcacaccattctcctgcctcagcctcctgagtagctgggactacaggcgcccaccaccatgcccggctaattttttttgtatttttagtagagacggggtttcaccgtgttagccaggatggtctcgatctcctgacctcgtgatccacctgcctcggcctcccaaagtgctgggattacaggcacgagccaccgcacccggcctcaccttcatttttgaaggatgttttctctggatatagaattctggatatacagttgttttttcttttttttaactttttatttattttttcctgagacagggtctcactctcttgcccatgctggagtgcagtggcacgatcatggctcactgcagccttgacctcccacctcagcctcctgagtagctggagctacaggcatacaccaccacaccaggctgattttttttctttttttttttttttggtagagacggggatctcacatgttgcccaggcaggtctcaaactcctgggctcaagaaatcttcccaccttgacctcccaatgtgcctggctcatacagatttattcttttttttttttttttctgagacagagtttttgctcttgttgcccaggctggagtgcagtggtgcgatctcggctcattgcagtctccacttcctggattcaagtgattcttgtgcctcagcttaccgagtagctgggattacaggcaaccactagcatacccagctaattttttttttgtatttttagtagaaatggggtttcactatgttggccaggctggttttgaactcctgacctcaagtgatcctcccacttccgcctcccaaaatgctgggatcacaggcatgagccacagcacctggccctatcatgtctttttttttttttttttttgagatggagtttcactcttgtcacccaggccagcatgcagtggtgcgatcttggctcactgcaacctctgcctcctggattcaagtgattctcctgcctcagcctcctgagtagctgggattacaggtgcccgccaccacgcctggctaattttttgtatttttaggagagatggggttttgccatgttgggcagtctggtctcgaactactgacctcaggtgatccgcccaccacgtgagccaccacacccagcctctgagtttcttttatgtgtaaatttgtctttaaatttaggaagtatttggctattattactttaaacatttttctgcctctttctgtccttaccatctggaaatatatacatatatatgtttccaggtacatgtcttatataataagtttatatttattttatgtatattttcaggtcaatctgctgttaagcccatttggtgaatttttttagataattttcagtttcaaatttacacttggttcttttttagagattatgtttctctgctgtgatttactaccttcttagtgagtacaagcatattttccctcagttataatagctgccttaaaatttaattctcatcatctggattatcctagggatggggccattcattgccttttctcttctgtatgggtcacagttccctgtttcattgtatatctactaattgaggattttatcgtacatgttattgatatgaagagtctggattatgttatgtttctataaagaatgttgacttttttgttttcgcaggcagttaacttggctgaactaagatcattgttttttatatttcctctgtggtttatgtaatttatggaatgattggtataataggaggtacccaggcattactggaagcagaacctcgaggattgagaaatagtcattggattcagcaatgtagatattgttggtgactttgagtcagattcaatagagggatggaagcaaaagctcgaatgcagtggcgtttaagagagaatgaagctagccatggtggctcttgcctgtaatcctagcactttgggaggctgaggcaggtggatcacttgaggccaggagttcaagaccaccctgggcaacatggtgaaaccccgtctccactaaaaatacaaaaaaattagctgggcatggtggcgtgtgcctgttatccccaggaggctgaggttgcagtgagccgagatcccgccactgcactccagcctgagtgacagagcaagactctgtctcaaaacagaaaaacaaacaaacaagaatgagagagagcaattagaaagagtaggaatagatgaatagacagctctttctttcttttttttgagacagagtcttgctgtgttgccaggctggagtgtagtggcgcaatctcggctcactgcaaccttcgcctcccaggttcaagcgattctctttcctcagcctcccgagtacagtcacgtaccaccacaccccatacccagctaattcttcttttttttttttttttttttcagtaaaggcgggtttcaccatgttagccagggtggagaatggacagctctaagagttttgcttcaaaatggagaaaggaaatggagtaatagctgataggaggaagttattcagaagttttcttttttcgtttttttactatgaaaatttgggggttaggcaaagttaatcctagtgctctgggagttcaaggcgggaggattgcttgaggccagaagctcaggaccagcctaggcaacatagcaagaccctatctctccaagaaaatgaaaaattagcctggcatggtgacatgcctgtagtcctagctatttaggaggctcagcggagaagatcacttgagtctaggagtaggaggttacaataggctatgatggtgccattgtactacagcctgggcaatagagtgagaccgtatctctaaaaaattttttaaaataaaaattttaagtttaccagtaagttgaaagaaccataataaacactaatatagctgcaacctacattcaacagttaacagttggccagattagctttatctttatttttctgaaccatttcacagtaggttgccgatatcgtgacacttaatccttaaatattttaacatgcgtctcctaagaatacacaaattctttttaaaaaccacatccagtactcacttcagcaggacatatattaaaatttgaataatacagaggttagcatggcctctgcacatggatggcacaaatttgtgaagctttctgtattttttattacctgggtgatgagataatatgtataccaagccccaagacacgcaatttatttatagaaccaacctacacatgtacccctgaaactagaataaaatttaaaaattaaataaaaaaataaaaaccagactgggcgcggtggctcacacctgtaatcctagcacttcgggaggccaaagcgggcggatcacctgaggtcaggagtttgagaccagcctggccaacatggagaaaccccatctctactaaaaatacaaaaatcagctgggcatagtggtgcatgcctgtggtcccagctacttgggaggctgaggcaggagcagtgcttgaacctgggaggcagaggttgcagtgagccgagattgtgccactgcactccagcctgggcgacagagcgagactctgtctcaaaaaataaaaaaaaaaaaaccacgccgttatcctatctatgaaaattagcgatttcctaatattatgtattattcagtgagtgtcacaacagagtgatactctgtctcaaaaaataaaaaccacacccagttatgtctgtgaaaattaatgatttcctaatattatgtattatccagtgagtgttacgacagagcgatactctgtcctaaaaaataaaaaataaataaaataaaaaccacacccggttggctgggcatggtggctcatgcctgtaatcccagtactttgggaggccaaggcgggcggatcacaagctcaagagatcaagaccatcttggccaacatggtgaaaccccatctctactgaaaacagaaaaattaactgggcgtggtgctgcgtgcctgtagtcccagctactcgggaggctgaggcaggagaatcgcttgaacctgggaggtgtaggtttcagtgagccgagatcgtaccactgcactgcagcctggcaagagagcaagactccatctcaaaaaaaaaaaagacacccagttatcctatctgttagaattaactatttcctaatatgtgatatccagtgagggtttacattttcccagttgtccccaaactgtttaatagctttttaaatattaaatcagaaagccaggcatagtggctcacacctgtaatcccagcactctgggaggccgaggcaggcggatcacctgaggtcgggagctggagaccagcctgaccaacatggagcaaccccgtttctactaaaaacacaaaatttgctgagcgtggtggcgcatgcaggaaaatcacctgaacccgggaggcagcggttgcggtgagccaagattgcgccattacactccagcctgggcaacgagcgaaactccatctcaaaaaaaaaaaaaaaattagctgagcgtggtggcacctgcctgtaatcccaactatttggcatgctgaggcaggagaatctcttgaacctgggaggcggaagttgggtgagccgagatcacgccgttgcactccagcctgggcaacagagtgagactcttatctaaaaaaaaaaaaaggaagagtcccgggtgcggtggctcacacctgtaatcccagcactttgggaggcagaagtgggtggatcacctaaggtcgggagttcgagaccaggctgatcaacatggtgaaacccatctctgccaaaaatacaaaattagggcgtggtggtgcatgcctgtaatgctagctacttgggaggctgaggcactaaaatcacttgaacccaggaggtggaggttgcaatgagccaaggttgtgccattgcacttcatcctgagcaacaagagcgaaactccatctcaagtaaattaattaaattcttcctcttttctgagcatcgctataggctttaattataggttttaatgtattggttgtcttattattagttagggcaatgattattgtgagtgctcaagttgttccaaatatgtctggtgggagcctagagggtttaaaaggctgagagaaaataaaggtatgttagcatgccaatggaaatgatgcaacggataaatttaaaaatgataatataggagaaagatgggagaattcttgaaatgatgtccttgagaaggtgaaaggaagtgggctccggggcataaatcaaggcttggctctaagaggagctggcgataggtgggaagacagaggctattgtagcaatgctcggggtggagcggcatttatcttcagaccacttcagtcttctcagctcattaagaagaaaagccagtagaggagaggaggtgtaggaggttttaggaatccactcctgcccacttgatcttatccctttagcagggtccaaccctgattgatctttattccccacggtatctagcagagtgcttttactctacgttgttgatcatgtgaaactgagtgaacacctacatttgtataaagccggtttctgaacatcaatccactaagcagcctcacacatttaactggccaaggtaaaagaaaacacttggagattctgattcgagagatgtgaatggagtgggcttttcagggagcttcatttttacaaattccatagggggttctgatgagcatccaggtttgggaactactgattaaaagaaagtttgtttattcaactactatatgttgagcaccagccatttataaggtaccgtgagtacagctgtcttgatcctagagtcaggagaattgactgattttttttgttgttgtttgtttgagacagtctcactctgtcacccaggctgcagtgcagtggcattatcttggctcactgcaaccccttcctcccaggttcaagtgattctcctgcctcagcctcccgagtagctgggattacaggcatgcaccaccatgcctggctaataattgactgattttttttttttttttttttgagacggagtctcactctgccacccaggctggagtgcagtggcaacctccgcctcctgggttcaaatgattcttctgcctcagcctcccaagtagctgggactacaggcacgagccaccatgtccggataatttttgtatttttagtagagatggggtgtcaccatattggccaggctggtcttgaactcctagacctcgtgatccgcccacctcggcctcccaaagtgctgggattacaggcgtgagccaccgcacccggcctaattgatttttatctatttcagctgagacctagggaaccccttgcagaattatgccataaacaccatagctccctgagctatgttgtattttgaatattagaatattaagtctgggcgtggtggctcacgcctgtaatctcagctctttgggaggcgagacaggcgaatcacgaggtcaggagatcgagaccatcctggctaacacggtgaaaccccatctctactaaaaaaaatacaaaaaaattagccgggtgtggtgaccggcgcctgtagtcccagctactagggaggctgaggcaggagaatggcgtgaacccaggaggcggagcttgcagtgagcccagatcacgccacacgccactgcactccaacctgggcaacagagtgagacaccgtttccaaaaaaaagaatattatagagtcagtgaaacagaattataaaagatatggagggccaggcgcagtggctcatgcctgtaatcccagcactttgggaggccgaggcgggcggaccacctgaggtccagagtttgaaaccagcctgaccaacatggagaaaccctgtctctactaaaaatacaaaattagccaggcatggtggcgcatgcctgtaatcccagctactctggaggctgaggcaggagaatggtttgaacccgggaggcggaggttgctgtgagctgagatcgcaccattgcactccagcctgggcaacaagagcaaaactccatctcaaaaaaaaaaaaaaaaaaaaaggtatttgagttctttcctcaatccatatacatctaaaataaagttatagcatataggcaactttacattctagtcttccttgaaacagtgtcataagtatttttcactgttagcatgtgtttgctcattggtttagcaaacatttgttgctgctgtgagctaatcctgctgggtctgaggataaaagggtgaaagaccattctggtcctcctggagctcactagtaggagagacataagttgacagtgacagctcagtatgatagggcaagaagagaaggggatgaggctgggtgtggtggctcatccctgtaatcctagcactttgggaggccgaggcagattacttgaggccagcagttcaagaaagcctgtgcaacacagagaccccgtgtctattaaaaaaaaaaaaaaagggatgagagaactcagagtaggtactgctcctagatggggccaaggggccttcccagaagtgataccaagctaagacttggagggaatgccagcccaaaaaggggaaaggagaagctgttccatgtgaggaaaaaacagcacagaaatgagaaagaacttggtagatacaggagtgcagaattattcagcatggctgggggagtggtgagaggcaaggccaggtcacagataacctgtgtgtcacagcaagaaatttggtgtcagggagagaacataagaagaagcaagcggattgatgctgggtgagaattaggtttgttctgggtgtgctgagtgcctcagacttcatgggacagctaaatgacagagtttagtaggcatttcatgttctgatgtttggaagagaaggcagtgctagaggtaaggacttaggacagtggcctcttggtgaaaccctgggcatagaccacccagagactgggtaaagtgaaaaaaaggtcaggacagatcccccatggagtcagggggtatgtagagaagggaagaatctggccagactgaggaggaaggttgaggaagatgagagaagaaagcagagagagaaatgtgtccttagaacttgggatagaagaattttaaggagtggttatttctccttgctcctgagaaagaaagttcgaggtaaggatgtgtttgagtcaggaggggcttgaattaattggatcagtgccagtattttcagtggaatggctcagtagcaattttacagtatgttggagcataaaagaaataaggaagtagaatttatgggcaaccatatacaaaataaatttatgaaaggatgccatctttaaaataggtgtagacattcatatgcttcctccctgcatgccagtggatctgggtttcagcacttgctctagaaaccactgattaagtctgaagttttttgggatgcagattcttgggccccaacctagaatttctggttgtgacacttgagaatttttatatttgagaattcaacaggtgattcttatttttcctaaggtgtgaaaaccactgatctaatgttgctcagtcattttccttttcacctcataaaatattcaaactacagaaaagttgggaggatagcacaataaacactcatattcccttcacctgtagtcactaactttttttgttttcatatttgtttttttcttttcttttgagacaaggtgacactctgtcactcaggctatagtgcagtagcgcaataatggctcactgcagcctcaaactcctgggcacaagtgatccccccacctcagcctccccagtagctgggataacaggtacatgccaccatgtccagctaatttttaaatttttttgtagagacagagtctcctatattccccaggctgttcttgaactcctgaactcaagcaatccagccaccttggcttcccaaagtgctgggattacaggcgttggccagatctggccaccaattgttaacattttgtcactttttttctttttctttcttttttttttttttttttgagatggagtcttgctctgtcacccaggttggagtgcagtggtgcgagatctcagctcactgcaatctccgcctcccgggttcaagtggttctcctgcctcagcctcctgagtagctggggttacaggtgcacgtcaccacatccagctaatttttgtatttttagtagagacaggttttcactatgttggtcaggcgggtctcaaacccctgaacttgtgatccgcccacctcagcctcccagagtgctgggattatcggcgtgagccaccacattcagcctttcccctctttcttttgccgaattatttgaaagtaggtgcaaatttcatgctgttttattcctagatactacagcatgctaataataaggcattctcctgaacagccataatgtcttttttttttttttttttttttttttttttttgagacagagtcttgctctgtttcccaggctggagtgcaatggtgcgatctccactcactgcaagctctgcctcccaggttcacaccattctcctgcctcagcctcctgagtagctgggactacaggcgcccgccaccacgcctggctaattttttgtatttttagtagagacggggtttcaccgtgttagccaggatggtctccatctcctgacctcgtgatgcacccacctcggcctcccaaagtgctgggattacaggtgtgagccaccacgccctgcccataatgtcattttcaaactaagaaaattaacagttctccaacatgatccagtaatcagcccatgttcaagtttccccatctgatttttttttttttttttttttgagacggagtctcgctctgtcacccaggctggagtgcagtggcacgatctcggctcactgcaagctccacctcctgggttcaagccattctcctgcctcagcctcccgaatagccgggactacaggtgcccgccaccatgcccggctaattttttgtatttttagtagagacagtgtttcaccatgttagcctgaatggtctcaatctcctgacttcgtgatcggcctgcctcggcctcccaaagtgctgggattacaggtgtgagccaccatgtccggcccccatttgatatttaaaacaaaagtttttatcttttttctttcaatttaagacccaggaagattcacattttgtatttgatgtgtgtcttcagtgggccttttgttttatttttcatgacatcaacttgttttgttcaatgttaaattaaatctaacactgattaaattagtgctgcgatgattacattagtaggcacttgatgaggttatcccttttattgctgatgtcaatttaatcacttgttcaaggtgctaactatcagattaagcacactcatcccttggtattgtggggcattggctccaagagccccagaggaaaccaaaatccatgcatccgcaagtcccataaaatcttgtcatatttgcatgtaatctactcacatcctccaatatacttatttattattatttttttagtagagacaagtgtcttaccatgttgttcaagctggtctccaactcctaggctcaagtgatcctcctgcctgggcctaccaaagtgctgggattacagcctggccaaaactagggtccatatacctttttttttggtgtttttttttttttttccccctgaggcagtcttgctatgtcacccatgctggagtgcagtggcacaatctcactgcagcatcaagctcctcaacctcctgggttcaagctatcctcccacctcagcctcccgagtagctgggactgtagggtcacaccagcacacccagctaatttttgtattttttgcagagatggggttttgccatgttgcctaggctggtctcaaactcgtgagctcaagccatctgcccacctcagcctcccaaagtgctgggattactggcctgagccaccatggttggccatagagctttttttatcccctgatttcctgtccgtgtcattatgttttcctttttcactcagaaccatgatttcctgactgcaatggtctgtgaacatttttccccttacaataaatataatacatactcaccagataaaaatgtaaatactgatgaggaaaaattgtaactaacattttcggggctcttgtgggttagggactttatactaactcattgaagacagacagtagcctgagagaaggtagggtttgggttatcctcattttgccggtgaggaaaatgaagcttgaagttagactaacttagagtcttaagctaataaatggcagagttggttttcaaaccagaaataacttgtttatagtacccttccaaagccttttctatacacaaatatatataagaatgggatcatattgtgaccatctttccatgtcaataaatggacttcaacagcattctttttaatccagtgtccttttgtttcctcttctcccggccttgtccccaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtggagagagcccactgcccagtaccagaactgaaagggttgggctaatggctctgccaggtatcactgctgacacaggctattttgggctctgacacacagctgcctctaggcaggggagaaccaagtgttgcaacacttcattagcgtggaaacttcctttcacacaggggagcaggatcccagagggggtccctgattgggggcaacttccaggactatctcaagcagtgtttggacctgtttcatctgtatcctccaactatttggccgtaattcttccttgagctaagcgaggcagaagctctgcctgcttccaggagtggaaggtgaagaatttgttcccaactccagttgaggcttttgattccctccaagcacttcaccaaatcaaagccagtcacagagaatggagacacctgcccagaatacccaccgtccagggagattagtgtgctttgttcttcctgaccgagactcacaaccacattctgaggtcactcgagtgcccctgtctcatacattccaaaggaagttgaagctatagagacaacagtcaggggctggtggtggtgcttttgggggtctaggagagcccaaggccctgatattttaaaatgtcctcctcggcatctccagcaagttgccactgctggtgagcttcactgtctgccccgttgacacgatgggtttctagtaggggacgccattgatggaaggtctgtgaagacaatgctcgccaaacccctgacagatgtcgtatcatttgactcagcaactcagggcggggcggggtgggggaaattcataacacaaattcatttatttcacaaatatatgttgagtttttaccatgtgccaggcatagtacctgccgagtcaagccctcgaggaaaaaaagcccttaattagtcaacgttcgagctcacattctaattctcaacttcgtgatttgttaatccatcttataggcgaagaaagcgaggtatagacaaggagccgagctgaaacactggctagattccggtaggggtctgagccatcactcccacctggaggcgcggtctccattcctctgaagccctttgtgcggcccccttcctcactgagttctgggctgcggcggcagcactgtgctctagcactaactctgaagctgccagggcagcgtcagcggacagatgaaaaggtgcggggacatgctggctgccagccggggttccgcaagttcaggtcttgggcggggcgtggagggccaggccccgcccctcgaacgacggccttaagtgtgcgcacgcgcagggggccgcgctttctccgggcggcggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcggtaagtgctggtcttcgggtcgggaactggctatctggggcgcgggtgggcggcgccggcctaggcctcagcccccggggcgtgaggccgctaggggcccggcgtccgcggggagcggcgcgcggggggccgggcactcgaggtggacacccgagttgttgactcctggattcctgctggcatcctggtgttgggggacctgcggctcggagcggatggctcgggggtagggtgacgggattcctttgaactttgtgggtggttgatgcctgtcagttaggtttggcggcctgactcttcctttaatgtgagtgagtgccctgctcgtgggctgccctgatgccctattttttactgcgtccagtcggtcttgaactctcgggcctgggctttggcttaatattcgagacttacacatcaactggatattctagtctgaacactacactgggtgttagttctttgtagtaagttaggagtgcgtggtggaggttgaaaccgtgaatttaaaactctcgttttccacccccttaatgtggaataacaacagcatttcttaagagtgtgtgtggggaggggaaatgagatcattcctatcaagtgcctgaagcatagtggccggcactggagaaagttctcagtgaatgttagctgcgccttctatgttcttttttcctagggtcatttgttgagattcattgtttacagagtgctgggtattaggcagacctcttttgggagttagggaccttttttaagacgccagtcctacacagcatgaatcagaaggtcatcttcctggagagcattccagggtccctggttaagcaccctagcctggcactgccactagagcctgagtctagaatttgtctcctgagttaaaggacatttctggccatggaaacgaagagctcctcacaaaacttcaaagtggcagtttgagaacaaggagaatttttagaggatccttaaactggtcatatttgtaactggcgtctgcactgtatagacaaagtactgagtggcagatttcaggtggctttcagaggtctgatttgtgttcagttacacttttgggtctcacatttctacatcctgcttctctctaattccagtttctacttcatttttcaaaagccctacacagttttccagtaacttttccctgatgctgccctcccacagagagggttctttcctgtggatagggagcggagtttgcatggagatggcctctgtcgttagtatgtatctcttccaatagttcagagtactagaagctatgattgccacaccaaaccggaccagttacttacttctaatttgtgttcctgtttctaactctagaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatagtgagtgaccagttggtctggtttgaatttagtggctcatgagattatatggcccttttactgtccatgtcatttcctttcccacctgttagagtgagaaatgccaggactagcttagtgattaaacagtcttagttgtagtcccactaacagtgcaggaaggcctttgagaagactttcctagcatttgtggtcattttattctctgcttacccacagcaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacagtgagtactttgagaaagtagatggtacagtagagataggaggccacgctgagagtggagatgtttaattttattccacaaaaattattattattattttttttaaatggagtcttgctctgtcacccaggctggagtacagtggcgtgatctcggctcactgcagcctccgcctcccgggttcaagctattctgcctcagtctcccgagtagctgggactacagacacccaccaccacgcccggctaatttttgtatttttagtagagacggggtttcactgtattggccaggctggtctcgaactcctgacgtcatgatctgcccgccttggccccccaaagtgctgggattataggcatgagccaccgcacccagcccaaaaattctccttgtcatctgattactccacactcaagtatctatcttttctcctaggaatcagtatcttccaacaccttagagcaggttcagagaaggggtggaagagaaatatgaaaattttggttgggggagggagtaattcctctggatgtcttcatttggctcaggctgagtgtggggcttggagtccctggagtgccctggagttctctgaggggcaggcaaggtgtaaataatatcttggaacttttagaataaataaaattgatttttttttgagagattataagtgtaaatgggctgggtacagtggctcatgcctgtaatcccagcactttgagaggccgaggtggaggatcacttgaggctgggagttcaagaccagtctgggaaatacagcaagaccccttctctacagaaaattttaaaattagccgggcatggtagtacatgcctgtagtcctagctactccagaaagctgagacaggaggatcgcttgagcctaggaaatgaaggctgcagtgagctatgatcgcaccactgcactccagcctgagtgacagagtgaggccctgttactaagaaaaaatagtaagtgtaagtagacagaaaggagttaaagaatctatgtgtatctcaagtagaaaacctagtactggtcctttctttagatagtctttaaaagtttggtagaaggtataaaaggcattgtattgggtctgctattcagccttacttatcattcccttcttttctctttctctcatttctagattccttatggcagaaagtatgacaaggcatggctcctgagcatgattcagagcaagtgcagtgtgcccttcacccctattgaggtaagacaaggcctgagtggctggctggccaggcaccagggatggtgaaggggcaagctggactcccagcgtaatgcccctccccaagggctctggactcccagtgtaatgctcctgtttcctcttgtagtttcactatgagaatacacgggcccagttcttcgttgaagacgccagtactgcctctgcattgaaggctgtcaactataagattttggatcgggagaaccgaagggtgtgtttaaagggcctggcttggctggaggtggaggttggtgctcagagcagggactgggtcttgttcttgcggcttaggcttccctagagttttctgtgccctctgtgtcttccctccagatatctatcatcatcaactcttctgctccaccccacactatactgaatgaactgaagccagaacaagtagaacagctaaaggtgaggcaggctcaaattagatgtttccaacccagtcttactacttctcacacccccaccccccacacacaaacccagtgaccactaaacccttctttttcctctagctgatcatgagcaaacgatacgatggctcccaacaagcccttgacctcaaaggcctccgttcagacccaggtatggttgacagcagtagttctcagataggtggtgataaggtgggatctgtcagggagggaaagtttgaggatgttttactgctaatgctggcatgggcaaaccctctcagtcttccctttccttcccttctgcttcctgaagatttggtggcccagaacattgacgttgtcctgaatcgcagaagctgtatggcagctaccctgaggatcattgaagagaacatccctgaggtaaggcctttggcccagtattaggcatgaggaagcagggtgtgttagataggaagtggctggagggcagattcgtctctgatccacttgctggtggtgcctcctctaaactcttctctcctcacagctattgtccttgaacttgagcaacaacaggctgtacaggctggatgacatgtctagcattgttcagaaggcacccaacctgaagatcctaaacctttctggaaatgaagtgagaattgatagctcggctatatttttgaaggggtgggtagagggtgtagagagtttgtccagtgatggcaagaggcaagagagagaactcaggccagatgtgctggtttgcaactctaatcctaacactttgggaggccaaggcaggaggatcacttaaggctaggagtttgcacgcctctagtccaagctgccccagggggctgaggtgggaggattgcttgagctcaggagttcaaggctgcagtgagttatgattgtgccgttgcattctagcctgagcaacctgtctcaaaaaaatttttttaatttaaaaaataaattagtcgagcatgatgtcacatgcctgtagtcctagctacccaggagtctgaggtgggaggatctcttgagtccaggagtttgaggctgcagtgaactatgatcatgccacggcactgaacttgggtgacagagtgagaccctgtcccaaaaaaaaaaaaaaaagaaaaaattttaaaagattagaaaagatctcagagctaagcgtagggactgggggtatggggagccagctggctgtcttcaccagggtctcctccctttgttccttccaccctttgcagttgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcgccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcaggtgctgggcgtggaggccacgggggcataggctaccaaggagacagagaactgaccccctcgggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttgggggcaacagaggtggggcatggaccctcacccccacaatcctacaggggcctgaaccctcacaccttctgagggaggtctcctgcccccatggctgctttgcttcccacgcccagttcagatcgggacccaggtagcagacagagacctggccaacagcaagtgcccactcaccacagcaaggatttgtttctcatttctaccttggaccacagggatggggcagctgaaagaaagggctgtgtcagggtgtctttctcccttttctccctcatttttctagatgcttttttgccttgtagttctttctctttttctttgctttctctttcctttttctgtctgtctcctatacctccccatctctcccttgcccctgccccatcttgcctttttctctttttcctccttttcctttcttattcctttgcctctcctcttcctgagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggtaagtccataattttttcattctaacaagcacagcatctctcactcacaaggattcctggataggtttctttttctttttctttttcttttttttttttttatttgagacggagtttcactcgtcgcccaggctggagtgcaacagcatgatttcagctcaccgcaacctctgcctcccaggttcaagcgattctcctgcctcagcctcctgagcccaagtagctgggattacaggcatgtgctaccacacctggctaatttttgtatttttagtagagacagggtttcaccatgttcgccaggctggccttgaattcctgacctcaggtgatccacctacctcggcctcccaaagtgctgggattacagacgtgagccactcgcaccaggccctttttttttttttttttggatggagtcttgctctgttacccagagtgcagtggtgcaatcttgactcactgcaccgtttgcctcctgggttcaagtgattctcctgcctcagcctcctgagtagctgggattacaggcatgtgccacaatgcccggctaatttctttgtgtatttttagtagagatgggggtttcatcttgttggccaggatggtcttgaactcctgacctcaactaatccatccaccttggcctcccagtgtgctgggattacaggtgtgagccactgcgcccagcctggatccctggatacttttcatgatgcgtttacacttgacttctgacccttctctcttagttcttcagtctacttatgcacccagcctttttctctctggtttaaactgtcaactttcttttttgtttgttttgttttttgagacagggtctggctctgtcatccaggctggagtgcagtggcacaatcgtagcttactgcaaccttcgcctgccaggctcaagtgatcctcccacttcagcctcccaagtagctaggactccaggcacgcaccaccatgcccagctaatttttgtattttttttggtagagatgggttttgccacgttgtccagccaggctggtctcaaactcctgagctcaagccatctgcctgcctcggcctcccaaagttctgggatcacaggtgtgagccactgggcccagtctacactgtcaacttttacttcctttccacaggatggccatgagctacccccaccaattgcctttgatgttgaagcccccacgacgttaccgccctgcaaggtaggaagcatggacagagtaagaacttgtgtgtggagagaatactgcttccatgttcctaatacctgtttgatttcagggaagctattttggaacagaaaacttgaagagtctggtcttgcacttcctgcaacagtaagtatcccagggtcccccctccccaccccgaggttgagggggaatggtgggcagacccaggcacacatcaatctttttgttttgttttttgttttgtttttttttttttttttggacagtgtctcactgtgtcacccaggctggagtgcaatggtgtgatcttggctcactgcaacctctgcctcccagggttcaagtgattctcctgcctcagcctccccagtagctgggactacaggtgtgtgccactgcacctggctaatttttgtatttttcgtacagatgggatttcactatgttggccaggctggtctccaactcctgacctcatgatccacctgcctcttcctcccaaagtgttgggattagaggcgtgagccaccgcacctagccattttttttgtatttttagtagagacagggtttcgccatgttgcccaggctggtcttgaactcctgggctcaagctattcacccatctcagcctcccaaagtgctgggattacaggcatgagcttccatgcccggccacaactcactcttgggagctactgggtccttgtatggctgtagaccacagagcccatactttcttttttgtttttcccataggtactatgcaatttacgactctggagaccgacaagggctcctggatgcctaccatgatggggcctgctgttccctgagcattcctttcattcctcagaaccctgcccggttagtatcacatcccagaatctgcccgggaccactgggtttcccagcagatacagggcacacctgctggcagcactgctctgaacaccacgtccattccttttattcccccagaagcagcttagccgagtatttcaaggatagcagaaatgtgaagaagcttaaagaccctagtaagtgtgtgatacgaacaaaatatgggaaaagggcatgggaaggaatcagtcagaactcaggagtgtgtggcagcaccactgagctttctcctctacccacagccttgcggttccggctgctgaagcacacgcgtctcaacgttgttgccttcctcaatgagttgcccaaaacccagcacgacgtcaattccttcgtggtagacataagcgcccagacagtaagctcctgcttgcgcctgacagaagcctagaattggggtgggggtggcatttaataggcaagggggggcactcaggctctgagaagtgtacattgtacctgatgctgcttctctttcagagcacattgctgtgtttttctgtcaatggagtcttcaaggaaggtaagaatctttagagtcccgagtttgtagcgtggtcccacccccagctggaattttcctcagcactcttagcttcccagctactttctctcccattttctttttgagctccttctcccattctgcccccaagccgtcttggcttggcctacctctccacctgtcctgtctggatgtgggaaaagcctggggattaggaggactttggagtcaggcagttcttagtttccatcctagttttggttgtgcggggctgtggacaagtaacattacctctaagacagattctttatttgtaagatggggttagtaatagccgtctcatagtggtgctataggaagtaaactgaagtgacttacaaagtgcttggcctggggcctggcatacagatgctatcagtggattagtagttattacttttttttgagatggagtcacactctatcaccaggctggagtgcagtggcgcaatcttggctcactgcaacctccgtctcctgggttcaagtggttctcctgcttcagcctcccgagtagctgggactacaggtgcgcactaccacgcccagctaatttttgtatttttagtagagaaggggtttcgccatgttggacaggatggtctcgatctcttgacctcgtgatctgcccacctcagcctcccaaagtgctgggattatacgcatgagacactgtgcccggccgtagttattactattgtcctttctgacctgacccttcaccccacctgtgcttcccttatacccttatatacttaatcattcctctctgacttgctaggattctttatatcaaagaccatgattcaagaagctgtttgtaaacataaagcactagtgaccctaaggtgttgttgctgttcttattgcagtggacggaaagtcccgggattctttgcgagccttcacccggacattcattgctgttcctgctagcaattcagggtaagtattctgcttttcgcattggataccagtcctaatccatggccaacagtgtggtaattggagggtagagtcagtctttggggtgatttcagaaaggcaacaggaaatcagagaaagctcacatagtagttaagagccagttaatagcttggctctggaattgtaccgtctgggttttcatcctggctccaccacttctagcaagtaggctgctgcctcatctgaaaattcatataacaatattcatttcctaagtttgttgtgaggatgaattaaaagagctaaagtccatgcgttgggagaaccctagtgtgtttagtagataatccttccaaacattgattccatgggaggggataaatgataaaaggtaacaatagctaagagtgggagggggaccttgtggatattgaaagaatcagagaataggaatgatgttgggaggatgatgttatctctgtctagctttttaagtgctctttgtcctcaaggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgagtgcggggcatgtgtaggatggggatgcactgaagtagggctagtagtaaataatgagggctcctgacagtttttttgttttttttttggagacaagttcttgcgctgtcatccaggctggagtatagtggtgatcataactcactgtagcctctaattcctgggcacaagctgtcctcccacctcagcctccagagtagctgggcctataggcatgtgccaccttattttattttattattttttttttttggaggtggagtcttgctatgttgcccaggctggagtgcagtggtgcgatcttggctcattgtaacctctgcctcccgggttcaagcaattctccaatctcagcctcccgagtagctgggattacaggcacacaccaccatgcctggctaatttttgtattttttttttttttttttttttttagtagagacgggctttcatcatgttggccaggctggtctcgaactcctgaccttgtgatctgcctacctcggcctcccaaagtgctgggattacaggcatgaggcactgcacccagccaaatttttatttgcttgtttgttttgagacagggtctcactctgatgcccaggctggagtacagtggtgtgatcacagttcactgcagcctcaactgctagggctcaggtgattctcccacctcagccacctgagtagctgggactacaggcataggccacagcacctggctaatttttttgtatttctttgcagagatggggtttcaccatgttgcccacctaggcctcccaaagtgctgcggttataggtgtgagttactgtgcctgggctcctgaaattttaaaaggcaaaacttttggctgcttaaaaaaacctaatagttggctgggagaggtggctcacacctgtaatcccagcactttgggaggctgaggcggccagatcacgaggtcaagagatcaagaccatcctggacaacatggtgaaatctcgtctctactaaaaatacaaaaattagcggggcttggcgttccacgcctgtagtcccaactactcgggaggctgaggcaggagaattgcttgaacctggaaggcggaggttgcagtgagccgagatcacgccactgcactccagcctggtgacagagcaagactcggtctcaaaaaaaaaaaaaaagcaaacagaaaaacacaaacctgatagtctataaaaaatttgcctgtgtataaattaacataaaaaactttaaaggtaaaatggaagttccttttcatatactgttctgcaacttagtttctttacttacaccatgaacatctttccctaccactgtaaaaactatcttgagcttcttgacagctatttaatattccttatctttgagaagccattggtagaacatctggacttttactaatgtctcatttgtataaatagtgcaaggatgtataagaatgtacatatttgttggcaaacttgggtgcttttatggagtggactttcagctggcatttacgagtcagagttcttacagagctgcctgttcttccactccaggtgccttcaggacaacaactgggactacaccagatctgcccaggccttcactcatctcaaggtaaggtctggaaatacagtggcaaaaagactaggatctctgggcctccaggaggtcaggttagctgagtggggttgctgagtggcgagggtaggcctacctctactgaccttcatttttctccaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatttcgtgttctgcgtgctggattggttgtctcctcccagccctgagcgaggggggcgggccctctagcgggggcgcccagggagggcggaaggcggctctgcggcaggaagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcggtaagacgtgggctggcttcccactgtgacaacgtggggtggcgggacacgaccttccctatacaggcagggagagtcagggactccctatccgagagtggcgggcgggctttaccccacagaaatgtgaaacactggccgggcgcggcggctcaaatgctgggaggccggaggcgggcggatcactaggtcaggacatccagaccatcctggctaacaccgtcaaaccctgtgtctactaaaaatacaaaaaattagctgggcgtggtagcaagcgcctgtagtcccagctactcgggaggctgaggcaggagaatcaattgaacctgggaggcggaggttgcagtgagccgagatgacgccactgcactccagcctaagcgaccgagcgagactcccctctcaaaaaaaaaaattgggaaacagtgatgtctccgagcgccgtgccctgtcatagcctaggctgagggctgcccttcactctgcgaccttgagcaaggtccttaaagctctccatcttcccattaaaatggaaacggacatctattaaggttgttgggaggaataacaagattactgggtataacaggagctcagtactgcactccagcctggccggcagagtgagactcagtctcaaaaaaaaaagcgctcagtaaatactactttcatcccacaaatttcttattcagagggcactggaaaggtcggtacttagatgcccagtgaaaacccctcaccccaatctctgccctgcctgcaggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttac

SEQ ID NO: 38634 - DNA, 20988 bp, Homo sapiens
ggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccaggtaaaggggtctccccaatacccacccccgaccggccgcaggcgacgtcgctacctgcggagagagtcggtcccctcctttccaggggccgaggctccttcacccacacccgagcatccaaaggaccagctggggccaataagggctgaccaggatccttgagtcgctgcagtattccaaaggggacctctaggcgggctcaaggcacctgccataaatggctctggctctgcgttgacatcagaaggagaggcagaagaatagctcagtaggcaacatgcatttcctcaaaggaagagaaaatgttccctgttttcttgtcgttgactctgtattcattattgaaactgctaattgtctaattctctgtagagtgtgtgtgtgtatacagttataagcatcttggtaaattatagtgtgctgtaagacgatttccaatatttgaactaattacgtgcgagtaagttttagcgactcttgtatgcagacgttaaaactcaggggcatcctctctcacccgcctgtatccttttaccccgtctttcaacaagattcaactcgacttcaggcccttaaagcctaaataataatggattagaaaacgtcgctaacctaatattgctgagcctctttaatgatataaaactcttaaacacttctctcaatgctgcatactgaaaacaactcctgccccatctccttacatagttcaggtttctttgcaaaagcttgaaaagaggctacattagaatccattcaaaataaagtattggcctggttttctcttgattccctagaggcttgcaaaatatggcagcgtattaagtaccttggccagaattattaacctggggagtccacgataaggtatccatggatagaattcaggatgtctgtgaacttgagtggaaaaaattattatttcaccgacttctgaaatggaatgtaggcaaaagccacagtagtattagcagtagctatgatttgccccctgtaaatattgccgatatctttatatcacatgacttgttgcacgtttcaaaatattatctatactcaataccacgtcaaaattatggcagttattagatgaccacttgttacttaataggttaataaagaagcacatattatgtcccacaactttttgtaagttttaactaaaatgaggataataatgggatctgtaaagattaaatgacatgatatatataaagtgcttagcatagaaactggcattttagacgcaataaatgttactattttactgtatacagaattttgacaaacagcaagaaaagtattagacttgtgttttattaccatatactggtttgtttctgggtttttttttttttttggttttacctttttttaaaactaaaagtccatagttcacataatgttcactctgtgtgttttacatttctatgggttttgacagatgttcaataacatgtatcctccattacagtgttatacagaatagtctcaatgccccaaatatcccttgcactccaccgattcatcctcccactcctgttctcctggtgaccactggccttcttactgccgctgtagtttgccttttttagaacgtcatacagttagattcatatctgttcagactggcttctttgacttaggaatatgcagttaagattcctccatgtctttttgtggcttgatagttcatttatttttattactgagtaatattccaatgtatggatgtatctcattttgtttattcatctattgatgggcatcttggttgcttttagtttttggcaattatgaataaagctactacaaatattctattgcagatttttgtgtggacataagttttcaattcatttgagtgaatacataggaggacaattgctgaattgtatggtaaggctgcatttagcttggtaagaaactgccaaacttctcccaaagtggctgtaccattttgcattccccaacagcaatgaatgagaatttttccttttttttttttcttttttgagatagggtctcactctgttgcccaggctggagtgcagtggcatgatctcggctcactgcaacctccacgtcccgggttcaagcgattcttctgcctcagcctcccaagtagctgggattacaggcacctgccaccatatctggctaatttttgtatttttttttagtagagatggggtttcaccatgttggtcaggctgatctcaaactcctgacctcaagtgatctgcccaccttggcctcccaaagtgctgggattacagatgtgagccaccgcgcccaggcgagaatttctgttgctccatgtccttgtatttggtattgtccattttttggattttagccattctcataggtgggtagtggtatcttgtttgaatttgcaatcccctaatgacatatgatgttagataccttttcatatgcttatttgtcatctgtatatcttctttgataaggtgtctgctcagatcttctgtccattgagtttcttttcttattgctgacttgagttctttgtatattttggataccagtcctttatcacagggttccccaacccctgggccgcagaccagtacctattaggaaatgggccacacagcaggaggtgagcagtgggccagagagcaaagcttcctctgtatttacattatgcattactgcctgagctccacctcctgtcagatcagtggtggccgtagattctcatcggcgcacgaaccctgttgtgaactgcacatgtgagggatctaggctgcacactccttatgagaatctaatgcctgatgatctgtcactgtctcccatcacccccagatggtactgtctagttgcaggaagacaagctcagggctcccactgattctacattatgttgagttgtataattatgtcgttatatattataatgtaataatagaaataaagtgcacaataaatacaatgcacttgaatcatcctgaaccatacccccacaacgccgtccatggaaaaattgtcttccatgaaactggtccctggtgcgagaaaggctatggactgctgctttatcagatgtgtgtttcacaaatatttcctccaaaaaaaaaaaaaccacctcaaatatttcctccaagtctgtggtttatcttttcattctctttaacggtatcttttgtagagcagaagtttttaaatttaatgaagtccaacatcaaatttttctttcatggagtgtgcttttggtattgtatttaaaaactcatcacctaatctaaggtcacaaggattttcttctgttattttctagaaattttatggttttatattttacatttaggtctgtgatccatttagagctaaattttgtgaaaggtgtaaagtatgtggctagatttatttatttattcatttttgcaaatggatatccagttgttccagtaccatttttggaaaagactgtcctttctccattgaatcccctttgctcctttgtcaaagatcagttgactctctttgtgagggtctatttctgggtttactattccattccattgatctgtttgtctattctttttctaataccatacttttttgattattgtagctttacggtaagtgttgaagtcaggtagtatcagtcttccaactttgttctttagtattctggactgttcttggtcttttctgcatttccatgtaaattttaaaatcagttggttgatatccaaaaaataactttgggcttttgattaagactgtatttaatctgtagctcaagttgggaagcactgatacctttttttttttgagacggagtctcgctctgtcgcccaggctgcagtgcagtggcgcaatctcggcttgctgcaagctccgcctggggttcatgccattctcctgcctcagcctcccgagtagctgggactacaggcggccgccaccacgcccagctaactttttgtatttttagtagagacggggtttcaccgtgttagccaggatggttgtgatctcctgacctcatgatctgcctgcctcggcctcccaaagtgctgggattacaggcttgagccatggcgcctggccaggaagcactgatatgttaacaaaataaagtcttcctatccatgaacatgttatatctctctatttattagctcctctttgatttctttcaccaggattttgtagggacattctaaaatctattttggtaattatatttcactataactggcttcctttggaatcctacatattccattttatgcatttttaaatatgtctcacaaaagagatcctgagcttcctcagactatcaaaggggttaataaacaaaggttaaagaagtagtaattctgctctaagctatcattcagcaaacaatttgtattcaacaaaatgtttaatgaaatgttaaaaggaaatgtggaggttgataggtgaggataatttcttgtattgtcttgccagtttaacatttatttttcctaaaagaaccagcatctcaatagagttggcattatacatagtgtgacttttgtatttttaaggctgtcaaaaagaaaacctgcccctaaactttcctttaactgaggcagcgtattcctcctgctgactggctaatttctagaattagattattagagttttctaactctgatttgatacttcttaaggagaagcagcaataggaaagactatctcagtttcttcattataaaatgaggaaaataatagcttttttttttttttttgagacggagttttgctcttgtcacccaggctggagtgcagtggtgcaatcgtggcttgctgcaacctccacttcccgggttcaagtgattctcctgcctcaacctcccgagtagctgggattacagctgcccgccatcacacccaactaatttttgtatttttaatagagatggggtttcaccacattggccaggctggtgtcgaactcctgacctcaggtgatccgcccacgtgacttgacctcccaaagtgctgggattacaggcatgagccaccgcacccggccaataatagcttttttgcaaggttgttgtattagtcagggttctctagaaggacagaactagtgtaatatatatatatatatatatatatatatatatatatatatatatatatatatgggagtttattaagtattaactcacatgatcacaaggccccacaataggccatctgcaggctgaggagcaaggagtttcaaaactgaagaacttggagtctgatgtttgaaggcaggaagcatccagctcaagagaaagatataggctggggctgggcgtggtggctcacacctgtaatcccagcactttgggaggccgaggcaggcggatcatggtcaggagatcgagatcatcctggccaacacagtgaaaccccgtctctactaaaaatacaaaaaaccagccgggcgtggtggcatgcgtctgtagtcccagctactcggaaggctgaggcaggggaatcactcgaacccaagaggtggaggttacagtgagccgagattgtgccactgcactccagcctggcgacagcaatactctgtctcaaaaaaaaaaaaaaagatataggctgggaggccaggccagtctctctttttcgcattttctgcctgcttatattctaactgcactggcagcagatttggttgtgcccacccagattcagggtgggtctgcctttcccagcccactgactcaaatgttaatctcctttggcaacatgctcacagacacacccggaatcaatactttgtatcctttaatcaaatcaagttgacactcagtattagccattacagttggtataaagattaaagatggtaataaattaaagagaataacaattcaaaagagtggtaaattccttagcacaatgtctaccatctagtatattgtcacctatttttactttttaagttttttttgagacatggtctcgctttgtcacccaggctggagtgcagtggtgtaatcacggctcactgcagcctcaacttcctgggctccagcgatcctcccacctcagcctcccaagtcgctgggaccacaggcatgcgccaccacacccagctaattttttgtatttttagtagagacagggtttcaccatgttgcccaggctggttttgaactcctgagctcaagcaatccacccacctcagccttccaaagtgctgagattacaggcatgagctaccacgcctagcccctagtagatgattttaaaatgctgattgttattactgagaaaggaaatatgctcaaacctattactactgcttcatcagtgactagaaatgtgtgccctctccgctctgagttagaagagggaaggattgtagaattccgaggcaggcctactgtttatacctgttccttcataagcattgtcagcttttaagcattggtgaggtagtatgtttgtttatgcttattagttctttgccaaatgtttaatgaaaagttgtcttaaatttactaaaagtgaaacaaaaaatacgtgtatcttttcttctctaaattgtatgtggatccttttcattgactttaaggaaatgaaatgtttcttcccttgtttgttaaagaaacaaaactcattgatgattttccatttttgttctagagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatacttcaactcaagaagactgcattaattcttgctgttcaacaaaaaacatatcaggtaaatagtggtttcttggcaatcctttgttccatgtgttttgtggcttcaggagctgggggatgtggctgaataacttataccagtgattctcgacagggtatgaatataagtgacaaaatcactggagaattttctacaagtgtgccctcccctctcctaagctgagtcaaagttattgatgaatgtatgtatatatccctcaggtgactgggtagacaagaggttgagaatcactggtgttatatcccaactggtatctagaatattgaaaacaaaaatcctattgaaatggttagctgccatcagcatggagtattggaatacagtgtgatattacaaagaaaatgtaaacagagaaaaggggttgagacaaaaaatagaattcttatctcttgggaaaatcagcatttgatctttaagttggaagcataaaacctccacttcgtctccttccttggagctggtggcataggataagtcaaaaaaaaaaaaaaaaaaaaaaaacaaaaaaacactgactactaggtaactacagcttctagaactctaatgggatggggaatcaattagtctggcccattttcatgacacaggaggaaactgagacccataggtttgaaccaggacttgcatattttaggatttaagtatttgtactgaaaagagaagtatactgtgtattttagtaaaaccttttttcaattttacttatgaccctgtccgagttctctaaatgaaaaaaactaaatttcttgagtacttaacactttgttagttgccagagagaaaacagtgaataagatggacaaggccttgccatcaagttgcctagaaaagctagtgaatggccgggtgtggtgaatcattcctgtaatcccagaactttgagaggccaaggcaggaggattgcttgagcccaggagtttgagagcagcctgggcaacatagcaagaccctgttctctgtaaaaagtaaaaaatcagccaggcgtgctggtgcacgcatgtagtcccagctattgggaggctgaggtgggaggatcacttgatcctagggggttgaggctgcagtggacttttttgtttgtttgtctgtgatgatgtctcactctgttgcccaggccggacggagcgcagtggcgcaatcttggctcactgcattctctgcctcccaggttcaagtgattctcctgcctcagcctcccgggtagctgagattacaggtgttcgccaccacatccagctaatttttactattttcaatagagacgtggtttcaccatgttggtcaggctagtcttgaactcctgacttcaaatgatcctcccaccttggcctcccaaagtgctggcctcccaaagtgtgtgagccaccgcacccagcctacagtgagctttgatcgaaccactgcactccagcctgggtgacaaagcaagaccttgtctcaaaagatacatatttgatctttgtctccagttcctggcacagaactcctaaaaaccttggaatttcccaagagatgggagcatgtctttggttattcataaccagcccctttcaactatacttgagtttgtgctagtgaggcttcacctcaggggagggactggagattgagttcagtcacagtggcccatgacttaatcaatcatgcttgtgtaaaatgagaccatcataaaaacccctagatgatcgggaagcatccaagttggtgaacacatcccagtgtcaagagaattatgcacctcagttccccagggacaaagtctcctgcacttgggactctaggagcctcttttggctgttcatttgtatcccttattataaactgtaatagtaaatacagcattttccttagttctattagttgttcttgcaaattatcaaatctgagggggtaggatcatgggaatccctgaattagcagtagccgagtcaggcagaagtgtgggtgacctggagacctgatacttgctactggcttctgaaatgagggcagtcttgtgataccgagcccataatccatggaatctgatgccagctctggatagttggtgtcagaattgaactcaatagtaggatatgtggttattgctgcaaaatggtgtggagaagacaccgtatacttggggtcaggaggaaaaatcccttcgatggtctcattgagcagtgtgctttgggacactttatgcaagtaatttatggaaatgacagaggtttaatttaaatttctagtttttctttaaatgttgacatcaacatgtatgtgaaatagaaacatcacctgcaagcaggactgaatactgtaagtgtggtatttacaggcatcagcaaagccctgctcctcaattctaagaaacgagggtttgctgttttattctagaagccaaagtcctattactgctttgctacaagcagaggtacttggaacctcagttaatggatctcaaacattttcctcacttcctgagaaatggtttaaccaccgagggttcaaaaggcactatgataactcgatgatactctagaaaaatgcacataacacgatgggcacaatatcttgcatacaattttgagcttatggaccctcccctttacctaagtgctaaaaagaaaggtatttctggtatcacattgttgagaaaggaaaagcaggagtactcctgttattatctgagtaatggggatatgacgtgataaaactcctgcagaggctaactaaatcttccttcccatctcgggagttggagttgatctctcaccattgcctgactagcaccagtggtggtgatggtcgacagagcgtatgtttttaacaattagcctatgtgtctcttaaccttcagcctgaccagggatacgctgacctcccaaagatgtgagactgtaccaaatggaggacaaaatcaaatctaggccatgatgaatagagggtttaatttctgttggacacaagaggaacagaaaaagaagccagcagctgggtgcattagctcatgcctgtaatcccagtactttgggaggttgagggggatggattgcttgagcccaagagttcaagatcagcctaggcaacatagtgagaccccgcctctacaaaaaacaaaaaattagccaggcatggtggtgcacgcttgaagtcccagctactggggaggctgaggtgggaggattgtttgagcccaggaggtcaaggctgaagtgagccatgattgttccactgcactgcagcttggatgacagagcaagaccctgactcaaaaaagaaaagaaaagagaccagaaattatagttaacagtgaaaagtaaggaaggaaggaacatagaaaagcaaatatgacaaggagagaggggtaattggaagaaaaacacaaagaatggtacagataaaaattaaaagatagactgtattccatatactactcagatcctgtgtggaaggagccatgatatctatgataatttactgactccactcatggctttattaggcatctgagatgctttcagaatccaagagatggccaggtgcagtggcttacacctgtaatcccagcactttcagaggccaactagggcaaacagcttgagcccaggagttcaagactagcctgggcaatatagagagactccatctctacaaaaaataccaaaaaaaatccgagtgtggtggcttgcatctgtagtcccagttactcgggaggctgaagtgggaggatctcttgaacctgggaggtggaggttgcagtgagctgaaatcatgccactgcatttgcacttcagcttgagcgacagagcaagacattatctcaaaaaataaaaaataaaaaaaataaataatcccagttttgtaggcaacatgcaaagcattgtgggcaggggccagcagagcgcatgcctctttctctccatcaggcctgctcagggtgtaaccttggccacatcagtgtcagagagcctcttcacagcctctttggtgcttgccggccctggcatccacagtgaacaccagtgtgtggttgtcttctatcttcatagcacatcagtagtcagggcttgatgatggcagagtggtcaaacatgtgggagcactcttcccgggatactcgggctgcctctggagccacagtgtcttgagctgctggaggtaagtgacatgcaggtcttaggggtgtgtgtgtgtgtgtgtgtgtgtgtgtttgtgtgtgtgtggttgtggatgcctttcagccctgccttcttggcctttaaagactttgctttggctttgactttaggagggacaggagcttccttcttcgccttcggtgccaccttgtgaaaaaaaaaaagctaaacccaatgttttttaaaattgccttaagcaactaagctaaggaaaaggaaatgattcagcggtcagcaagcaagtgaacaaaatgaacaaaggtgtttgtgttggactccataataagtgaagtttttcctacttgccctactctttagaaaatcgcatttcaaaatcatgcttatgaaacctttcattgcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacaggtaatgaaagcattatactttttcttttgtgattggaataatttaagactggttcatgtgaaagattttctacaagagtctaaataaaactaccagaaggggtaccagacatatcagaaaatctcatgactggaaattcaatttattaaaccaaaatttgatttccaatgaaagccatggtagtatttgttctggtttgtttctgtttttaccttcatgagataaaagacacacaaaccttgtatgaaacgtttttgaagcacctctttagaacaaggtcggcaacactggaataagtatacaggtctccagggtgattgttttgaaagggtgaagacttgtgttaatatagaaagttctagtatatttgttattaagttcccattataatcacattatctgaaatcaaactttttatggccataccaccctgaacgcacccaatctcgtctgaaatcaaactcactggattttattgtctagactggaaaggaaattcattcaagaaatatttattaaacatttaccatgtgccagattctgtccaaagcactagaactacaatctccatgttcatggaacttacatattaattcagaatggaaaataaatagcaaaaaaattaatataattcctgggatatgttttgctgagactttggcttgttaatttttcaagttgaagtggtttcagtatcaatttttcttttttttgagattatccatataaaaaaggtgaaaacaaattaatgttgcttaggtaattctgtggacccttcatagacagtatttgcataaaatcagaattacagaatttagtggggtttgttgttgttgttgcttgtttgtttgctttttccgagatggagtctcactctgttgcccaggatggagtgcagtggtgcgatctcggctcactgcaagctccgcctcccgggttcaggccattctcccgcctcagcctcctgagtaactgggactacaggtgcccgccaccacgcccggctaattttgtttttgtacttttagtagagatggggtttcaccgtgttagccaggatggtctcaatctcctgacctcgtgatccgcctgccttggcctcccaaagtgctgggattacaggcatgagtgttgttgttttttgagagagagtctcactctgtcgcccaggctggagtgcagtggtgcgatctcagctcactgcaaccaccacctcctggcttcaagcaattctcatgcctcagcctcccaagtagctggggttacaggcacccactaccatgcccagctatttttttttttttgtatttttagtagagatggggtttcaccatgtgggccaggctggtctcacctcctgacctcaggtgatccaccctccttagcctcccaaagtgctgggattacaggcgtgagccactacacccagcttcaatttttcttttatttaagttttagaaagttatcatcatactcttgatttttaatattctacttgttcatttgttcaataaataacaaatattatttagcatctcctatgtgccaagtactttctatgccctaaggaaacaacactaaacatgaaaaacaaggttctggccatgtggtagctcatgcctataattccagcactctgggaggtgggaggatcacttgagcccagaagttagagaccagcctgggcaacatgatgagacctcatatccacaaaaaattaaaaaaattagccgggcatggtggcatgagcttgtagtcccagctacttgggaggccaaggcaggagaattccttgagaccaggaggtcaaagctgcagtgagctgtgttcatgccactacactctagcctgggtgacaaagtgagatactatctctaaaaaaaaaataggaaaacaaggttctcccttctggaacttatgttttaggggagagagacaataaccataataaataaataatcaagaaaaatatagtcacaagtgctatgcacagaattgagacaggacggtataatagacaatcagtaagtaaagttgtaacccctaaactgagatctgaatagtgaggagccagatgtgaggagatcaggggaagaccttccaagtccaaggtcctcaggcagaatgctttggagtgtttgaaaaaccaacactccaatcccagctggttgactcattgtgaaatacgcagagagtgatatgcaaaacggtggggagggccagatcacataacaccttgtaagtcataggagggagtttttttgtttgttgttgttgtttttgagacagagtctcactctgttgcccagggtggagtgcagtggcgcgatctcagctcactgcaacctccgccttaggaggggcatatgccactacacgtggctaatttttgtatttttagtagagatagggtttcaccacattggccaggctggtctcgaactcctgatgtcgggtaatccacccacctcggcctctcaaagtgctgggattacaggcatgagcctccgtgcccggccgggagtttttaggtgtgtggtgggaagctgttgggagttttatttttattttttttttgagatggagtctcactcttttcacccaggctggagttcagtgatgcagtgtcggttcagtgccacctctgcctcccaagttcaagtgattctcctgcctcagcctcctgagtagctgggactacaggcaagcatcaccatgcctggctaatttttgtatttttagtagacatggtctcgccatgttggccaggctggtctcaaattcctgacctcctgactcatgtatgtaatcccagcactttgggaggctgaggcgggcagatcacaacgtcaggaattcgagaccagcctggccaacatggtgaaaccccgtctctactaaaaatacaaaaattagccgggtgtgctggtgcgtgcctgtaatcccagctactcaggaggctgaggcgggagaattgcttgaacccaggaggcagaggttgcagtgagctgagattgcgccactgcactctagcctgcacgacagagcaagactctgtctcggggagaagaaaaaaaaaaggtgatttctcaaagctcaccgtagccgccctcttgggaatggacagtgacacagcagcaaagtggaaatggaaagactggttaggaggcgcaggtgagatctgggtgaagaaacagggagtggcgggcgagatggagagagtagtggacatatgggctattccgaagtagagttgacaggacttgctggtggtgtgggtctggggaaccagaaaaaaagaaccatcaaggccaagtcctagtttttgccttgagcatccagatgaatggtgacaccatttgctgcactgggggaaacttgagtagttttagggttgtggaatggaatctaggtggagtggaatctagggttctctcttgactgcattaagtatgaggggcttcggggaatgatactgcccagggtgcctgcgtgttgacactgctttgccccctagctgaggctgtgtctgagttttgttcatgtgccagggaagcctgatgggtcaaacatcctctcaaacaggagcgtgaagcacagagtattgtgtaaataattgttgttaggatacgatgatagaaattacagctgaatttgttttctaatacttctggagtgttgttacttttgtaatgcacatataaaagagcatgtatgggatgaagttccttgccaatgggaacggaaaaaagggaacttggcatgtgcataaatctttttagggcgagtgtgaaggtaatgaagtgaaattagaattaaactgttcttgtggcagccaccagggggcgttgccggcccctgagcaggttgatggacacctaggggcaacgtggcaccaaccccggacatagtatgcaaaggactgtttatatctacaggatgtgtgcaagttgtgtttgtaattctgtgtatgaatctgtccatgttgatgaattcatattaccccattaaaaatgaattatctgcctcctgcctggagtgaaattaaatacagattatctgtttggtggtttgtttctggaagaactctatttctttttcttttctgtctctctctctctttttttttttctttttttttaaggcagcatctcactctgttgcccaggctgcagtgcagtggcgcgatcatggctcactgcagcggcgcgatcatggctcactgcagcctccacctcctgagctcaagcagtcctctccattcagcctcccaagtatttgggactacagataatgcaccaccatgccaggctaattttttaaaatgttttgtagcaatgggggggtctcagtatgttgcccaggctggtctcaaactcctggcctcaagcaatcatcctgcctcggcctctcaaagtgctgggattacaggcatgagccaccgtgcccagcctctatttcctatatcccattgactaatatttacggaccaagagtttgaaagatgacagtggattctgttcattctctaaagccattgcagtttggtatttaatcttttattgttgttgttggcagcttcatggcatgtcatttttaccaaggactggaagaataggagaattcagacatagaataaattgggagtctgtttgctcagctggggtcccagtaatagtcagtctctcatttttcaactcagtgaagtcgtttgaaaataaaactccaaagaggagttaagggcgctgagctgctttgcagctccctttgtggctcatctctgcgtgactgagaggaagcaccatgccccaatggcaaacatgagtgggtgaggcgaatggagcaggtgtggaggatccctttgtggttctaggacctctgccaacagaggaatcttatcaagaagtgggactggccctagctttgctttatttatgagcttgcatgcttgagaaagaaaacagctgttttggccattcttgtcaatggccatatttaagttctgatttcacacacatcacagagtgtttacttaaacagtctttttcttttttaactttaaaatgaattataggccaagtatgatggctcacacctgtaattccagcactttgggaggctgaggtgggcggattgcttgattccaggagttcaagaccagcctgggcaacatggcaaaattctgtctctacaaaaaatacaaaaattagctgggcatggtggcatggcattgtggccccagctgctcaagaggctgaggtgggaggattgcttgaacccaggaggttgaggctgcagtgagctgtgtttgtgccactgcactccagcctgggtgacagagcaagaccctgtctcaaaaatatatatatatatattttcaaatatatttcatttgacccaaattctactttagagtagaatactatatcctagagcagatgtccaccaactttttctgccaagggccaaatagtattttaggcttttcacaccagtactttaggttttgaaatacagaaatttgaattttgtatacctttcctgtgtcacacaattttcttttgattatttttcagccattaaaagaaatataaaaactggccaggcatggtggctcacctctataatcccagcactttgggagaccgaagggggtggatcacctgaggtcaggagtttgaaaccagcttggccaacatggtgaaacctcacctctactaaaaatagaacaatcacccaggtgtggtggcacgcgcctgtaatcccagctactcaggaggcagaggtaggagaatcgcctgaatctggaaggcagaggttgcagtgagtcgagatcataccactgcactccagcctgggcgacagagtgagactctgtctcaaaacaaataaaaattttaaaaaacgtaaaaaccattcttagcttgcaagtcatacaaagacagatggcaggccagatttgtccatcaggccgtagtttgctgagccctgtcctagatggacgaataagtgacagagtgacagtgcaaagaacctctcagaggggtaaggcttagagagtagtcacgagatggcatgaatccgtagctgcctctggatccgtctgtaggaaagaggagactgaggaccagtttggaaactggcatggaggtgaattgaggaagaaaaaggaaaagagagcaggagtgagtggactgagaaatgccaggacattcctctgcttctttccttgtgttttctgcagttctaatgtgagatggttagcctagcagcagagtgatacatggcaattcacctggtcattccctgcacttgattgcttgaacaggtctttccagtttgagctgtgataaatggggtgtgtgatcaggagaaaaattctaagcttcatggagcaggagcaggatctggggctggtttctcctcagcaggcatcgggactgtatggtttttctgccctctgtgtctacagtgtggtcatcatgatttcaaatattggtcccatcatcctcatgacctatgacattggctccaaaattctaatctttgagagtccaaatgaaatctcccagatagcctccctcctctgcgcacagtgctggaacgatatatctctggttttttgttgtcgttgttgctgttctgctgctgctgtggcctcagtgctcagagcggagaccagaccctgcctggcccctcctcctcctccctgtcagagacacaccacagggattctgctccctctctcctgctctattgcctcatttcccacagcttccacatacctttcttgcctgcctcatgcccccactgaaatctctcctgatgattacttgctccccatttgtcatctcagtcttaggtggcatgtcttgcagaagcccacaccttcccccgcattctccctgccaacctttcctgctcaggtcaccctccggcccacttttttccctggccttggccccttaggaagacggagaaccctttccatctttgtaagcctcttgctgccctgctgagcccctccggcttctctgctgtgcacctcccaccttttccttaatttgcctggtcctcctccacacatttctcttctcttctgtcctatcatgctagaaataaaccacagcatctggtagagaggcggcgttatcagattctcatttagcaatttgtgtttttccattttgcacacatttcaatgaaatgtcaagtatcaacagtttggagatttttttgtttaagagacaggatctccctatgttgtccaggctggtctccaactcctggcctcaaaccatcctcctgccttagcctcccaaagtgctgggattataggcgtgagccaccatggccaaccagtttagggatcttttgaacaagctgatatgtttgtatttttttaacctaccgtagcatggagttacataagccttccttttattttccatacattttcagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctttgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactc
